United States Patent 11,278,029 (ANTIFUNGAL METHYLOBACTERIUM COMPOSITIONS AND METHODS OF USE) - sequence listing, part 2

SEQ ID NO: 5632 - DNA, 474 bp, Methylobacterium sp.
atgtccagtgtgtggcagtacctgaccctcggcctcggcgccgagaccttcgggatcgacgtcgagcacgtccacgagatcctcgactaccgggtcccggccgcgctgccgcaggcgccggccttcctgctcggcatgatcgacgtgcgcgggcagagctacccggtggtggacctgcggaccaagctcggcctgccgccggtggcgcgcacgccggccacccggatcatcctgctcaacgtgccgatgcccgaccgggcgctgcgggtcgggttcgtggccgaccgggtgatcgaggtgaccgagctcgaccgggccgagatggaggcggcgcccgaggtcggcgggcgctggaacgcccgctacatcgcggggatcggccgccggggcgaggccttcgtggtggtgttcgacctcgtcgcgctcatggacggcgacggcccggccctggtcgcgaccccgcaggccgcctga

SEQ ID NO: 5633 - DNA, 522 bp, Methylobacterium sp.
atgagcggcggcgtggcgcgcggagtcgtcgagcccggcccgcaggcggccgccgacggcggtcagcgggacggtcggcagggcggccagcggggcggtcagcaggtggtgatgttccggatcggctcggagagcttcgcgctggaggccgggatggtgcgcgagatcatcgatccgatcccggcgacgcgggtggcgggagcgcgcccgcatatcgatcggatcgtgaacgtgcgcggcaacgtcgtgcctctggccgacatccgcgagcggttcgggatgccggcggcgtcggcgagcccggacacgcgcttcctcgtcctggaagtggccgtggcgggcgaccccgtggtcgtcgcgctggtggccgacaaggtgttcgcggtcacggaggtcgatccggcgcagtgcgaggcggtgccgcccgtcggcacgacatggcgcccggagtacatccgctcgatcgtcaaggcgggggacgaattcatcatcgtccccgagctcgagaagatcctcaactga

SEQ ID NO: 5634 - DNA, 2100 bp, Methylobacterium sp.
atgactgctctcgatcccgcggagatcttccgcgccgaggccgccgagctgctcgcccgcctggagacgacgctgctcgacctcggcgaccggcccgaggaccgggccctgatcgacacggccttccgggccctgcacaccatcaagggctcgggcgccatgttcggcttcgagcaggtcgccgccttcacccacgacttcgaaaccgccttcgaccgtgtccggcgcggcgaggtcccggtcggccgcgacctcgtcaacgtctccctctcggcgaaggactacatccgcggcctcatcgaggagcccgaggcgagcgccccgatcatcggcgaggctatcctggccgaactcgagcagctgctcggctccgcgtcccgcccagccgccccgtccgcgctcctcccggagccggccgccgatcccgctgcggcgggggagggcggctggcagatcggcatcgcgttcgcgcccgagatcctccgcaacgggaccaatcccctggcgctcctcgacgagctgcgcgatctcggcgcctgcacgatcgtgccgcgcctcgacgcgctgcccgagctgacggccctcgatcccgagagcctcgccatcggctgggacgtcacgctgcgcgcggccgtgccccgcgaggcgatcgaggacgtcttcctgttcgtgcgggacgagatggccctgacgctcgtcccggtctcggccgcgccgccggacgtcgcgcccgagccggccgaggccgcaccgccgccgtctgggccgccgtcagggccgccgtcggggccaccgtccggcgcggctccggccgccggcctcgccgcccccgcctccggcgagaccggaccggccgggccggggccggtcgagcccgcggcccgggccgccgagcgcgtcccggcccggcgggccgaggagcggccggccagcagcgtccgggtcgaggccgagcggctcgacgagctgatggaccgggtcggcgagctggtcatcgcccaggcgcgtctcagccagctcgccggcctgcatgccgatcccggcctcaaggccatcgccgaggagatcgagcgcctgtccgcgcggctgcgcgacaccacgatgagcatccgcatggtcgccatcggcgccctgttcggccgcttccgccgcctcgtccacgacctctcgcgcgatctcggcaagccggtcgagttcgtgaccgccggcgaggagaccgagctcgacaagaccgtgatcgagcgcctggccgacccgctcgtccacctgatccgcaacgcgatcgaccacggcatcgaggcgcccgagcgccgcgcggccggcggcaaggccgccaccgggcggatcacgctcaccgccgagcatgtcggcgcgcaggtgctggtgagcgtgcgcgacgacggcgccgggctcgacgcggcccgcatccgcgccaaggccgaggagaagggcctgtgcgcgccgggcgcggtgctcaccgaccagcagatctaccagttcctattcgcgccgggcttctcgaccgcccaggagatctcggccctgtcggggcgcggggtcggcatggacgtcgtcaagaagacgatcgagagcctgcgcggcacgatcgacatcgcgaccgagccgggcggcggcacctgcgtggcgctgcgcctgccgctgacgctggcgatcatcgaggggctgctgatccgggtgggggaaggacgctacgtcatcccgctggccgcggtggaggaatgcgtcgagctgcccgccagcgagcgcggcggccgcgggcgggacttcctcaacatccgcggcgcgctggtgccgttcctgcggctgcgcagcctgttcggggccgcgggcgagccggacctgcaccagaaggtgatcgtggtggccgccggtgaggcgcgggtcggcctggtggcggaccagatcatcggcaaccaccagaccgtgatcaagtcgctgtcgaagctgcacgcggacgtggcgaccttctccggggcgacgatcctgggtgacggcacggccgcgctgatcatcgatgtcggccgcctcgtgagcggcgggcgcgccgagggcgtgcgcgagtacctggaggtggcgtga

SEQ ID NO: 5635 - DNA, 282 bp, Methylobacterium sp.
atgtccgaggctcccgtcctcacgctcggtcccgactgcaccatccggaccgtccgggcgctgcaggacacgctggcggcggcgctcgccggcggggcgcgcctcaccctcgactgcgcggcggtcgagcgcgcggacgtcaccttcgtccagatcgtgctcgcggccgacaggacggcgcggggtcgggccgccgggatcgcgctggtcaacgtccccccggcggtcgagagcgcgttccggcgcgccgcgatcgaacaccccagcgcgccgctcctctag

SEQ ID NO: 5636 - DNA, 1545 bp, Methylobacterium sp.
ttggctgcgccgcagctcgcgcggccggccctggcgcaggggggcaaggtcctgcgcttcgtgccgcaggcgaacctcgccaatttcgacccgatctgggggacccagtacgtggtgcgcaacgccggcaccctcgtctgggacatgctctacggcgtcgacgcgcagctgaagccgcagcgccagatggtcgagtccgaggaggtctcgggcgacaagctgacctggaccttccggctgcgccccggcctgaagtggcacgacggcgagccggtgctggccaaggacgtggtggcgagcctcacccgctggatggcccgggacccgatcggcctgatgatccgcggcatccaggacgacctcgcggcgaccgacgacaggaccttccagtggcgcctgaagaagccgttcccgaagctgctctacgcgctcggcaagaccaacgccccgatggcgctgatgatgccggagcggatcgccaagaccgacccgttcacgcagatcaccgagtatgtcggctcgggcccgatgaagttcgtccgcaacgagtgggtgccgggcgcccgggcggtgttcgagacatttgccgactacaagccccgagacgagccgaattcctggctcgcgggcggcaagcgcatgctggtcgaccgggtcgagtgggtgatcatgcccgacccggccaccgcctcggcggccctgcagaacggcgaggtcgactggtgggagaacccgatctccgacctcgtgccgctcctgcgcaagaacagcagcctcaacgtcgatatcgccgatccgctgggcaatgtcgggtcgttccggatgaaccacctgcacccgcccttcgacaatccgaagatccgccaggccgtcatgaccgcgatgagccaggaggattacatgcgctcgatcgtcggcgacgacgacagcctgtggaagacgctgccgggcttcttcacgccggggacgcccctctacagcgaggcgggcggcggcaatgtcggcaagggcgacatcaagctcggccagatgctgctcaaggaagccggctacaagggcgagccggtggtctgcatcgtggcccaggaccaggggatcaccaaggcgcagggcgacatcaccgccgacctcctgaagaagatgggcttcaacgtcgacttcgtcgccaccgactggggcaccaccggcacccgccgggcctccaaggcgccgccgtcccagggcggctggaacatgttccacacctggcacgcgggcgccgactgcatcaatccggcgggctacccggcggtgcgggcgagcggcgacaaggcgtggttcggctggccgaacatcccgccggtggagaccgccatcgccgagtggttcgacgccgccgacccggccgccgagaaggccgccatcgacaaggtcaacgccgccgcctgcgagggcgtggtctacgtgcccaccgggttcttcctcggctaccaggcgtggcgcaagaacgtctcgggcatcgtgaaggggccgatccccttcacctggggcgtgtcgaaggcgtga

SEQ ID NO: 5637 - DNA, 936 bp, Methylobacterium sp.
atgagggtcgcctgcatcggcgagtgcatggtcgaactgtccgaacgcccggacggggatctggtccggggcttcggcggcgacacgctgaacaccgcgctctacctcgcgcgcctcggcgtcgcggtggactacgtgaccgcgctgggcgacgacatctggagcgacgagatggcggcggcctggggccgcgagggcatcggcctcgaccgggtccggcgcctgcagggccggatgccgggcctctacatcatccgcacggatgccgacggcgagcgcagcttccactactggcgcgaccgggccgcggcccgggacctcttcaccgagccgggcgccgccgagacggaggcggagctggagcgctacgacctcgtctacctgtccggcatcagcctctcgctctacggcgagaccgggcgcgccgccctgttcgagacgctgtcgcgcctgcgggagcggggcgggcaggtcgccttcgacaccaattaccgtccccgcggctggcccgaccgggacgaggcctgggcggcgttccgcgcggccctggacctggccgacgtgatcttcgcctcggcggaggatctggactggctgttcggcgcggcgggcgaggacgaggtgctgcgccaccgcggccgggccgagatcgtgctcaagacctcggacggatccggccccgtcgcccgggtgctgcacggcccggccgacaccgccgtgccggccgggcgcgccgcgcgggtcgtcgacacgacggcggcgggcgacagtttcgcggcgggctacctcgcggcgcgcatcgccgggctggcaccggaagccgccgccgccgaagcgcaccgcctggccggggcggtgatcgggcatcgcggcgccgtgattccccgggacgcgatgccggtccccgccgcccgaccgccgggtgcggacgcctga

SEQ ID NO: 5638 - DNA, 291 bp, Methylobacterium sp.
atgccgcacggtgcgcgaacgagcctcgccgccctcatgctggtcctcgggatcggcggcgcctccgccgaaaccgtcgccacgacctggacggatccgccggcccacaaggccggatcgccgaaggcgccggccacggacacgaaggccgccccgccggcaccgtccgccgcgactcccaccgggacgcccgccgccgcgaccgagacccggccggccaccgcccggcggaaggccgtggcggtgcggcgcgcgccggagcggaaggccgcccgcgcggcgcaccgccac

SEQ ID NO: 5639 - DNA, 312 bp, Methylobacterium sp.
ccgcgccgggcccgcgtcgccgcggcgccgccccggtccgtccgggccgccccgcaggtcgtcgccgccgcgccgccgcccccggagggctacgcccgctacagggcctacaattacgggccgggctacggctacggctacgcaccgggttacgcccaaggttacacccagggctacaccgacgaccgcctcgaccgcctgagcagcgcccaggccgccggctacgtcgtggtccaccgccggacggtgcagttccccgacggccggactctgcgggtctatcgcccggacgacgagggcgagccgttctga

SEQ ID NO: 5640 - DNA, 195 bp, Methylobacterium sp.
atgatcgatctcaacacggcgacggccgaggagctggacagcgttccagcactcaagggccacggcttcgagatcgtgcgctaccgggaggagcgcggccggttcaccagcctgcggcaactcgacgaggtgccgggcctcagcggcaagaccgacggtgtcgccgatcaggtcacagtcgcggacagtccttag

SEQ ID NO: 5641 - DNA, 960 bp, Methylobacterium sp.
atggaaagcgccctgatcacgcccaccctcgacgacgtcctggccgcccacgagcgcatccggccctacatccacgagacgccggtcctgacctcgcggatcatcgacgaagcggccggcgcgcagctgttcttcaagtgcgagaacctgcagaaggccggcgccttcaaggcgcggggcgcctcgaacgccgtcttcagcctcaccgacgcgcaggctgcccggggcgtggcgacccactcgtcgggcaaccacggcacctgcctgtcctacgcggcgggccggcgcggcatcccctgcacggtggtgatgccgcgcaccgcgccccaggcgaagaaggacgccgtgcgcggctacggcggccgggtggtggagtgcgagccgtccacctcatcgcgcgaggccgtcttcgccgaggtcgtcgccgagaccggcgcggagttcgtgcacccctacaacgatccccgggtcatcgccgggcaggcgacctgcgcccgcgagctgatcgcgcaggtcccggatctcgacgcggtgatcgccccgatcggcggcggcggcatggtgtcgggcacctgcctgaccctggccggtctcgccccgcacatcgccgtctacgcggcggagcccgagcaggcggacgacgcccaccgcagcctgaaggccggtcggatcatcgccgacgacgcgccggtgacggtcgcggacgggctcaaggtgccgctgaaggacctcacgtggcacttcgtccgccaccacgtcgccgacatcctcacggtctccgaggccgagatcgtcgcggcgatgcagttgatctggaagcggctgaagatcgtcatggagccgtcgagtgccgtcgccctggcggcggtgctgaagaaccgccctgtcttcgcgaacaagcgggtgggcgtgatcatcacgggcgggaacgtcgatctcgacgcgctgccctggcaataa

SEQ ID NO: 5642 - DNA, 1191 bp, Methylobacterium sp.
atgttcgcacagaatcccgtcttcattcccggcccgaccaatatgccggaagtgcttcgccgcgcggccgacatgccgacgctggatcaccggtcgccgctgttcgcgcagatccttcatccggcgctcgccggcgtgaagaaggtcctgaagagcgaggacgccgaggtgttcatcttcccgtcgacggcgacgggcggctgggagaccgcgctctccaacacgctcagcgccggcgacacggtgctggcggcgcgccacggcatgttcagccaccgctggatcgacatgacgcgccgccacggccttgatgtccggatgatcgaagccccgtggggcgaggggcttccggcagatcgcttcgccgaggccctcgcggccgacaaggcgcaccgcatccgggccgtgctcgtcacgcacaacgagacggcgaccggcgtccgctcggacgtcgccgccgtgcgccgcgcgctggatgccagcaaccacccggctctgctgctggtcgacggcgtcagctcgatcgcgtccatggatttccgcatggacgagtggggcgtcgatgtcgccgtgacgggctcgcagaagggcttcatgctgcccgcgggcctcgccatcgtggcgttctcgcccaaggccatggccgccacggcgacggcgacgctgccgcggacctatttcgacatccgcgacatggcgaagggctaccccaatggcgcctatccctacacgccggcggtcgggctcctgaacggcctgaagctgtcgacggagctgctcctggccgaggggctcgagaccgtcttcgcccggcaccgccgcatcgcggacgggatccgcgccgccgtcgccgcctggggcctggaactctgcgccgcgcgcccggacctctactcggacacggtgagcgcgatccgcaccccggagggcttcgacgccacgcggatcgtcacccacgcggcgcgccactacgacgtcgccttcggggtgggcctcggcgaggtcgccgggaaggtcttccgcatcggccacctcggcagcctcacggatgtgatggcgctgtcggggatcgccgccgccgagatggcgatggccgatctcggcctgcgcatcgcgctgggatcgggggtcgcggccgcgcaggcggtgtaccgccgcgccccggccgccgccctgcgcgccgccgcctga

SEQ ID NO: 5643 - DNA, 789 bp, Methylobacterium sp.
atgaccctccccgttcccagcctgcccgatctgctgcccaccggcccggcccggttcctgggctggtccatgatcgccgacccgatgctggccggcttcctggcgcgcgccggcttcgacgccgtcctgctggatcagcagcacggcacctacgactacaaaacgtcgtgtgcggcgatcaccgaggtcgccctggccggcaaatcgaccctggtgcgcgtgccagtgggcgacttcgccatggtctcgcggatgctcgacgcgggcgcggccggcgtcgtggcgccgatgatcaacaccgtcgcggatgccgaggccctggcggcggccgcgaaattcccgccggtcgggcagcggagctgggggccggaccgggccatgtggctctcggggctccggaacggcgcggactacctcgcgggcgccaacgatcgggcgctcacgatcgccatgtgcgagaccgaggcgggcatcgccgacctggaggcgatcctcgccgtgccgggcatcgacggcgtcctggtcggccccgccgacctgtcgatcgccctgtccaagggtgcggccatcgacccgctgggatcggcggtcacggcggccctcggcgagatcgcgcgcaagacccgggcggcgggcaagatcccctgcgccttcgcgccgtcgccggcgcgggcccgggagatggtcggaatgggctaccagttggtctcggtcgagtacgacgcgctgaccatcgtcaacgccttcgcgcgggtgctctgcgaggccgacccggcgcgggccggctga

SEQ ID NO: 5644 - DNA, 1596 bp, Methylobacterium sp.
atgccagcacagctctccctcctgaacctcgcgtggaccgcgcctgacgggcgcgccgtcctctccggcatcaccgccagcttcgggcaggagcggaccggcatcgtcggccgcaacggggccggcaagagcatgctcctgaacctcctggcgggccgcctcgcgccgacgggcggcagcattcaccgcgacggcacggtcgccctgctgcgccagttcgcgggcccgaccgccgacgagaccgtcgccgacctgttcggcgcgacggcgggcttggcgctgctccgccgcgcggaggccggtgcggcggaggccgacgagctcgccgtcgccgactggacgctcgcggagcgcctgacgggagcgctggcgcggatgggcgtggcggtgggccccgacacgccgctgcggcgtctctccggcgggcagcgcgcccgcgcggcccttgcggcggcgatcttcgccgcgccggatttcctgctcctcgacgagccgaccaacgacctcgatcgcgacgggcggcgggcggtccaggaacttctgaaggcgtggcgcgccggcgcgatcgtggtcagccacgaccgggccctgctcgacgcgatggacgcgatcgtggacctcgcgccgggggaggcgacccgctaccggggcaatctcgacgccttccggcaggccaaggcgacgcgtctcgccgcggccgagcacgacctcgcggtcgccgagaagcgggcgacggacctcgcccgccgggcgcaggagcgcgtcgagcgccagcagcgccgcgacgcggccgggcaccgccgctccgcgaagggcgacctgccccggatcctggccggggctcgccgggacaacgcggagcggaatgcgggcgggagcgcgcacctcgccgagcgccagcgcgccggcgccgaggccgatctggcggaggcccgggaccggatcgcggcggtgaagccggccgcgatcgcgctcctgccgagcgggctccacgccgaccggcgcgtcctcgcgctcaccgacgtgacggtcggctaccggccgggtcagccggtcctgcgggacgtgtccctcgcggtcacgggtccggagcgcgtcgccctctgcgggcggaacggctcgggcaagtcgaccctgctcgcgctggtcgccggccgcctcagcccgtggtcgggccgcgtctcggtcggcgtgcgcgccgcgctgctcgaccagcgcctcgacctcctcgaccgcgaccggacggtggcggagaacttcgcgcgcctcaacccggaggaggacgcgaacgggtgccgggcggcgctggcgcggttccagttccgggcggcggccgcggaccgccccgtcgcggcgctgagcggcggcgagcaggtccggaccgccctcgcctgcgtgctcggcaaccgcgcgcccccgcccctcctgatcctcgacgagccgaccaaccatctcgacctggacgcggtcgaggccctcgaggccgggttggcggcctatgacggcgcgcttctcgtcgtcagtcacgactcggccttcctggacgcgttggggatcacccggcgcgtcgacctcgccgaccggccccgcgcctga

SEQ ID NO: 5645 - DNA, 1059 bp, Methylobacterium sp.
atgagcgacgccgatgtcttctccggcgtgaagccggtcgagccgcgtcaccggatcgacgaggcgaagctcgccgcctggatggaagggcatgtgcgcggctatgccggcccgctcaccgtgcagcagttccgcggcggccagtcgaacccgacctaccggctcgacacgccaggccaggcctacgtgctgcggcgcaagcctttcggcccgctcctgccctcggcccacgcggtggagcgcgagttccgggtgatcggcgccctctacggcgaggggttcccggtgccgcgccccttcgcgctgtgcgaggatcccgacatcatcggcgcggccttctacgtgatggaggcggtggacggcgccgtccactgggacggcgcgctgcccggcctcgacccccacgcccgccaccggcactacgcgggcatgatcgccacgctggcgcgcctgcacgcgatcgacccggaggcggcggggctctccgattacggccggcccggcaactacttcgcccggcaggtcgaccgctggccccgccagtaccgcgccgccgaggacgggcgcctggaggatgtcgagcgcctgatcgcgtggctgcccaggacggtgccggagcagcagggtgcctgcgtggtccacggcgattaccgcctcgacaacctgatcttctccagggacggcggcgtcagcgccgtcctcgactgggaattgtcgacactcggcgatccgctggccgatttcagctacctgctgatgcagtgggaactcccggcggacgggcgcagcgggctcggcggcctcgacctgccggcgctcggcatccccacccgggacgaggccgtggcgctctactgccgggcggcggaccggacaaacctgcccgacctcgactggtacttcgcctacaacctgttccggctggtcggcatcctccagggcgtggcggcccgcgccaaggccggcaacgccgcgagcgagcacgccgccgccatggcggcgcgcgtgccgaagctcgccgaagcggcctggcgcttcgccgagcgggcgggggcctga

SEQ ID NO: 5646 - DNA, 1242 bp, Methylobacterium sp.
gtggacttcaccctctcccagtcccagacgcgctggctgacccgcgtccgcgccttcatcgccgacgcgatcctgccggccgccgccgcggtggcgtccgagcgcgcgcagagccgcgaaccctcccccacgatggagcggctgaaggagacggcccgtgccgagggcctgtggaacctgttcctgccgccctcctccgagcacgacaccgacgactatcgcggcgccggcctgaccaacctcgactacgcgctgtgcgccgaagagatgggccgggtcgggatcgcctcggaggtgttcaactgcgcggcgcccgatactggcaacatggaggtgctgcaccgctacggcaccgcggcccagaaggaccggtggctgaagcccctgatggcgggtgagatccgctcggccttcctgatgaccgagccggaggtcgcctcctcggacgccaccaacatcagcacgtcgatccgccgcgacggcgaccactacgtgatcgacggccgcaagtggtggtcgaccggcgtcggcgacccgcgctgccggatcgcgatcctgatgggcaagaccgacccggaggccccccgccaccggcagcaatcgcagatcctcgtgcccatggatacgccgggggtccgggtggagcgcctgctcccggtcttcggctacgaggacgcgcccaagggccacggcgaggtggtgctggagaatgtccgcgtgccggccgagaacctgatcctcggcgagggacgcggcttcgagatcgcgcaaggtaggctcgggcccgggcgcatccaccattgcatgcgcaccgtcggggcggccgaggtggcgctggaggccatggcgcggcggctcgtatcccgcgtcgccttcggcaagcggatcagcgagcagtcggtctgggagcagcgggtcgccgaggcgcggatcgacatcgagatgacccgcctcctctgcctgaaggccgccgacatgatggacaaggtcggcaacaagggcgccaagctcgagatcgccatgatcaaggtcgcggcgccgcgggtcgccctcaaggtgatcgacgacgccatccaggcccatggcggggccggcgtctcggaggatttcgggctcgccaagatgtacgcccatatccgcaccctgcggctcgccgacgggcccgacgaggtccacaaccggtcgatcgcgcggctggaattcgggcgctacaccaacagaagcgaggcggagcgcgcatga

SEQ ID NO: 5647 - DNA, 1506 bp, Methylobacterium sp.
atgaccgtcgccgtcgtgcccccgccggccgtgtcgcccgtcctggccgagccctgcctcaccgtgcgcggcctgaccaagcgctacggcggcctcgtcgccgtcaagaacatcgacctcgacctgcgcccgggcgagatcctcggcctgatcggcccgaacggctcgggcaagtccaccgtgatgaagctgatcatggggctggagcggccgagcgccggctcgatccgcctcgacggcacggagatcggcggcatgccggcccaccgggtcgcccgctccgggatcggcctcgtgttccagcacgcgcggccgctccagcggcagaccgtgctggagaacatcagcctcgcgctcctgcccgacagcctgatccggctggcggccgacccccacgtggcgcggcgcgcgagagaaatcgccgagcgcgtcggcctcggcgcggtcgtcgaccggcgccccggcaccctgcccttcgcggatctccgccggctggagctcgccaaggccatcgcccgcgacccccgggtggtgctggtcgacgagcccttcgcgggcctgaccggcggcgaggtcgcggccttctcggagctgatccgggggtttcgcgacgagggcaaggccgtgctcctcgtcgaccacaacgtgaagagcgtcgcggccatcgtcgaccgggtcttcgcgatgtatctcggcgagcgcatcgccgagggctcggccgagtccgtgatggctgacccgaccgtgcgccgggtctatctcggcggcagcatcgagacggcagcccggcctgaggcggcgttcaagcccgactcgctgctcaccgtcgagggcgtcgacgtgctctacggcaaggcgcaggccctgcgctcggcctcgatccacgtccacgagggcgagttcgtctcggtggtcggcctgaacggcgccggcaagaccacgctgttcaacgccatctcgggcctcgtgccgcacacgggcgcgatccggttcgacggccgggacctctcccggatgaagcccgccgccatcgcccgggccggcatcgtccaggtgcccgagacccgggagctgttcggcgacctcagcgtgcgcgagaatctcgacctcggcggccagcattttccgaaggccgagagcgccaggcagcgcgactggctctacgagctgttcccgatccttaaggaccgtgaggcgcagagcgcccgcaccctgtcgggcggcgagcagcagatgctgaccatcgcccgggcgctgatgatgcgcccgcgcctcctgatcctcgacgagccgacgctcggcctcgccccggtgatcctggagctgctgtcgaaggcgctggagaagctgcgccagacgacgccgatcacggtgctgctcggcgagcagaacgtcaccttcgcgctcccccacgccgaccgggtctacgtgctggaacaggcccggatcgtctgggagggaccgccgcagcgcttcgccagcgagatgggatcggcctatctgtga

SEQ ID NO: 5648 - DNA, 921 bp, Methylobacterium sp.
atgaagctcctcaccacccccggcttctgggtcgcgatcctcgccgtcctggccgccgccaccctgccctggtgggtctccggctacatcctcggcctcctgaccatcgcctactatttcggcgtgttctccatggcctgggacctgctcttcggtttcgccggcgaggtgaatttcggcccgaccttcctgatcgggctcggggcctacggcgccggcatcctcaacaaccgctacgaattgccgatcccctactgcctcgcggccgggaccgtgctcgccgtggtcggcggcctcgccctggcgctgccggcgctgaaggtccgcggcccctatttcgggctgatcaccctggtggcggtcctgctcctgcagaacatgatcgtggtcttctccggcctcaccggcggcgagatcggcctgaccgtgccggacgtcatctccatcgacgccgacaccaattactggctggcgctgggcttcatggcggtctcgggcctgatcctcacggccatcgcccgctcgccagcggggctgatcctccaggccgccggccaggacccggtggtgaccggggcgctcggcttcaacgtcgccaagcacaagctcgcggccttcgcggtcagcgccgccttctcgggcctcgcgggcgggctggtggtcttctacatgggcaccgcctcagtcggcacgctgatcaacacctcggtcggcgtgcaggtgatcatcgcggcggtgctcggcggaaggcgcaccatcgtgggcgcggccttgggcgccgtgttcctgatcgcggcgggcgagctgctgcggccgctcggtggcctctcgaccttcgtggtctcggcggtggctctgctggtgatcctgttcgtgccctcggggctgctcggcctcggatcgctccggagagcccgatga

SEQ ID NO: 5649 - DNA, 876 bp, Methylobacterium sp.
atgatcggcctccagatcctcgtcgacggtttcgcgatctcgtccctctacgcgctcggcgcgatgggcttcaccctgatcttcggggtctcgggcgtcctcaacctgacccacggcgccctgatggtcatggccgcggtggcggcctgggcggcgtcggcgctgttcgggctcggctcctacgcgggcgctgtgatcggcatcctgtgcgggctcgcgggcgcgctggtcacctacttcgcggtggtcgcgccgatcgagcgcagccgggccatcccgcgggaggagaaggagatcttcgtgctcacggggacgctgctctgggggatcatgatccaggagctggtggcctacttcttcaccgacaacccgaagaccgtgctgccgatcgtcgagggcgtcttcgagatcgccggcgtgcggacgccgaggaaccaggtcttcaccgcggtgatctgctgggtggtgatcggcctgctctggctgttcgtgaaccgggcgcgggccggcaaggtcctgctcgccgcctccatgaacccgcggggcgtcacgctgctcggccacgacatgggcaagatctacgtggcggtctgggcgatctacggcctgctcgccggcaccgccggagtgctgctcgggatgttcctcggggtgtcgtcgtactcggtggggccgctcaccgcgagcgccttctccatcgtggtgctggggggcctcgggagcgtcaccggctcgctgatcgccgcctacgtggtgggttacctcgagaccgccaccgcctacctgatctcgccggcctaccgggtgatcccggcgctgctcctgctggtcgcagtcatgtacctgcgcccgcagggcctgctggggcggcggtga

SEQ ID NO: 5650 - DNA, 396 bp, Methylobacterium sp.
atgacccgatttcgcgccgcactgctcgcgcccgccctgatcctgaccgcctgcacgaccgtctgcacgaccgtctgcgccgcgacgggagcctccgcggccaaccggttcgacgggtcctggtcggtcatcgccaccgcggagaccgggagctgcacggggccctacagctatcccatcgtcatccgggacgggaccgtggacgacgccggcggcaacggcgtcgacgcctccggccgggccgggccggacggccggatcaccggcacgatccgcaaggggctggccagcgtctcggtcacgggccgcctgcgcgggtccgccgggaccggccgctggacgctgtccgggctcggtgcctgcgcggggcgctggacggcccgccgcaccggttag

SEQ ID NO: 5651 - DNA, 513 bp, Methylobacterium sp.
atgcggttcctggctgtcgcgctgccggccctgctcgctgcgggcctgattttggatggctccgcggtgcgcgccgtggatgccgggactgccccggcggcctcgccgatctacggcgtcaccgtcccggacgggtaccgcgactggcagctcgtcggcgtcgcgcaggagaccggggccctcgacgagctgcgcgccgtcgtcggaaacgcgcgggcgctggacgcctaccggtccggaaccctgccgttccccgacgggacggtgctggtgaagcgcgcctggacacgggtgccgtccgcggagttcgccccggccttcgtgcccggcggcgccacgacggtccaggtcatggtgaaggattcgcggcgctacgcggcgacggggggctgggggttcgggcgcttcgtcgacggcaagcccgcggacgcggcccagcacgagacctgcttcgcctgccacagcgccaatgtccgggaccacgacttcgtgttcacgcggctcgcgccttga

SEQ ID NO: 5652 - DNA, 828 bp, Methylobacterium sp.
atggccagtcttggtactcgagacgcgctcaccctcgttgagcgggacacggccgaaagccgccgcggcttttcgggtgcacatgccggtgacaacccggtcgtcgtcgagcaacgggaccagtcccggggccgcgccagccgcatcgtcatcatcgatcgacgccagctcgtcggccgatgcctcgccgcctcgctcagcgaggccgatcggcagacgtcgttcgaagtcttcgcggacatcgaatcgtggaagcggcagacgccgttcgtcgccgcgagcgtggtcgttctctgccggcccgacggcaacctgaccgagaccgaatggaccgagatcacgcgggagctggcgttcctgcagggcgaggccggcgctccgccggtggccgtcatctcggacggcgagaacctcgaccagatcgtgcggatcatcaagctcggcgtcaaaggctacatcccgacgacgacctccgtggacatcgccctgcaggcgctccagctcgtgcaggccggcggcgtctacatcccggccgaatgcctcctccccctgctggccaacatcaaggtggacgagccggtcgaggccggggacgacgacatcttctcgccgcggcagctctgcgtggcgcgggcgctccggaaggggacgccgaacaagatcatcgcgtacgaactcaacatgtgcgagagcaccgtgaaggttcatgtccgcaacatcatgaagaagctcaaggccaagaaccggaccgaggtcgcctacctgaccaacaagtacttcctccgggaagattccagcctggcgagcgtgaaggccccggcggcctga

SEQ ID NO: 5653 - DNA, 771 bp, Methylobacterium sp.
atgtccctgttcgacctgaccggcaagaccgccctcatcaccggctcgtcgcggggcatcgggcgggcgatcgccctgcggatggccgagcacggcgcccgggtggtgatctcctcgcgcaagcgcgaggcctgcgcggcggtggtcgccgagatcgaggccgcccatggggccggccgcgccgttgcgatcccggcaagcatctcggtgaaggcggagctggaacacctcgtcgccgagaccgagacccggctcggtcccgtggacgtgctggtctgcaacgccgccagcaatccctattacgggccgctggccggcatctccgacgcgcagttccgaaaaatcctcgagaacaacgtcctgtcgaaccactggctgatccagatggtcgcccccggcatggtggcgcggcgggacggcgcgatcgtcatcgtctcctcgatcggggcgctcaagggctcgccggtgatcggcgcctacaacgtctccaaggccgccgacctccaactcgcccgcaactacgcggtggagtacggccccgccaacgtgcgggtgaactgcctgtgcccggggctgatccgcaccgacttcgcccgggcgctgtgggaggatcccgagatgctcgccgccaccacggacgccgcccccctccgccggatcggcgagcccgacgagatcgcgggtgcggccgtgttcctggcctcggcggcgggccggttcgtgaccggccaggcgctcgtgatcgacggcggggtgacgatcgcgcgatga

SEQ ID NO: 5654 - DNA, 1773 bp, Methylobacterium sp.
atgagcctcgatccccgcatcctcgccggctggccggccctgcccttccgcgaggccgaggcgcggctcactgtctcaggggggccgttcgcgatcacgacgatcgacatccggggcgtgccgacccggatctgggagaaggccccgccgacgctgggcgacctgttccggatcgcgcgcggccacggggacaagaccttcgtggtctaccaggacgagcgcgtgaccttcacgggcttcgcccgcgccgccaccgccctggcgcgggctctcgtcgaggccggcgtgcgcaagggcgaccgggtcgccgtcgcgatgcgcaacctgcccgaatggccggtgagctatttcggcgcgctgctcgccggtgcgatcgcgacgccgctcaacgcgtggtggaccgggcccgaactcgcctacggcctgcagcattcgggggcgcgggtgctgatcgccgacggcgagcgcttcgaccggctggagccgcatctcgcggaatgccccgcgctggagcgcatcgtcacgacgcgaatggaggtcgattcccgggcgacgccgctcgccgacatcgtcgggcggatccacgactggggtgccctccccgacctgcccccgccggacatcgccctcgacccggaggacgacgcgaccctgttctacacctccggcacgaccggtaagcccaagggcgcggtcggcacccaccgggcggccgccaccacggtgatggcctacccctactcggcggcgcgcagcgccctgcgccggggcgaggcgccgccgaaacccgacccggccgcgccgcagcgggcggtgctgctggtgatcccgctgttccacgtcaccggctgccacgcgagcctgggggcggccctctacggcggccaccggctggtgatgatgcaccgctgggacgccgccgcggccctcgacctgatcgagcgggagggctgcacgagcgcgggcggcgtgccgaccatcgcgtggcagctcgccaacgcggcccgggaggccggccggccgctgccgaccctcgagggcgtcacctacggcggcgccccggccgccggcgacctcgtgcgggcgctgggcgaggccctgccgcgggtcgtcccgggcaccggctggggcatgaccgagacctcggcgaccttcacccaccaccagggcgaggattacctcgcccacccggaatcctgcggaccgcccctgccggtctgcgaggtgcggatcctcgatcccctcgggcaggatctgccgcccggcagcgtcggcgagctctgcgtgaagggtcccaacgtggtccgcggctactgggacgacccggccgccaccgcggaggtcctctccgagggctggctgcgcaccggcgacctcgcccgcgccgacgaggagggcttcctgaccatcgtcgaccggatcaaggacatgctgatccgcggcggcgagaacatctactgctgcgaggtcgagaacgccctctacgcgcacccggacgtgatcgacgccgtggtgctgccggtgccccacccgacgctgggcgaggagccgggcgccatcgtggtgctggccgagggcgccgagaccgacccggaggcgatccgcgccttcgcggccgagcggctcgcggcgttcaaggtgccggtgcggatcgagatctgggacgggctcctgccccgcaaccctgccgggaagatcctgcgggcgcccctgcgggcggtgttcgcggcgggctcagctcagaacggctcgccctcgtcgtccgggcgatag

SEQ ID NO: 5655 - DNA, 1143 bp, Methylobacterium sp.
gccgagccccggccggtcgaggcgggcggccacggccacggctgcggccacaacctcctcggctcggcggccttgctcgccgccaccgcgttgaaggactggctcgccgagaccgggacgccgggccgcgtgcgctactacggctgcccggcggaggaaggcggcgccgccaaggccttcatggtccgcgccggcgccttcgcggacgccgacatcgcgatctcctggcatccgggcagcttctgggaggtggcgccgccggtggcgctcgccaacacccgggccgacttcgtcttcaccggccgcaccgcccacgcggcggccgcgccccatctcgggcgctcggcgctcgacgccgtcgagctgatgagcgtcggtgtgaactacatgcgcgagcacatgccgtccgacgcgcgggtccactacgcctatctcgacgccggcggcatcgcgccgaacgtcgtccaggccggcgcgacggtgcgctactcgatccgggcccgcgacctccctggcatgctggcactggtcgagcgggtgaagaagatcgcgcagggcgccgccctgatgaccgagaccgccgtcgaagtgcggatcgtcagcgcggtgtcgaacctgctgggcaacgatcccctggagcgggcgctgcacggcgtcatggaggagctcgggccgccgcatttcgacgaggccgaccgggacttcgccggccggatccgcgggacgctcaccgacggcgacatcgatgccgtcttccgcgccatcgggatgccgcgcacagaggcaccgctcgccgacttcctcgtgcccctcgacgcgccgcgcaatccggcggtcggctcaacggatgtcggcgacgtcagctgggtggtgccgaccgtccaggcccacgcacccacggtggcgatcggcacgccgttccacacctggcaggtggtggcgcagggcaaggcccccgcggcccacaaggcgatggtgcaggtcgccaaggcgatggccgccaccggcgcccgggcggtgaccgacgcggccctgcgcgacgccgccaaggcggacctcgcccgccgcgtcggcgcggccggttacgtctcgccgctgccgccggaggtcgagccgccgctcggcatgtcgctggggcgctga

SEQ ID NO: 5656 - DNA, 669 bp, Methylobacterium sp.
atgacgtcgatcaacatctccctggacgccgcggccgcgtacatcgtgagcgacggcctcaggtatgatgcgcaccgaggcggcgccacctgctgcatcacgaaggtcatagcccttccgcacctccgggcagcggttgcgacccgagggagcgccttgctgcctcagatgatgttcggcggcctcaacgcgctcccatccttcgaggcgtgcatcgcggcgttgccggtgctgttcgccgacctgatgagccgcctggccacggtggaagtgccgctggggcctgagcatggcagctcagaggtgttcctcgtgggctggcgggaagccggcctgcgccccgagtgctggttcatccatgcaggcggtcagccgggcgaagcgttcaaggcgatgccaatgaacggggtcgcgccggcgatggatgggagcagctcgcgtctgcaagccctggctgcatcagcagtcgatccgttcgaccccgatccttgctactggccggagcgcgacgggcctgaactgatcgagggcactcgcagcctttacggcgagacgatcggcggcttctgccagctcaccaccgtcgcccgggacgagatcagcatgcggatcctgaagcgttggccggagcacgtcacgttgcctttcaacacggcgcctgtcccctaa

SEQ ID NO: 5657 - DNA, 234 bp, Methylobacterium sp.
tttgcgctctacgccgcgaccaacgcggtcgtgcgcgcctatcgcccactgctcggcgagctcggtctgacctacccgcagtacctcgtcatgctggcgctctggcaggacggatccgcgccggtgcacgccttggccgagcggctgcaactcgggtccaacgccgtgacccctctcgtcgacaagcttgaggcggccggcttcgtcacccgcgcacgcggcgccgaccgccgc

SEQ ID NO: 5658 - DNA, 753 bp, Methylobacterium sp.
gtgacggctcccgtcggtcacgcggccgtcgacccgggcgcaggcgagacgctgcgggtgcgtgtccggcgcggcgagaccgtcgcggactacgcggtgccgcgccgggccaaccagacggtgctcgacgtcgtcaccgagatccagcgcgaccaggaccccaccctcgcctaccggttcgcctgccgggtcggcatgtgcggctcctgcggcatgacggtgaacgggcgcccgcgctggacctgccgcacccgcgtcgccgccgtggcgccggacggggtgctgacgctcgagcccctgcgcaacctgccggtggtgaaggacctcgcggtcgacatggagcccttcttcgagaagtggcgccgggcccacggcttcttcgagccgggcgagaacccgcccgaggatttcgcggtcgtggaaccggaatccgccgcgcgccgggaggtcgatgccggcatcgagtgcatcaattgcggcgtctgctacgccgcctgcgatctggtgacgtggaaccccgactatctcgggcccgcggccctcaatcgggcctggacgctggtcaacgacgtgcgcgaccgcgaccgggatcggctcgccgcggtggcgggcgatgccggctgccactcctgccacagccacatgagctgcaccgagcactgcccgaagggcctgagcccgaccttctcgatcgccggcctcaagcgcgagaccggcaaggcggcgctgcgccggttctggaggcgcggatga

SEQ ID NO: 5659 - DNA, 330 bp, Methylobacterium sp.
atgagcgcgctcctgtacctcgcccagcgcggcaccgcggcgatcctcgcggtcacggtcgcggtccatctcggcacgatcctctacgcggtgcgcggcgggctcacggccggcgagatcctgggccgaacacagggcaacgtggcgttcctgctgttctacgcggtcttcgttctggcggccgcgatccacgccccgatcggcctgcgcagcgtcctgcgcgagtggaccggctggcgcggccgctccctcgacgtcgccatgatcgctctctcggccctgctcgccgggctgggcctgcgggcggcactcgcggtgtacgcggcatga

SEQ ID NO: 5660 - DNA, 378 bp, Methylobacterium sp.
atgaggaccgccacgagcacggccgggcgggccggcatcacccgcgcgtccctgcgccggcccggcttcgccgccgcgctgatccaccggctctcggggatcgccctggcgctgttcctgccgatgcacttcatcgcgctcggcaccgcgctccagggtgccgaccggctggagagcttcctcggcctcacccataacggctttgtccgcacggccgaatggggcctcgtctgcgcgctcgccgtccacatggcgctggggctgcgggtgctcgccatcgagtggctgcgcttccgcgagcgcaatgcccgcgtcgtggcaggctgtctcgcggccgccttcgcggtcggcctgctgttcctcctgagcggggcctga

SEQ ID NO: 5661 - DNA, 612 bp, Methylobacterium sp.
gtggcccaccacgtcctcgacatgccggccactgaggccgagatccgggcgctccggatcggcgacaccgtcaccctgcggcgctggctgttcggcatccgcgacgcgaccctgatccacatgttcgaccgggaccgccgcacccggctcgacctcgacggccacgcggtgatccacaccgcgccgaacgtccaccgcgtcccggtctccaacgaggcgccggtcggcttcgcgccgttctgcatcggcaccaccacgtcgatgcgcatggagcgcttcaccgacgcgctgatggagcgcgagggcgtgcgcctcatcgtcggcaagggcggcatggggccggcgaccctcgacgccttcgcgcggcgcggcggcgcctacctggcgatcgtcggcggcgcggcggcgctggagaccacctggatcgagaccatcgtggacgtcgacctcgacgatctccatcccgagagcctgtggcagttcgcgatccgcgatttcgggccgctgctggtcggcatggattcgcacggcggctcgctctttgccgacgtgcagcgcgacgtggccgcccggcgcgacgccgtcatcgcctccctcgaggacgcccgatga

SEQ ID NO: 5662 - DNA, 1725 bp, Methylobacterium sp.
atgagccccgaacaggtcgagaccgacatcctgatcctcggctccggcggggccgggctgttcgcggcgctccacgccaagaaggtcgcgccggacctcgacgtcaccgtcgcggtgaagggtctgctggggaaatgcggctgcacccgcatggtccagggcggctacaacgtggcgctggcgccgggcgactcggtcgagcggcacttcatggacacgatcgagggcggcaagtggctgaacgatcaggcgctcgcctggacgctcgtcaccgaggcgcagatgcggatccgcgagctggagaccgagctcggctgcttcttcgaccgcaacccggacggcagcgtccaccagaaggccttcgccggccagaccttcgaccggacggtgcacaagggcgacctcaccggcatcgagatcatcaaccgcctgtccgagcaggtctggcgccgggacgtgcgccgcctggaggaccaccgcgccctggaactgatcccggcccgggacggatcggggctggcgggcgtgctgatgctcgacatgcgcaccggcgagccgaagctggtgcgggcgaaggccgtgctgctcgccaccggcggcgggccgaccatgtacaagtaccacacgccgtcgggcgacaagtcctgcgacggtctcgccatggctttgcgcgccgggctgccgttgcgcgacatggagatggtgcagtttcacccgaccgggctgctcgccggcgccggcacccgcatgaccgggacggtgctggaggagggcctgcgcggggccggcggctggctcctcgattccaccggccagcgcttcatggaggcctacgacccgcgggccgagcgggcgacccgggacgtggtcagccgctcgatcatgcggcggttgcgcgacggcttcgccacgccgagcgggggcgtccacatccagatgagccatctcggccccgaggacgtgcgccgccggttcaagggcatggtcgagcgctgcgccgattgcggcttcgacctcgcgggcgggctcgtcgaggtcatccccaccgcccactacatgatgggcggcctccagttcgcggtcgactgcaccaccgcgctgccgcgcctttacgctgccggcgaggataccggcggcgtccacggggcgaaccgtctgggtggcaacggcgtcgcgaactccacggtgttcggggggctggccggccagtccatggcgcgggccgtgacgcgcgaggggcgcctcgccgagcccgatccggccgccatcgaggcgggcctcgcccgcgcctacgggccgctcggccggccggcggagtcgctgccggagatccgcgaggcgctctacgagacgatgtgggccgatgtcggcatcctgcgggacgcggccgggctgacccgggcgctcgccaccctcgacgggctctccgacgcggtcgcccgggccggcgcgccggacggcgaccgccgctacgcgctcacctggatggaccggctgaacctcgagaacctcgtgctggtctcccaggcggtcgcccgggcggcgctcgcccgcaccgacagccgcggcgcccatttccgcgaggatttcccggaggcctcggatctcgcgacctcgcacttcaccgtggtccgccagcgcggcggggcgctcgacctcgcgatggagccggtgcacttcacgcatgtgcggcccggcggctcgctcctcgacgccgccgcctga

SEQ ID NO: 5663 - DNA, 300 bp, Methylobacterium sp.
atggcctacttcctgctccgcctggaaccgccccgcccgagcttcccgttcgacgcgacggaggccgagaaggcgctgttctcggcgcattccggctactggatggagcaggcggccgccggcaccgccatcgcggtcggacccgtcttcgagtccggcggcacctggggcctggccctggtcgaggccgacgacgcggcccgggccgaggcgctcggcgaagcagatcccgtcctgatggcgcaggcaggcttccgatacaccgtctcgcccgttccatccctgatcctgcggcgctga

SEQ ID NO: 5664 - DNA, 633 bp, Methylobacterium sp.
atgagcagacgcgccgattcccgtccgttccgtcgcctcgcggccggcctcgtgctcggggcctgctggctcccggccggtcccgccgccgcccaggcgctgttctggccgtccatcggcttcgcgccgctgccctccttcgcgtggccgcagatgcccgaggacgcgtacggccgctggaccggctcctacgcccgcctgtcgaccggctacgcggtcagcacgtcccggcatctcggcagctattcgggaccgacgatcgggttcgagggcggccggatgtggcaggagggcccgatcctctacggcatcagcggcgggttcgactatctggccggcctcggcggcaacctcacgccgggctacgggcggctcgcctattccaacgacttcgccggatccctggaggtgaaggtcggcaccctcgtcgcgccggacgtgctggtctacgccaagaccggcgccctggccctgcatcagacgctgcgcgtcgggccgaccccgggatcgctgccgttcgcgcgccaggacatcgcggtccggccggtggccggcgtgggcgtcgagtgggcggtcacggaccgcctgtcgctcgcggtcgaggcgggcgtggtcggcggcgggatccgctga

SEQ ID NO: 5665 - DNA, 552 bp, Methylobacterium sp.
tacttcctggagcacgcgatcgcgagcgccaacgcccaggagctcgaccggccggcgacgatccacttcttcgtcgggatcgaccccgggatcgagatcccggcgcagctcgccgcgcacccgcaggtcaccttcgcgcgcggcccgcagaggggccagatccccgcgctgaacgccgccatcggtgccgtcgacgacagctgggacctcgtcggcttcctcgaggacgacgatcactggctgccgccctatctgggcttcgcgctgagggccctcgagagcttcgatttcgtctcctcgacgcagctcgagaccgacgaggccggcgaggtggtgcggatcaacgacttcgcgacgccgtcgggctggctgatgcggcggacgaccttcgcgcaggtcggcgcgatcagcccggcctccaagtggcactacgacaacgagtggctcggccgcctcgccgagaccggcctgcgccgcgcccacctcgtcgaggcgacggcgcccgtcacgctgcaggacgcgatccaggtccgcccgtggctcgccaacgtc

SEQ ID NO: 5666 - DNA, 1875 bp, Methylobacterium sp.
atgcttgatctgacgggctatcgcctgacttacgacgacgagttcaacgcgcgcagcatctcgcagaacggcgtcgggactacctaccgcgatattcgcgccgagtggcggtacgacgccaactccgacatcggcttcggccggtcctcattcctcgattccgggtccggttacgatcccttcagcgtccagaacggtgtcctgacgatcacggcggcgccgcccgggacgagcgcatccggctatccggggagctggcagtccggcctcatcagcacgcagggcaacttctcgcagacttacggctacttcgagatccgcgcggatttctccaacaatcccgatgcctgggacgccttctggctgttgccgaatcagcagagcccgcagtcgagcagcgccaacgggcaccaggagctcgacgtcgtcgagcattacggcaacaacgaccgcggcgtctacagcacgatccacacgaccgatccgcagccggccggaacgacctggcagcagacccgccaagtctacagcgagatgcccaatccgaacgggtatcacacctacggcatgaactggcaggccgatcgcatcagcttctacgtggacggtcagctcgtcggttcgcaggcgacgccgtccgacctgcacagccccatgtatctgctggccaatctcgccgtgcagagcacggcgacgacgggcacccgcttcagctcgagcatcgactatatccgcgtctactcgaacaaccccaacgccgtcgcggtgccgcaggaccgcgtgtcgtcgccggatggccgggacccgggcctgtacggggcgacggccggtctccggtcgggcgccggcgcggccggagcgcagccgggcgcgaccgggtcgaaccccggtgcgacggcgcctgcatcaggcgccaacgggtcgaatggatcttctcaaccgtcctcggggacggctcaagggaccgcggcgccgggaaacgccccgtgctactgcaccggcacgtccatcaggaccgaccgcggcgacgtcgctgtcgagcggctcgcggtgggcgacagggtcgtcacggccgcgggcctgcatcggccgatccggtggatcggtcgccggacctatcccggatcgtcggccccgccgaccgagcggcctgtgcgcatccgggccggcgcgctcgacgacggcgtccccgcccgcgacctgctcgtctcgccggaccacgccgtgtggctggacgggctgttcgtcgccgccggccacctcgtcaacggaaccagcatcacccgcggtgagcgcgtggtcgatctcacctactggcatgtcgagctcgacagccacgacctcttgctggcggagggcacgccggccgagagcttcctgcccgctcccggcctccggcggctcttcgacggccgcgatccggacgacagcgcgatcggtccgcaggcctacgcgccgcgcaccgcgctcggtccccagctcgccgccctgcgcaggcggctgatccgtcgcgccggcgcgacgtcgcggccgggcgccgtgcgggcgtggctggatcgctgcgcgctgcgcgcggacggcgcgctgcgcgtggccggctgggcccacgacgccgcgcagcccgacgcccccgtatgcctggacatcgtggtcgacgggacgatcgtggcggtgacggtggcggcggagtatcgcgccgacatcgctgcggcgggcgtgggcgacggccggcacggattcgacctcggtgtcgaggcgcccctcgctcccggtgtgccgcacgtggtcgaggtgcgccgctcgatcgacgaggcggtcatctgcgccatggccgccgacgcggcgggcgtgtggcggcccctgctggccgcctga

SEQ ID NO: 5667 - DNA, 666 bp, Methylobacterium sp.
atggcaccgagccctctcgccctcatcgcctccgccgccctcgtcgccgtgatcgccactggcaccggggcgatcgtcctccagcagggctcggggttcagccattcccggaaggtcggcggtccgttcacgatggcggatctcgatggccgcccggtgacccaggccgatctccgcggcaagccgtccgtcctgttcttcggcttcacccactgcccggacgtttgcccgaccacgctcgcgaccctggcgtcggccctcggccggatgggccgcgacgcggaccgcctcaacgtcgtcttcgtcaccctcgacccggagcgcgacacgcccgacaccctgcgggcgtacctggcctcgttcgatccgcggatccgcggcttcgtcggcacgccgcagcaggtcgcccgcatggccgacgcctaccacgtcgcctacaagcgcgtcccgaccaaggacggcggctacacgatggagcattccgcgaccgtggcgctgttcgacaagaccggccgcatggtcggcgagatcggctacggcgaggacgaggccaacaccttcgcgaagctgatcaccttggcgctgccggggcagtgcccgccggggggcggcgccaacctctggacgaccgacggcagcaccggcagctgcggtccgcggagctga

SEQ ID NO: 5668 - DNA, 1488 bp, Methylobacterium sp.
atgttgcgttacgccgcctgtctcctcgccgggctcgccctcaccgggcccgccgccgcgcagaccctgcgctacggcatgatggaggatccggacgccctcgacccgacgctcgcccggaccttcgcgagccggatggtgttcgccgcgctctgcgacaagctcgtggatatcggcccggacctgaagccggtgccgcagctcgccacctcctgggagctgtcgcccgacgagaaggcgctgaccatgcacctgcgcccgggcgtgctgttccacgacggcgagaagctcgacgccgccgccgccaagttctcgatcgagcggcacatgaagatgccgggctcgcagcgccgctcggagatcgcgccgatcgactccgtcgacgtggtcgacgacctgaccttccgcatcaacctgaagcagccgttcgcgccgctgctggcgcagttcaccgaccgggccggcatgatggtctcgcccaaggccgccgagcggctcggcgacaagttcgcctccgcgccggtctgcgccggtccgtacaagttcgtggagcgggtgccgcaggaccggatcgtggtcgagcgcttccccgactactggaacaaggacgcgatccacatccagcggatcgagttccggccgatccccgacgccaccgtgcggctcaccaacctccgcgcgggtcagctcgacctcttggagcgcctcgcccccaccgacgtggcgcaggtgaagcgcgacgccaagctgaagctggactccacctacgagctcggcttccaggagatcctgttcaacccccacaaggccggctcgccggtctccgacccgaaggtgcgcgccgctttcgaggcggccatcgaccgcaacgccatcaatcaggtggtctacaacggcgagttcctggccgggaaccagtgggtcaacccgaagaacccgaactacgtcgccgagtacccgatccccaagcgggacgtcgccaaggccaaggcgctgctggccgaggccggcaagccgaacccgcagatcacgctgaccgtctacgccaacagcgagtcgccgcaggtcggccaggtgatccaggcgatgaccaaggaggccggcttcgacgtgaagatccaggccgtggacttcaccacggcgctcgatgccgccgacaagggcaattacgaggcgcagctctattcctggagcggccgctcggacccggacggcaacacgttcagcttcctggcctgcaaggcggcgctgaactatccgaaatactgcagcccggaagccgacgcggcgctccaggccgagcggggcactgtcgacccggccaagcgcaaggccgcctggaaggccctggccgatcaggtgcttaaggatcgcccgggcatctacatcctgcaccgcaagctgctctgggcctacagccagaagatcacgggtttcgtgccctacccagacgggctcgtgcgcttcaccgggctgaagctgaactga

SEQ ID NO: 5669 - DNA, 930 bp, Methylobacterium sp.
atgagcaccggcagcgagatcgcccgcgccgaggcggtcggcctggaggccgccccgtccggcgcccccgcccacgccatcctccgagagcccggcaccctcgcggccttctggcgacgcctgcgcgcgcgcaggagcgcggtcgtgggcctcgtcatcgtcggcctgctggtgctgatggcggtgttcgcgccctggatcgctccctacgacccgacagccaccgactggggcaacgtccgcgggcccccgagcctcgcgcacccgttcggcggcgacgaggtcgggcgcgacgtgctctcgcggatcatcttcggcacccgggcctcactcggcgccggcctcgtctcggtcgcgttggcggtgtccctcggcctgcccctgggattgctcgccggctacgcgggcggctggatcgacggcgcgatctcccggctcaccgacgcgctgctggcgatcccattcctgatcctggcgatcgcgctcgccgccttcctaggcccgagcctcgtcaacgcgatgatcgcgatcggcctctcggcgacctcgaccttcatccggctgacccgcgcgcaggtgcgcgccgtggcggcggaggagttcgtcgaggcggcccgcgccatgggcaacccgccctggcggatcgcccgggtccacatcctgcccaacatcgtcccggcgatcctcgtgcaggcgacgctcaccatcgcggccgcgatcatcgcggaggcgagcctgtcgttcctcggcctcggccagcagccgcccgacccgtcctggggggcgatgctcaacaccgccaagaacttcatggacgaggcgccctggatggcgatctggcccggcctgtcgatcttcctggcggtgctcgccttcaacctgttcggcgacggcctacgggatgccctcgatccgaggcagcggacatga

SEQ ID NO: 5670 - DNA, 1017 bp, Methylobacterium sp.
atgatcaagcctctcctcgacgtccgcgacctcgcggtcgccttcgacacggacggcggcgcggtccacgcggtcaacggcgtgtcctacaccctgcacgagggcgagacgctggggatcgtcggcgagtccggctccggcaagagcgtgcacgtgctggccatgctgggcctgatcccgcgcccgcccggccgcatcaccggcgggcaggtgctgttcgaggggcgcgacctcctcgccctgaaggagcaggacctgcgcgagatccgcggcggcgcgatcggcttcgtgttccaggacccgatgagctcgctcaaccccggcatgaccgtggcggcgcagatcgtcgagccgctgcgcatccatctcggcctcgacgcccgcgcggcccgcgcccgggcccgggagctgctcgacctcgtgcgcatcccgaacgcggccgcgcgcctcgaccagtacccgcacgagttctccggcggccagcgccagcgcgtgatgatcgcgatcggcctgagctgccggccgaagcttctgatcgccgacgaggcgaccacggcgctcgacgtcaccgtccaggccgagatcgtcgccctggtgcaggagctgaagcgtgagctcggcatggcgatcatctggatcacccacgatctcggtgtggtggcgggcatcagcgacaccgtgcaggtgatgtatgccggccggatcctggagcgcggcccggtcgacgacatcttcgccgatccccgcaacgcctacacgctcggcctgctgcggtccctgccggatctctccggcggccgcgccgggcggcggcgcctccaccagatcgagggcgcgccgccggacatgcgccatctcccgccgggcgacccgttcgcgccgcgcaacgcctacgcgacgccgcgctgccgagccgagatgccgcccctggcgcaggcgcccggcgccgctccgggccacctcgtcgccgcctggtacgacctgccgaagctcctggatgaggaggccgcgcgatga

SEQ ID NO: 5671 - DNA, 924 bp, Methylobacterium sp.
atgaacgcgtcgcagcagccggttgtctcggtgcgcgacctgtccaagcactatcccctccgctcctggtggggcggcaagggcgcggtgttccgcgccgtcgagggcgtgagcttcgacatccgccccggcgagaccctggggctcgtgggcgaatccggttccggcaagtcgaccatcggccgggccgtgaccatgctgaacccgccgacctcgggcaccattgcgttcgagggcaccgacctagccaagctctcggcgggcgcgatgcgcaggatgcgggcccggatccagaccgtgttccaagatccctacgcggccctcaacccgcggatgagcgcgggcgagtacgtcgcggaggcgttcaagctgcaccggcgcgacatgcgcggcccggagcggcgggaggcggtggcggccctgttccagcgggtcgggctcgatccgcgcttcatggggcgctacccgcaccagttctcgggcggccagcggcagcgcatctgcatcgcccgggcgatcgccctgaagcccagcttcatcgtcgccgacgagccgatcgcggcgcttgacgtctcgatccaggcgcaggtggtgaacctgctgcaggacctgcaggacgagatgggcctgtcctacctgttcatctcgcacgacctgcggatggtgcgctacctctgccaccgggtcgcggtgctctggcgcgggcggatcgtcgagctggccgaggccgacgccctctacgacgacccgcgccatccctacacgcgccgcctgctggcggcggtgccggtgccgcacccggccgaggagcgcgcccgcctcgcagcgcgcgacctcgccggtcacgaccagccgcccgacgggccgctcaccgaggtggcgccggggcactgggtggcgctgccgagagggcagcaggcgtga

SEQ ID NO: 5672 - DNA, 396 bp, Methylobacterium sp.
ttgcaccaggcggccgagatcgaggccctggtcaacagggcggccgacatgctggaggccgagggcgcgcgggcgttcgacgcgttccggcgcaaggggagcacctggcgatacggagacgtctacctgttcgtcgtcgacctgcgggggatcgtcctcttcaacgccgcccatccgaaccgcgaggggcacgacctgctccacgagcgcgacgccgacgggaagcagttccaccacgatttcatcgacgccgtcacgcggttcgggtccggctgggtcgactacatgttcccgaagcccggccagtcggcgccgagcgtgaaatggagctacgtctgcgcgacgcgcgtggccggcgtggaggcgctggtcggcgccggcgtctacgtggagtag

SEQ ID NO: 5673 - DNA, 933 bp, Methylobacterium sp.
atgcgcatcgccttcatcggtcaacaggatttcggaaaagcggtcctggaggcgttcctcaaacgaggcgatgaggttgcggcggtgttctgcgcgcccgagaagcccggcgccaagccggatgtcctcaagacggcggccgtcgagaaggggctgacggtcttccagttccccagcctgaagagcccggaggccgaggacgcgatgcgcggcctgaacgccgatatcggcatcatggcctacgtgctccagttcgcgccgcagagcttcgtcaatatcccgaagcacggcaccatccagtatcatccgagcctgctgccgcgttaccggggcccgtcctcgatcaactggccgatcgctcggggcgaatcgcagaccggcctgacgatcttccggcccaccgacggcctcgacgaggggccggtgatcctgcagaaatcctgcccgatcggcgccgacgcgaccctgggcgacgtctacttcgacaacctgttcccgatgggcgtcgaggccatgctcgaggcggccgacctcgtcgtggccggccagcatgtcgagatcgatcaggacgaggacgccgcgagctacgagggctggttccgagccgccgaggcggagatccactggtcggcccacgccgagcagatctacaacctgatccgcgcggcgaacccggcacccggtgcctggacgacgcacgacggcaagaagctccagatcttcgactgcgccctgcatcggatccgcaagctcgccgacgtcgtcggcaagcccggcgaggtgatcgccgtcgacgacgagggcttcagcgtctgcgcgcagggcggccggctcgatatccgcaaggtcaaggcggagggcggcaagaaggtcgcggccgccgaatacgcccgggaggccgggctggccgtcggtcagtttctcggacgctag

SEQ ID NO: 5674 - DNA, 561 bp, Methylobacterium sp.
atgctgatcacccgctaccggcatcgtctgccggccgactacgacatggaccggatccgcgcgcgcgtcgccgcccgcgcgccggtctgggacgcggtgcccggcctcgtcttcaaggccttcacggtcgaggaccgggctcgcggggccgccgccaacgcctacagctccctctatctctggcaggatgccggcgccgccgccgagttcctggccggggccgggttcggcgccgtgatcgcgagcttcggccggccgcgcatcgagacgtggctggcggtcgccgccgcgttcgggccgggggacgcggcgggcgccgtctcggaggagacgcgtctcgtcgggcccgcggaggatctcgctgccctgcgcgacgacgagcggggacgcgggcgcgacatcgcggccgggcgcgacgtcctcgccaccgtggccgggctcgatcccgacggatggcgcctcacccgcttcaccctccgcgccgaggcggccgccggactgtccggaaccgcgatcgcccatctcgccgcgccaggcctcgccgcggcgcgcggccgctga

SEQ ID NO: 5675 - DNA, 255 bp, Methylobacterium sp.
atgggcgacgccatgatccgaccggcggagttctgggacacggtcggcggcctcgtgaccgccaaggtcgagccggtgatcggccgcgccgacaggcaccgcggcccggtgatcgactacctgcgcgacctggaggccctggcgcggcgccagtgctccagccgcgagacggtccagatcatcgcctcgggccggcggctcctcggggaccgcagcgagatcgggccgtcggacggaccgttcactcgcgcctga

SEQ ID NO: 5676 - DNA, 621 bp, Methylobacterium sp.
gtggttgaccgccccctcggcctcgaacccgcgctcgatccgagcgcccgggtcgtcgacagccgcctcggccgctacaccgaggtcggcgcccgcacccgcctcaccgagacgaccctcgacgactattcctacatcggtgaggacggcgaggtgatctacaccgcgatcggcaagttctgctcgatcgccgccagcgtgcggatcaatcccggcaaccacccgatggagcgggcgtcgcaggcgcacttcacctaccgggcgcgcgcctactggccggaggaatcggacgagcccgccttcttcgaccggcgccgggcgagcccggtggcgatcggccacgatgtctggatcggtcacggcgcggtcgtcctgcccaggcgcacgatcggcaccggcgcggtggtgggggcgggcgccatcgtcacccgcgacgtcgagcccttcacgatcgtcgtcggcaatcccgcccggccggtccggcgccgcttccccgaggtggtcgcggaccgtctgacccgcttggcgtggtgggactgggaccacgagcgcctgcgccgggcgctgccggatttccgcgggctgcccatcgaagcattcctggagcgccacgaagattaa

SEQ ID NO: 5677 - DNA, 780 bp, Methylobacterium sp.
gtgatcagcttcgggacgaccttccggaccagcagggcgcggcgcgccgtcgccgggtcggcgctcactctcggttttggcctctcgggcccggccgctgcgatcgacggcggctcggccgccggccgggatgccctggctcaggccaccgtggcgatcggcacgatcacccagcccgaggaggcgctgaagctgacccgctgcaccggcgtgctcatcgcgccggatgtcgtgctcaccgcggcccattgcgtgaacggcgatccgctcggtgcgctcgtggtgttcttccggggcagcgagccggcgcggccggtctacggggcgcgggtcgccgcccgctacagtcccgatccgggggagatgctgccgaacgaggcgtcgggcgtcagcctctccgatctctccctcgacctggcggtcctgcgcctgaccgagccggtgcgcgatcggcggcccgtgccgctggcggcggatcccggccgcgtcccgaagagcctgcgcatcgccggcgcgggactttccggccggacggtcgggcgcctgcgcactgccacgctgacgccgatcgcggcgagcagcactgggctgaccatcgcccgggccaacggcgcccgggtctgcttcggcgattccggcggcccggtcgtcgcgcaggatcgccgcggcacctacatctggggcgtggcaagtgcggtgatcagccgggccgcgccctgcggcggctacgtggtgatcgcgccggccgcgcaagtcttctccgccaccgggacgcggtga

SEQ ID NO: 5678 - DNA, 1749 bp, Methylobacterium sp.
gtgaccgccgccgccatgcccgagaccctcgacatccgcgtccccgatctgggggactacgccgacgtgcccgtcatcgagatcccggtgtcgcccggccagccggtcgccaaggaccagaccctgctggtggtcgaatccgataaggcgacgctggacataccctcccccgcggcgggtcgcctcgtggagatgctggtcggcctcggcgacacagtctcggccggcacccttgtcgcccgcctcgcggtcgaagcgaccgacgcgcgcggcgaaccggcccctgcgcccgcctctgccccggcccccgagtcgacgcccgccgcgccgccgccgaagccgccggccggcgcgggctgcgatctcctggtgatcggcggcggaccgggcggttactcggccgccttccgggccgccgatctcgggcagcgggtcatcctggtcgagcgccacgcaaccctcggcggcgtctgcctcaacgtgggctgcatcccctcgaaggcgctgctccacgtggccgcggtcaccgaggaggccctccggctggccgcgcacgggatcagcttcggcgcaccgacggtcgatctggagaagctgcggaccttcaaggccggcaccgtccgccgcctcaccgacgggctcgcccagatggcgcgccagcgcaaggtcgaggtggtccgcgggaccgcccgcttcaccgggcccaagacggtctccgtgacgctgcacgacggcggcacgcgcgacgtcaccttcacgggcgccgtcgtggcggcgggctcggcgccggtggccctgccgatgctcccggacgatccgcggatcgtgaattccaccggggcactggaactgcccgccgtgccgcgccggctcctggtgatcggtggcggcatcatcggcctggagatggcaaccgtctacagcgccctcggcgcgcgggtcgacgtggtcgagcgcctgccgaacctgctcgagggcgtcgaccgggatctcgtcagcgtctggacgaagcgcaacgcccaccgtttcgaccgcgtcctgacgggggtcgaagtcgtctccgccgaggcgaaaccggacgggatcgccgtgaccttctcgggcgaggccgagcccggaacctatgacctcgtgctccaggccgccggccgccggcccaacggggcgacgctcggtctcgacgcggccggcgtggcgctggacggcggcttcgttccggtggacgcccagatgcgcacgaacgtgccgcacatcttcgccataggcgattgcgtcggccagccgatgctcgcccacaaggcggtgcatcagggccacgtcgccgccgaggcggccgccggccacaagaccggcttcgacgccgccgtgatcccctcggtcgcctacaccgacccggagatcgcctgggccggcctcaccgagacggccgcgaaggcggccgggcgggccgtcgaggtggcgcgcttcccctgggccgcctcgggccgtgccatcgccaacggcgccgattacggtctgaccaagctgctcttcgacgcgcagacccggcgcgtcgtcggcggcgccatcgtcggcccgagcgccggcgacatgatcggcgaggtcgcgctggcgatcgagatgggcgccgacgccaccgatatcggccggacgatccacccccacccgaccctcggcgagacgatcggtctggcggcggaggccgggctcggcctctgcaccgacctgccgccggtcgcccgtcggtag

SEQ ID NO: 5679 - DNA, 1131 bp, Methylobacterium sp.
atgcgagacttcaccgtcgcctgggacacgaaccggctggaatgggtgcgggagcgcgtgcgggcctaccgcatgccgcgcctgccgacgggggccggctggcgctacggctgcgatccggacgtcctggccgccctgtgcgcccactggctcgacggcttcgacgaggccgccgccgcggccgagctcaaccgcttcccgcagatcctggcccgcgtcgaggatctcgacctgcacgccgtccacgtcgtcggcgaggcggaaggccggcgcccgctgctgctgatccacggctggccgggttcgatctacgagttctggtcggtgatcgagcccctggccttcccgtcgcgccacggcggacggccggaggacgcgtttgacctcgtgatcccggcgccgcccggcttcggcttctcgggcaaacccgccgcgccgatcggcgcgcgcagcacggcgcggctgttcgaccgcctgatgcgcgagaccctgggctacccgcgctaccgggtgcagggcggcgactggggcgccggggtcgcggcctggctcggcctggaccacgccgcgtcgctggaggcgatccacctgaactacctgctggtgcagcccgatgccgagccggagagcgcggcggagcgggcttggcagaagcaggccggagccacccagcaggcgctcggggcctacgcgcagctgcagggcaccaagccgctctcgctgggctacgccatggcggacgaaccggtggcgcagctggcgtggctggtcgagcgcttccacgactgggccgacctccgggagcggcccttcgcgcaggtcttcacgaacgatcagctcctgaccaacgccctgctctacatcctgaccgattccttcgcgacggcgacgtggttctacgccggcgcgcagcaggaaggtgtgcgccggatgccgccggggcggcgcgtcacggtgccgacggccttcgcggcctacccggatccgcgcacgcccgcgccgccgcgagagtggctggagcgcggctacgcggtctcgcgctggcagacgatgccccgcggcgggcacttcgccgccatggaggccccggacctgttcgtccgggacctgcgggactggggccgcggctga

SEQ ID NO: 5680 - DNA, 405 bp, Methylobacterium sp.
atgctgcgcaacgcctttctcgctgccgtgatcctcgtcccgaccgccggatacgcggcggaggtcgattgcggcgcgtccgcgaaccagatggatgccaacatctgcacggcccaggaattcgaccgggccgatgcggagctgaaccgccgctacgcgaccctgcgcagcaagctcgacgagaacggccgacgcaatctggtcgccgccgagcgcgcctggatcgccttccgcgattccgagtgcaacctgcggaccggattcaacacgctgacgcccgacgacaacggaagcatcgccccgatgctcctgggcgcgtgcaagatcacgctgacgcgccagcggatccaggacctggccgcccagatcaagtgcccgggcggcgacctgtcctgctcgccctga

SEQ ID NO: 5681 - DNA, 312 bp, Methylobacterium sp.
gtgtcgctcaggaacggtcttgccgccctcgcgctggcggtggcgggcgccgcgccggtccccgcctgggcgtggggcgtcccgggatgcatcaaccttcccgagtacaaccgcgccctgggcgccctgcagggcatgacgagcgcctgcgacatgagcgtcgaggaagcccgccggatcgtcgccgcccgtgacggcgtcgcgcccgggcccccggtcgccgccgcggagccgccggcgccgccgcgggtcgcgccgcggcaccgcagggcgcggacgcaccggagcgcgcggccgcggcatcaccgctga

SEQ ID NO: 5682 - DNA, 1530 bp, Methylobacterium sp.
ttgaagaagaagccggtcccggccccgtcggcctcgtggggcacactcccgtggccggacgcgatcctgccgctgcccctcgacgggcagctccgccccctcgacgagcgccggctcggccaggtcgcggccggccagtttcccggctgccgggcgatcttcgtcgcgcccgcggcctccgagctgcgacccgacctcgcggggcacctgacgcgcgcgctggcggagcggcccgatatcggcatcttctacggcgacgacgccgtggtggacggcgccggccaggtccgcagcgtccactgcaagccggccttcaacccggccctcctcatggccgacgactatatcggcttcccgctgctgatccgcgtctcggccctggccggcctgagccccgatttcggcctgcgccacggcagcgccgcttggttccgcttcctgctcggcgcgatctccgcggggatcggcatcgaccggatcccccagaccctgatcgcctcgccgctggagcgcccgaaggcgacgcgcacggcccgcgcccacgccctcgaccgctggttcgagacctccggcatgccgctgcgcaccgccccggggctgaccccggacacgctggagatccgccggagcttcgacgcgcggccggccgtgaccctggtcgtgccgaccaaccagagcggcccgaaggacgatcagggccgcgccgtcgagggcgccaagccccacgtgatcaacctgctcgacagtctcggccgcagcacctacccggccgaccggatccgcgtgctgatcggcgacgacgtggccgacgacgcgatctatcgcggccgctccgaccgcttcaccgtgacccgcctgctgacgacccgggctccgggcgagcggttcaactacgcggccaagatgaacacgctctggcgcgcggccgagaccgacctcgtcatcctgatgaacgacgacctcgtcgtgcgccggcccggctggatcgaggcgctcctgaccttcgcgctggaccgcggcgtcggcggcgccggcggccggctgctgttccccacgggcaagatccagcatgccggcatgaccggcggcatcttcgacgtgttcgcccacccctggtacaaccgggacgcggccgagccgacctacggcgactgggcgctgacgcagcgcgactgctcggcggtgacgggggcgctcttcgccacccgcaaggcggtgctcgaggcggtcaacggcttcgacgagggcttcgccctcgacttcaacgacgtcgacctgtgcctgaaaatgcggcagctcggctaccgcatcgtctacacgcccttttccgagttggcgcaccacgagagcgcctcacggcagaccagcttcgccccgggctcgcagatcgcgcgcttcctgcgccgctggggcgacgtcgtcgcggaggatccggcctacagcccgcagctgcgcatcgataccgacgtggtcgccccgcgggccgacgcgacgcgctggatcgcggagcgccgggcggacgcggcctga

SEQ ID NO: 5683 - DNA, 573 bp, Methylobacterium sp.
atgaacgcgcgtcacctctgcctgctggcggctctccaggccgtcgccctgccggccgccgccgccgagtgggcggtggatccggccaggagcgcgatccggttctccggcgtgcaggtcggcgtcccgttcaccgggcggttcgagcggttcaaggccgacatcgatttcgaccccgccaagcccgaggcagggcacgcgctcgtgctggtcgacctcgccagcgcgcggaccggggacatccagcgcgacgaggcccttccgcagaaggactggttcgacgtcaaggcggggagcgaggcgcgcttcgaggcgacccgcttcgtcgacaaggggcagggcgactacgcggcaatcggcacgctgacgatccgcggcacgagccggccggtgacgctgccgttccacctgaccctcgagggcggcgcggcgcacgccgcggggcgcgtcgccctggtccgcaccgagttcggcgtcgggcagggggcctgggcctcgggccagtgggtggcgctcgaggtcggcgtcgaggtcgacctcgtcgcggcggcgcggccggcctccggccactga

SEQ ID NO: 5684 - DNA, 231 bp, Methylobacterium sp.
atgaccgttcgcatgctcgccgccgccgccctggtcgccgcggtcgccacgcccgccctcgcgcagggcctggactcgaagcactcgccctacccggcctcggcctattcgggctgggtcggcaacgcccccgtcctgtaccgggacgccgccggcccggcccggccggccgcctaccgctacagcggcccgcatgccggcggcccggccaacgccctgccgcggttctga

SEQ ID NO: 5685 - DNA, 1182 bp, Methylobacterium sp.
atgatcgcggcggccgatccggccacgccggtcgccggcgcgggctgcgcgtgctgcctgccccggcgcggcttcctgggccgcctcgcggggctgggggcggcggcgctgacggccggcgccgcgcgggccgagccgtcgcgctacacgggtctggtgatcgactgccacgggcactacaccaccgagccggccgccatgctggactggcgcaagcgccagatcggcgcgctcaacgacccgggccagtcccccaagccgtcggacctgcaagtcagcgacgacgcggtgcgcgccagcgtgagcgggcggcagctcaagctccagtccgagcgcggcatctccctggcgctgttctcgccgcgggccggcgggatgggccaccatatcggcacggcccgcaccagcctcgactggtcgatcgtgtcgaacgacatgatccaccgggtgacgagcctgatgccgcagaacttcgtcggcgtctgccagctgccgcaatcgccgggtgtctcgcccaagaactgcacggccgagctcgagcgctgcgtcaaggagctccgcttcgtcggctgcaacgtcaacccggacccgtccgggggctactggaccgatccgccgctctccgaccggttctggtacccgctctgggagaagatggtcgagctcgacgtgcccggcatggtgcatgtcagcgcctcggccaatcccaacttccacgcgaccggggcgcactacatcaacggcgacaccaccgccttcatgcagttcgtgacctcggacctgttcaaggacttcccgacgctgcgcctgatcatcccgcacggcggcggtgccgtgccctatcactgggggcgctaccggggactggcccaggacatgaagcggccgccgctgtccgagctgatgcgcaacgtcttcttcgacacctgcgtctaccatcagcccggcatcgacctgctgctcaaggtcgtcccgcgcgagaacgtgctgttcgcctcagagatggtcggcgcggtgaacggggtcgatcccgagaccggccacgcctacgacgacaccaagcgctacgtcgaggccgcggcgatcccggacgcggaccgggccaagatctacgccgggaacgcgctgcgcgtgtatccgcgcctcgcggcgcggctccggtcggtcggcgtgacgccgtag

SEQ ID NO: 5686 - DNA, 1560 bp, Methylobacterium sp.
gtggccgtgccggaggcgaaggcgagtgcccgggactggctcgccgtgttcggtgcgatcctcggcgccttcacggcgatcctcgacatccagatcaccaacgcgtcgctcgccgacatccagggggcgctcggcgcctccaccgaggaggggagctggatctccaccgcctacctgatggccgagatcatcgtgatcccgctcaccggctggctgtcctcggtgatcggcctgcgccgctacctcgcggtgaacaccatgctgttcaccgccttctcgctggcctgcgcgctgtcgacgaccttgggccagatgatcctgttccgggccggccagggcttcaccggcggcgtgctgatccccaccgccatcgtgatcgtgcgcacccggctctcgaaggcgcagcagcccatcggcatcgcgctgttcgggctgaccgcgaccttcgcgcccgccatcggcccgacggtcggcggctggctcaccgacaacctgtcgtggcactacatcttctacctgaacctgatcttcggacccgtggcggcagcgatccagctcggcgccttcgacagcgtgccggcgcgctggggcgagttgctcaagggcgactggatcggcatcggcctgatggcgaccggcctgccggccctgacctacgtgctggaggagggccagcgcaaggactggttcggctcgcaggtcatcgtgaacatgtcgctgctggcggcggccggcatcaccggcttcatcgtccgcgagctcacgaccgagcgcccgttcatcaacctgcgcgtcctggccaaccgctcggtcggcggcgcctgcgtgctgatgaccgtgctgggcgcggtctcgttcgggtcgatctacatcatcccggtctactgcgcgcagattcagggctacaacgcccagcagatcggctacgtggtgatgtggtcgggcctgccccagctcgtcctcttcccgatgatgccgctgctgatgcggaccttcgacgcccgggtgctggtggtcaccggcacgctgttcttcatcgcgagctgctggatcaacgtcggcctgacccacgatgtcggcgccgaccagctgatcctgccgcagctgatgcgggccatcggccagccgctcttcaccatcccgctgtcgcagctctccaccgtcggcctcgccccgcgcgacaccgcggacgcctccgccctgtcgaacatgatgcgcaacctcggcggctcgatcggcatcgccatgctgtcgacgatgatcgaccggcgggagcacttccacttctcgatgctggccgaggcgatcaccgtcaacgccacccgcacccaggaccggctcgcggcgctcgccgccgggatgcacgcccgcatcgccgacccgctggccgccaagggcgtcgcgctgggccagctcgccgcccaggtccgccgcgaggcctacgtgatggcctacgcggacgggttctggctggtgggcgtgagcctcgtggcgagcctcgccgtggtggcgatcctcaagaagccgcagcgcgccgctgggcccgtggaggcgcactga

SEQ ID NO: 5687 - DNA, 885 bp, Methylobacterium sp.
atgatcatcgcaacggtaggggtcgtcgggctcggcaacatgggtctgggcatggccgcgaccctggcccgcaagggcttcgcggtcctgggctacgatctcagtccggcccggcgccccgccgccgaggcggccggcgtcaccgtcctcgacgccctcaacgacgtgctcggccgggccgacgccctggtgttctcgctgccgctggcgcgggacgtggaggcggtggtcaccgcggagggcgggctcctgtcccggaccgaccggaaggtcgtggtgatcgacacctcgacctcggatcccggcacgacccggcgcctcgccgagcgcctcgccgcggccggtcacgcgctcctcgacgccccggtgagcggcggcccctccggcgccgccgagggcatcctgaccatgatgatcggcggggccgcggcggattacgaactggcccggccggtcctggaggccatgtcggcccgggcgccgcatgtcgggccgtcgggcgccggcaacatcgtcaagctcgtgaacaacctgctggtggcggcccatctggtgaccgccggcgaggccctgcgcctgtccgaggcggccggcctctcggccgaggaggccgtcaaggtcgtcaacaccgccaccggccgcagcgcgatcagcgaggtcatggtcccgcgctgggtccagtccggcaccttcgacagcggcttctcggccggcctgatgcgcaaggacgtgcgcctcgccctcgaactcgccgaagaatgcgggatcgacctgccgctctccgccgaggtgaagcggatctggcaggcgacgcaggccgccatccccgacacggccgacttcacccgcatggccgattaccgcgatcccaagggagcccactga

SEQ ID NO: 5688 - DNA, 741 bp, Methylobacterium sp.
atgaccgtcgtgaccgcaccgcagccagatctccgcttaccgctttaccagcgcctgcgggacgagatcgccttccagatcgcccgcaacgtctggcggtcgggcgaaccgatccccacggaggcggaactggcggcgacccaccgcgtcgccatcggcaccgtgcgcaaggcgatcgacgtcctcgtcgccgacggcctcgtcgagcggcagcagggccgcggcaccttcgttcggcggccgcgcttcgaccggtccctgttccggttcttccggcatctcggcccggacggcacccaggcggtgccggagggccggatcctgtcgcgcgaggcctgtccggcccccgcgaccgtccgcgaggccctcggcctggacgcgcgcggcgacgcgatccggctgatccggacacgccacctccagggccggccgatcctgtccgagacgatctggctgccggccgcgcggttcgcgccgatcctccaggccccgctgacggagatcggcgacctcctctaccccgcctacgagcgcctctgcggcgagatcgtcgcccgcgccgaggagaccctgaccgtcggcatcgccgacgcgacggacgcggggcgcctcgcgatcgccgacggggacccggtcgtcgtcatcgagcgcctcgccttcggcttcgatgcccgcccgatcgagtggcgggtgacgcgcggcgccgccagggacttccggtatcacgtcgacatacgctga

SEQ ID NO: 5689 - DNA, 663 bp, Methylobacterium sp.
atgccgcggggcgagggtcggcggggcgagcgcgagccggaggtcggcccgggggtcgatcccggggccgcgtctcccgacacgcgcacgcggatcctcgccgtcagcctcgcgctgttcaacgcccgcggcctcggccacgtcacgacggctgagatcgcggccgcggcggggatccgcgagggcaatctgcagtaccatttcccgcgcaagcgcggcctcgtcgaagccctgttcgcggccttcgagaccgaggccgtggcggtcgcgggccggatgcccgccgatcccacggcgcccgaggcgctgcttgcctaccagagggcgtggttcgacctgatgtggcgctaccgctgcgtctaccgcgacggcatcgccatggtggagatcgcgccggccctgcgcgcccgggtccacacgctgcgggccgagacccaggcgctggcccgcggcgtgttcgaggcggccgtgcgggcgggacggctgcgcgtttccccggacgcgctcgggcgactcatcgacaatgcctggatcgtgtcgggccactggatgagccaccgtctccagggcggcaccgacctgacggaggcggatcgggactggggcttcgcgcaggtccgcgacctcttcgcgccctacctcgcgcccgagagccctacttga

SEQ ID NO: 5690 - DNA, 1170 bp, Methylobacterium sp.
atgcccatcggcctgcaggatttcgacttcggcctgggcgagacggccgacgccctgcgcgccgaggtggagcgcttcgcgcgcgctgagatcgccccccgcgcggcggcgatcgatgccagcaacgcgtttcccgcggacctctggcgcaagctcggcgccctcggcgttctgggcgtcaccgtcgaggagacctatggcggcgccggcatgggctacctcgagcacgcggtggccatggaggagatcagccgggcctcggcctcggtcgggctgtcctacggcgcgcattccaacctctgcgtgaaccagatccgccgcaacggcaccgaggcgcagaagcggcgctacctgccgaagctgatcgcgggcgagcatgtcggcgcgctcgcgatgtccgagccgggctccggcagcgacgtcgtctccatgcggctgcgggccgacaggcgcggcgaccgctacgtcctgaacggcaccaagatgtggatcaccaacggtcccgacgccgacgtcctggtggtctacgccaagacggatcccgaggccggtccgcgggggatcacggcgttcctggtcgagaaggattttcccggcttctccaccgcgcagaagctcgacaagctcggcatgcgcggctcgaacacctgcgagctgctgttccaagactgcgagataccggaggagaacgtcctgggcgcggtcgggcgcggcgtcggcgtgctgatgtcgggcctcgactacgagcgcgccgtgctggccgccgggccgctcggcatcatgcgcgcctgcctcgacgtcgtcctgccctacctccacgagcgccggcagttcggtcggccgatcggcgagttccagctcatgcagggcaagatcgccgacatgtacacggcgacgaacgccgcccgggcctacgtctacgcggtggcgcgggcctgcgaccgcgggcgggcgacgcgccgggacgccgcgggcgcgatcctgttcgcggccgagcgcgcgaccgcggtagccctcgacgcgatccaggcgctcggcggcaacggctacatcaacgactatccgaccggccgcctgctgcgcgacgccaagctctacgagatcggcgccggcacgagcgagatccggcggatgctgatcggccgcgaattgttcgccgagacggcctga

SEQ ID NO: 5691 - DNA, 846 bp, Methylobacterium sp.
atggtccaagcgaacgatcccgcgcgcccgccgatacgggtgtcgtgcatccagttcgagccggaattcggcgcggtcgacgcgaatatggcgcgcgcgtcggacctcgtccgcgcggccgccgccgagggcggccggctgatcgtgctgccggaactcgcgagcaccggctacgtgttcgaatccgccgcggaggccgccgcgctggccgagccggtgccggacggcccgaccacccgcgcctgggcggcgctcgccgcggagctcggcgtgcacatcgtggcgggcatcgccgaatccgccggcgagaccctctacaacgccgccgtgatcgtcgggccggagggctacatcggcacctaccgcaaggcgcatctctgggaccaggagaacgtgttcttcgccaggggcgatctcggcttcccggtcttcgagaccgcgctcgggaagatcggcgtcgcgatctgctacgacggctggttccccgagaccttccggcagctggcgctcgccggcgccgagatcgtctgcatcccgaccaactgggtgccgatgcccgaccagcccgcgggcgaggccgccatggccaacaccctgcaccgggccgccgcgcactcgaacgggatcttcatcgcctgcgccgaccgggtcggcgtcgagcgcggccagcctttcgaggggcagagcctgatcatcggccccaagggctggccgctcgccggcccggcgagccgcgaccgcaccgagaccctctcggcgctggtcgacctcgacgcggccggccgcaaggacctgaaccggttcaactcgctgctgcgcgaccgccgctccgacatctacggctga

SEQ ID NO: 5692 - DNA, 933 bp, Methylobacterium sp.
atgagagaactcaacaccttctcgatcgccgcccgctgcccgcggaccggccagctcggcgtcgcggtggcgagcgccgtcccggcggtgggcggcctgtgcccgttcctcagggccgggatcggggccgtcaccacccagtcctgggtgaatccctacctcgccgcccgcatcctcgacgggctggccggcgggcaggatcccgacgccgcgctggcggcggccctcgccaccgacgaccggccggacctgcgccagctcggcctcgtcgacgggcaggggcgggccgccgcctggaccggcgccggctgcacgccggcggccggccaccgcaccggggcgggctacgccgcgcagggcaacatgcttgccggacccggcgtgatcgacgccatggcggaggccttcgcggggagcgccgcccaggatctcgacgagcggctgatgcgcgccctggaggccggcgacgcggccggcggcgaccggcgcggcaagcagtcggcggcgctcaagatcgtcgctgccgaggattacccgctcctcgacctgcgggtggacgagcacgccgagcccgtggccgagctgcgccgcgttctcctggtcgcccgccgtcagctcgtgccgttcgtggccggcatgccccggaaggacggtccggccggcgccctgccggacgccgtcgtggcgatgctgctcaggccccccgccgagcggccgggcgccgccggggatgcagcccccgacctgctgcgcgacgtcgtcggcctgcgccaggagccccggcgggtcgcgcacctgctggcccagttcgcgccggtgctcgccgagatcgcgcggctccgcgacctcgacctcgcggacatccacccgccggtcgtgttcgatccgacgctcccctaccgccgggtgccccatgacgaccgccgcgactga

SEQ ID NO: 5693 - DNA, 231 bp, Methylobacterium sp.
atgcggaccatcattctctcgggcgccctgttcgcggccctgtgcggcgcggcgagcgccgaggagaccaccgtcatccgccgcgacgggcccgccgtcgtcgaccaccgcgacaccgtcgtcgagaagcgtgaggtcaccaccggcagcgtcgattgcggctcgaagaccgtccacaaggaggacggcatgggcaactccaagaccgtccacaaggaaggctgcaactga

SEQ ID NO: 5694 - DNA, 1248 bp, Methylobacterium sp.
gtgacggcggcgccggtgagcgccgccgggatcgtcctggcgcgcgtcgaccggctcgccgggatcagcgcctacccgtggaccctgacgcggcgcgtcttcagcccgcagcaggccgaggccgaggcgctcgtcctcggctggatggcagaggccggcctgtcggcccggcgcgatcccgccggcaacctcgtcggccggatcgagggcgcggtcccgggcggcccggccgtcgtcgtcgggggccacgtcgacacgcgcgaggatgccggccgctacgacgggacgctcggcgtgctgatcggcatcgccgccgtcgagcgcctgatccggcaaggcccgcagccgcgccacgcggtcgaggtcgtcgccttcgtcgcggacgcggccggccggttcggtccccggcaactcggcagccgggccgtggtcgggcggctcgccccggacgcgctggactgggacgacgcctacggcgtcaccctgcgtcgcgccctggaggcgcacgggctcgacccggcgcacctcgcgagcgagcgccgggcccccgacgcgatcctggcctatctcgaggtcgccgccgaggccggccccgtgctggagcgatcgggagcgccgatcgggatcgtcccggccctgtcggaatcgacgatgctccgggtcacgctgacgggcgccgccgtcgacgcggcggcgaacccgatgccgggccggcgggacgccctcgccggggcggctgaatgcgtcctcgccgccgagggcgtcggcctggcgcgggagcgggtcaccgtcacggtcatgcgcctcgacgtcgcgccggtgccgaccttcgtggtcgcggggtcggcgacactgggggtccgcgtcgattacgacggcgcgcggcgcgcggccgtggcggaactcgccgcggcgctcgaggcggtcgcggcgcggcgccggctggggatcaccgtcgagcgcagcgtcgatcccgacgccacccggtgcgatcccggtctggtccgcctgttcgaggaggccgtcgcggcttcgggacaccgcgccgtgcggctggcgcagggcgtgaccaccgacgcgtcccacatggccctgctcggaccgatcggcctcgcgctgatccgctgtcgcggcggcgtcggctggggggcggcggggaccgtcgacccggccgacgtcgcggtcggcctcgacgtgctcactggcgttgtcggcgcgctcgcgggcggacgcctcagcccgctttga

SEQ ID NO: 5695 - DNA, 1122 bp, Methylobacterium sp.
gtgcgccgcgcgatcgttcacatcgggatgccccgaaccggctccaccgcgttccaggaggtgctggcccgcctgcgcccccgcctcgccgcggccgggatctgctacccgaacctcgccccgccgggcgcccccggcagcgacgacgtcaaccactaccggctcggccaggcgctggaccgccgccgcggcgccgcggagcgccgcgaggccctcgcgcggctcgacacgatcctggccgccacgccggccgacacggtcctgctctcctacgaggatttctccgtccagcgcccgctctggcgcgtgcccgagatcctgtccgacctgttcgcgcgccgcggcttcgccctggaggcggcgctcgtggtcaagccgcaggccgagcagctggcctcggcctacgccctgcgggcgcaggtcgtcgccgagggccgcacgttccgcggcttcctgcgctccgagggcgggtcccggcgctacgactacgcggaccggctcgagccctggcgccgcgccgctgcggggcgcgtcaccgccctgccgtaccgcgaccggcggtccgacgcgccgctgctggcgcggctggtcgacgggctcgggctgggcgagcgcctcgcgccgctcctcggcccggccgacctcgcctaccgcaccaaccggagttccgggccggtcgcggtcgaggcgtcgcgccgcctgtaccggctcggcgtgcaccggcaggtgaccgggcatcgccggctgctcggccacgtcctcgacgactgggcctgggcgcgggggctcgacgcggagcggttccgcggcgacgccccggaggggctggcccgcgtcgcggcgcgctacgcggccgggaacgcgcgcttcgccgccgcctgctgggggcagagctgggacgcggtgatcgcggccgcgcccgccgcgccgccgaacgagctcgccgccgggccggtcgcgcccgagacggaggccgcggtcgaggcgctggtgcgggcggcggcggcgcgggccgccttccggtccccgcccgcgtggcggcggcggacggcccacatcctggaggagtgccgggagcgcctcggcgaggccgtcggctacccggtctggcgcgtgccgtag

SEQ ID NO: 5696 - DNA, 330 bp, Methylobacterium sp.
atgcgcttcgccctgcccgtcctcgccgccctcgccgtcaccgccgccctgtcccggcccgccgcggccgagaccatcctccaggagcggttcggctgccacacccaggaggtcacggaccgcctgttcaagctggtcatggcgggcgacgaatccggcttcggccagctgctgcagggcagcctcgccagcggcgagtgccggtcgttcaagcccggcgaggaggtccggctcgagtcccggacgatgagctacggctgcctcgccctgaaggacacccaggatcgctgctactggacgccgttgagcgccatcgagaaggcgaactga

SEQ ID NO: 5697 - DNA, 783 bp, Methylobacterium sp.
atgagcctgatcgccgccaagatcgtcgtcacgccgaccctgatgtgggccgtgtcggcggccgcgcgccggtggggcagcctcgtcggcggcctgctctcgggcctcccgctgacctcggcgccgatctcgatctacctcgccgccgagcagggcgagcgcttcgccgccgaggcggcgatcggctcggtggaggggctcggcgcggtcaccgtcagctacctcgtctacgccgtcgccgcgccgcggacggggggtctggcgtccgcgctgctcgccctcgcgggcttcgtcctcgggggcgcgctgctgcacggggtggtccagcccggactgtggctcgccacggcgatcgacctgccggcgatggcgctggtggtcgccctgtgccggccggccgcggggaccgaatcgccggcccgccgggcgcgcccgccgcgctgggacatgccggcccggctcgcggccgccaccgccctggtcctgctggtctcggggctggcgccgcatctcggctccggcctgagcggcgtcctggcgccgattccgatcatctcctggccgctcatcgtcttcgcccgggcgcaggacggcgtcggcgccgcgctggacgtggtgcgcggcagcgcccagggcgcgttcggcgtgctggccttctatgtctgcgtgcacctgctgctcgggcgcatcgacccggtcgcggcctacgccgccgcgatcgcggtgtcggcggcctgcgtgctgccgtggctggtcgcgcggcgacgcccgctttccgcgtga

SEQ ID NO: 5698 - DNA, 663 bp, Methylobacterium sp.
atgcgcatcctcgtcgtcgaggacgatcccatcctctcggacgggctcagggcggggctcggcctcggcggggcgacgatcgattgcgtcgggacctgcgccgacgccgaggcggcgctggccacgagcgcgttctcggccatcgtgctcgacctgatgctccccgacggctccggcctcgacgtgctgcgcggcctgcgccgccggaaggaccggacgcccgtcatcctgctcaccgccctcgacgcggtggccgaccggatcgcagggctcgacggcggcgccgacgactatctcggcaagcccttcgacctcgacgaactttccgcccgcatccgcgcggtcgtccggcgggcctctgggcgggccgccgcgctcttggagcacgggggcatccggctcgatcccggcagccttgccgtcacggtccatggggtaccggtcagcgtgtcccggcgcgaggtcatggtgctggcagcgctgatggaacgcccggacgtgctccgctccaaggccgagttggaggagcgcctctacggctggcaggaggaggtcgagagcaacgccgtcgaggtccacgtgcacaacctgcgcgccaagatcggcaagcacgccatcgagaccgtgcgcggcctcggctaccggatgagggcgccggcatga

SEQ ID NO: 5699 - DNA, 444 bp, Methylobacterium sp.
atgctcgcggtcctcctcgcgaccctgggcatcgggacggtccgcgccggctcggaggccccggccggctactacgccgaccagaaggtggtctaccacaacggcggagccggcccggacggagcggcctacttcaagcgcctgctcgccaacctgcgcaatcacgtcgaggccgtgggcaaggcccatgtcgagatccgcgtggtgagcctcggcgacggggtcggactcttccagtcggccgcgaacgacacggaactcgccggccgcatcgacgccctgaagggaatgggcgtccggttcctggtctgcgccaacaccgtgcgcgaacggaagatcgaccgcaccaccctctacggcgtcggcgaggacgacctcgtgccgagcggcgtcgccgaactggcgcgcctgcagggcatggggttcgcctacatccatccctga

SEQ ID NO: 5700 - DNA, 546 bp, Methylobacterium sp.
ttgcccgccgcccagcgccgtttcgacccggatcgccgggcgcgcatcatccgggcgaccctcgacgtcgtcgccgagcacggcgtcgccggcacgacccaccgccgggtcgcggcggcggccgacgtgccgctgggctccatgacctaccatttcgacagcctcgacgcgctgctgaccgaggcgttcaccgggctcgccgacacggtctcggcgcggttcgccgaccggctcgccgcggccgcgaccgtcgacgaggcctgcgaggccgtggtcgacctgatcgtgagcgacctctgggcgagcccgcgcacgatgctgctgagctacgaactctacgccttcgcggcccggaacccgccgctgcgccgggtcatgcaggactggatggccaagagccgggccgccctggaacggcacttcgcgccggagaccgccaaggccctcgacgccatgatcgagggcctgacgatccaccgctcggtcgacccgcagccggcggatcgggcgcaggtgcgggcgatcgtggagcggctggtgcggtag

SEQ ID NO: 5701 - DNA, 600 bp, Methylobacterium sp.
atggaccacgcggacgacgtcgtatccgaggcggcgctcgtcgcggcgctcgaagcctcgggcggcgtcggcttctggatgtgggacatcctccgggacgaggcgcgggccgatcgggtgagcgccctgctgttcaatatcagcccggcccggtcgcgggtcggggtcagcctcgcggagctcctgaaggccgtccatccggacgatcagccccacatctcgcaggtcattctggactgcgtccggaccggcggctcctacacggcggagtaccgcgtctgctcgccggaggggcggctgcggtggctgttcacccgcgggcacttctacctggaccaggacgggcgaccgaccaccggacggggcgtgatcgtcgagatctcggacagcaaggcggccggcgcggctttcgcggagcgcgacggggacacgatcgacgacgccctcagccgcaccgccgacctctgcctgtcgctgcacaacacggtctcggtgctcggcgacaccgccctcgtggcgctgaccgagacgctgctcctcgagatcggcaagcggctcgcggagcgccagcgcgccgagcgcagcggcggtctgcactga

SEQ ID NO: 5702 - DNA, 396 bp, Methylobacterium sp.
gtggcgcgtccggacctcggcacgaagcgtatctgcccgacaacggggaagaagttctacgatctcggcaagaatcccgtgatctcgccctactcgggcgaggtcgtgccgatcgctgccgcgacatcgtattcccgggggagcgctcccgtcgtcgcgcgtaaagaggcgccgagcgacgaagaggacgagacggagggccccgagctcgtctcgctggacgaggtcgaggccgaggagtccgagaaggacacggacagcaacactgaggatgacgacgctctcgacatcgaggacgatggggagcaggtcgacgacgacaacctcgtcgtcgatgaggacgatgacgacaccagcgatctcgtcgaggtcaacgacgacgatgacgaccagtag

SEQ ID NO: 5703 - DNA, 699 bp, Methylobacterium sp.
atggccacggtggacttcctggccaagctcgtgcgggcgacgcccgcggggcgcgaccaggaccacatcccgaccctggtctgctcggccgtcgacatccccgaccgcgccgacgcgatcctgggcaccggcccggacccgctgccggcgctccgcgccgccctggcgcgcctcgaggccggcggcgccacccggatcgcgatcccctgcaacaccgcccatcactggcacgcggcgctgcaggccgcgaccgccctgccgatcctccacatcgtcgacgccgtggccgagaccctggcgcggagcgcgatcgggaccgcgaccggcggccggatcggcctgctcgccaccgacggtaccctgcggtccgggctctacccggagcggctggcgcggcacgggctcgcgtgccgcgcgcccgatgaggcgggtcaggccgcggtggcggcggcgatccgcctggtgaaggcgcaccgggtggccgaggcgacgccgctcctggaggcgcaggtccgggcgctggcggaggccggctgcgatcgggtggtgatggcctgcacggagatcccgctcgcgctcgccgggagcgacccgtcgggcctgctggtcgacgccaccgaggcgctggcgcgcgcctgcgtggcggcgtgccggccggattgccgcgccgacgccgcggccctgccgcgcgcggcctga

SEQ ID NO: 5704 - DNA, 426 bp, Methylobacterium sp.
gtgaagctctcagccctaaaggttgatcccgtagcgatcgaagtcggccagtgggtcggtgagatccccggctccggcgacctgcgcctgaaggtccgcggctaccagaacgcgcagttccggcggttgcagcagcgcctgatcgacgccgtgccgcgtgacaagcgccgcggcggccgcgtcgatcccgacgagatggacaagatcacctcgacctgcctcggctcgaccgtcctgctcgactggtctggcctggaggacgagaccggcgcggcgatcccctactcgaaggagcaggcgaccgagctgctgaccaagccggagtaccgccagttccgggaggccgtgatctacgcggccaccgtggtcggcgaggccgaggcgcagaccggcagggacgacgagggaaactcgtcgggcacctga

SEQ ID NO: 5705 - DNA, 1539 bp, Methylobacterium sp.
gtgcagggcggccccatgacgcgcgcggccacggctccgaccaatctcggcgacctcgtcgaccggtccgggccgccggacaggccgctgatcgtcggcgtcggcccggatggcgagcccgcggtgatgacccgcgccggcctcgacgcccgggccgacgccttcgcccgcggcctgctgcgcggcgggatcgcccgcggcgcgcgggtcgcgatcctcgcggccaaccggcccgacacgatcgcggccctcctcggcgcgatgcgcgccggcgtgatcccggtcccggtcaatcacaagttcccgccggccacgatcgccgccgtgctcgccgattgcggggcgcggctcgtgctctgcgacggtccccgccgggcgctgctggcggatctcggccccgatatccggatcgccgggttcgacgacggcgggccggagggcttcgcggcctggctcgaccccggtccgttcgttccggtcgtgcccgagcccgacgaggcggccctgttcctctacacgtccggctccacgggccggccgaagggcgtgcggctgagccatgccagccacctctgggtggcgcggacccgcgccgcggagacggacctgcgcgacgaccggctgctcgtggcggcgccgctctaccacatgaacgcgctggccctggcgctcctggtctgcgcggccggcgccacgatggtgctgctgccgcaattcgaggcgcgggcctacatcgcggcgatcgaccggtaccgctgcacgtggctcaccgccgtgccgccgatgatcgccatgatgctgcgggaaccggatctcttggccgaggccgacctcaccggcgtgcggacggtgcggatgggctcggcgccggtcaacgacaccctcgcccggcagatccgcgccctcctgccgaacgcccgcatcctcaacgcctacgggaccaccgagggcggcccggtcgtgttcggcgaccatccggacggacggccgacgccggtcgcctccgtgggcgcgccgcatccccaggtggcggtgcgcctcgtcggaccggacgccccggagaccgggatcctgcagatgcgcagccccgcgatcatgctcggctaccacaaccggccggacgtgcccgtcccgatcaccgcggacgggttctacgacaccggcgacgtcttccgccgcgacgcggacgggttcttctacttcctcgggcgcaccgacgacatgttcgtctcgggtggcgagaacatcttccccggcgaggtcgagctggtgctggagcgccaccccgcggtgctccaggcctgcgtggtgcccgtggacgacgccatcaagggcaccaagcccgtcgccttcgtggtccgccggccgggcagcgcggtcgacgaggccgctctcaaggcgcacgtgctcgccaatgcgcccgcctaccagcacccgcgccgggtctggttcgtcgaggcgctgccgctcgcctcgaccggcaagatcgaccgcgcggccctgcgccggcgggccgaagaggccgtccgcgccccgtga

SEQ ID NO: 5706 - DNA, 420 bp, Methylobacterium sp.
atgtccgacacccccctcaccaaggagcaggtcgaggcgctgctgctgcgcggcccgttccaccagtggctcggcctctccgtcgtcgccgtcggcgcgggcacgatcgagctgaaggcgacgtggcggccggaatgggtcgtcaacgccgagcgcggctacgtccacggcggcatcctggcgacgctggtcgacctcaccgccgactgggcgctggtctccaagaccggccggggcgtccccaccgtcgacctgcgggtcgactaccaccgcgccgcgatgcagggcgatctcacctgccgcggcacggtggtgaagttcggcaaccagctctcggtggccgaggcgcagatcctcgacgcggaggggcgcctgctcgcgagcggccgcggcgtctacatgacggcgccgccgaaatga

SEQ ID NO: 5707 - DNA, 1005 bp, Methylobacterium sp.
atgaaggcgctcgtgctggaggcgcacggcgacatcgacacgctgaaggtggtcgacgactatccgaggccgtcccccggccccggcgaggtcctgattcgggtcggcgcgtcctcgttcaactaccacgacgtgttcaccgtgaagggcatgcccggcatcaaggtgccgatgccggtggtgatcggcctcgacatggccgggcaggtcgtcgagctcggcgcggacgtcacggagtggcgcgtcggcgaccgggtgctggtcaacccgctcaacaaggccaagggcctgatgggcgagatgctcgacggcggcatggccgagtactgccgggtctcgacgggccagctcatcgcgatgccgccggacgtgagctacgcggacgcggcgtccctgccggtggcctacggcacggcccaccgcatgctgatcacccacaacaccgtgaaggccggcgacaaggtcctgatcctgggcgccagcggcggcgtcggcaccggctgcgtgatgctggccaagcagctcggcgccgaggtcatcgcctgcgcgggcagcgcggagaagatggcggcgctgacggccctcggggccgaccacgtcgtcaactaccgcgagaccgacttctccaagtgggcgatccagcagtacggcaagccgcagcgccggacctacgagggcggcgtcgacgtggtgatcaacttcaccggcggcgacacctgggtgccctcgctcaagtgcctgaagcgcggcggcacgctgctcgtctgcggggcgaccgcggggcacgatcccaaggaggatctccgctacatctggagcttcgagctcaaggtgatcggctcgaacagcttctacgacgacaacctgtcggccctgatggacatgatccaggccggcacgctgaagccgaccatcgacaagctcctgcccctcgaggaggccgccgagggcctgcggatgatccgcgaccgcgaggtcatgggcaagatcgtcgtcactccctga

SEQ ID NO: 5708 - DNA, 981 bp, Methylobacterium sp.
ttgaaacggatccgcgccctcgccgtcgccgcgctctgcgcggtcggcctgcccggcctcgcgcgcgccgagacggtgcgcatcggctactggagctcgggcatcagcctcggcttcggcgccgtgctggaggccggcaagttcatggagaaggagggcctgacggccgagtacgtcaagttcccggacgtgaacgcgccgaccaaggccatggccgccggggcgatcgatttcgcgatcgcggcgagcgccgggacggcgctgagcgtcaccgccgacgggctgccgatgagcatcgtcctggcgacccaggtggccgacctcgacttcgtcgtcccggaggactcgccgatcaagacgatggccgatctcaagggcaggaagatcggcacctcgccggccggcagcggcaccgccgccatcgcggcggcgatcctggagaccaaccacggcctcaagcccgccgactaccaggccgtccccggcaacgattcccggctggcgcaattcctcgtccagaaggacatcgacgcggcggccctgcgcaccgtgaccctcgcgctcctgccggacgtgaagctgcgccggctcggcaccttccgggaggagtggaagcgcctcaccaagcaggacgcgccgccggtcctcggcgtcggcctgatgcgcaacgcctggatgacgcagaatccggacgcgcccgccaaggtcgtggccgcgatgcgcaaggcctacgcgttcggccaggccgacaagcccggcgtggccaggatcctgaaggcggccgcgaacctgagcgacgccgacgccgcggcctacgcgggcctctgggacggcatctacacggtcagcctggagcccgccgacatcgcctcgctgaagcgggaattcgacgtgttcaaggcggtcggcgccgtccagggcagcctgccggacacggccctggtccccggcccctacgagcggtcgaagtcgatcccgtag

SEQ ID NO: 5709 - DNA, 633 bp, Methylobacterium sp.
cccggcctcgtcgccacgccgagcttcgccgccgatctcggcatcacgctgggccggatcggcgccggcctcgccttcgcggcactcgtggggctgccgctcggcctgctgctcggcgcgagcccgcgcctcgggcggttcttcgagccggtgctgacggtgaccaacaccgtctcctccgcgatctgggcgatcttcgcgctgatctggttcggcctctcgaactggaccacgatcttcgtggtgttcatgaccgcgatgccgctgatcctgaccaacgtctggcagggcacgcgcacggtcagcgccgagcatctcgagctcgcccgcaccttccggatgccgcgccgcaaggtgctgaccaagatctacctgccgacgatcctgcccgccttcttcgcgggcgcgcgcctcgccatcggcttcggggcgcgggtcgtcctcgtggcggaatcgctcggggcgagcagcggcatcggctaccgcctgcggcaggcggccgacctcgtccagaccgaccaggtcttcgcctggaccctcaccctcgtcgccctgatgatcgggctcgagacgctcgtcctgaagccggccgagcagcgcctgttcgcctggaagaaggtggcgcagccgtga

SEQ ID NO: 5710 - DNA, 672 bp, Methylobacterium sp.
atgttcgtattctcgattgtgcagcaaaaagggggcgtcggcaaaacaaccctggcgatcagcattgccgctgagcttcgtgcacgcggcaaaaaggcaatcttgatcgatgccgatccgcaggcctcagccgtcgcatgggcgagcccgcgtaaactcggctttgaggtgcgcgccgagctgatcggcggacagacggtgtcgcaatggctgcggaatgttctcaagcagcaggccgacttcgtgatcgtcgacaccccagcgggactcgggcctgcttttcgggccgctatcgatatcgccgatctcatcatcgtcccgtgcggcccctcgagcctcgatctcaatgccgcgcgccagacgctgtctcaggtaagctccgctctgcgcagtgacgcgcgctcacaggcgcggatcgtgaccatcccgacccgggtcgatgttcagcatccggaaggccaacagatcgccgaggaattgagctccttcggcgagccagttgggccggcgctcagccatgacgtgtattacgtccgctccttcagccaaggcgtggcggtcaccacagcggcgccggcgagccccgcggcggccgagatccgagctgtgacggacttcctgctgcgacggctggccgagcggaacggcgggcttgaacggaacggtgcatag

SEQ ID NO: 5711 - DNA, 1251 bp, Methylobacterium sp.
atgctggccctgtcggccgcctgcgggctgccggcgcgggcggcggacatgcgcatcgaggccgccaagatcaccggcggtgacctctggatcatcggttacgccgacgatccgggggtggagatcacgctcgacggccagttcccccatcggaccgacagccgcggctatttcgagtttcgcgtcgtctaccatccggccacctgcatcgcgacgctgcggacgccgaagcagacccgcagcatcgtggtcagcgagtgcggccagcaggggccgcaggcgcccgggctcgccggcccggccggcccgcgcggcgagacgggtcctcggggcgaggccgggcctcccagcgagcggggcgcgatgggaccgcccggaccgcccggaccgcaggggccggcggcccgggcggcgttcacgcatctcgcccgctggctcgtggcacgctccggcaccggggggacgctcgtggccctgctcgaccggctgcggccccgtccctccggccgctacggctcgctcccggtctcggcctgggacatccccaccaccttgggtctccgggcggccctggtcgccgcccccgaggcggcgtacgcggaggccctggacgcggccctccggctcgccgcttcggacccggagcccaccctcgcccgctggctcgcggtgatcttcgcggacgaccggcccggcgccgaccacgccctctccgcccgcgcggtgctggcgcgctgcgacccgcccgatcccaaggcctacggcaattcccacgtcgccctgccgctgatcgtcgacctgccgcccgcgcaggccgcgccctggtacgccgcgccgtatcaccgggcgacgctggcgacctgcgatgtcggggccgaggaggccgccgcgacggtgatcgccgtcgccgacgcggccggcgagccggccacccccggcctcgtctggctcctggagggggcggtcggccccgagcgcacgatcgtcgcccgggccctgctggagacccgcgccgccgacgccctcgacgcgctcctgccccgacgcgctcctgcccttcgtgggcaccaagctggtccgcgatgccctcgacgccgccgacgcggccttccccgactggatgctgcgggcctatctgggcgcgctccagggcaagggggagcccgcctacggccccagggctgtgaccctcgccgcgcgccacgggcacgcggtcgcccgcgcctgggcggcggtcgacggggcccgcgg

SEQ ID NO: 5712 - DNA, 843 bp, Methylobacterium sp.
gtgcccacgatcgcggtgatcgccccgggggccatgggcagcgccgtcggggctcggctcgccgggcacggcgcccgcgtgctgacctccctggacgggcgcggggcggcgagccgcgcccgggccgaggccgccggcatggcgcatgccggggacggcgacctcgccgccgccgatctcctgctctccatcgtgccgcccgccgacgcggaggcgctggcccgccggctcgcgcccgccctggcggcatcgccgagaaagccggtctacatcgacgccaacgccgtcagcccggagacggtcgggcgcatcgccgggatcgtcgaggccaccggcgcgccgttcctcgacggcgcgatcctcggcctgccgccgaagcccggcagcgcgggaccgcgcgtctacgtctcgggtccggacacggccccggccctggtcctgcgcgacctcggcctcgacctgcgcgtctgtcccggtgacgtcggcgcggcctccagcctgaagatgagctatgccggcctcaacaagggcctgacggcgctcgccgcgctcgtgatcggcgccgccgagcgcgccggcgccggcgaggcgctgctggccgaactcgccgagaacgagccggcgctgctggcccggttcgccaggggcctgcccgacatggcgccgaaggcctatcgctgggcgcccgagatggaggagatcgccgggttcctcgggcccgacgcggccgggcggcaggtcttctccggctacgccgcgctctaccggcgcctcgccgccgaggacggcgcggacgagatcgccgcgctgatgcgcttcgccgcggccgcggcggagcactga

SEQ ID NO: 5713 - DNA, 267 bp, Methylobacterium sp.
ttgcgagctccggcgctcgccgagctcgcatccgtgccccgctatttcatcgacctccacgacggcgccaacttggttcgcgaccgcgacggcttcgatcttccggatctcgccgccgcgcgggcgcaggcggtgcgcatcctgacgcggctcgcgcagggcctgaccgatccgatggagcggcaggattacgtgctcgccgtgcgcgacgcgcagggcgcggtccgcctgcgcctgcggctctcctacgatgtcgagggcggctga

SEQ ID NO: 5714 - DNA, 294 bp, Methylobacterium sp.
atgcccctcgaacgctacctggacggcggcgcccacatcctccccgccgacgactcgctgatccgcttcgccatgacgaacggccagcgggtgatcgcggtcgaggtcccggttcccgtgctgcgccagcacttcggcggcgccgacctcgcccccctagagctgttcgcccgcaatcaggcggtgatcgaggccgcggcgagccaggcctatgaccggaccgagacccccaacgacctcctcgatctgggcccggaggatttcgacacccggccggcctcggccaggacctga

SEQ ID NO: 5715 - DNA, 189 bp, Methylobacterium sp.
gtggtcgcgacctcgatcatcacggcccgcgacgacggggacgccaagcggcaggcaaagggattgatcgccgggcaccatgccgaactctgggccggcagccgcctcgtcaccgtgctcggcgcgttcgacttcccgatcgcgaccgcaatccgggcgctggcggaccagccgaagtcggaggggtga

SEQ ID NO: 5716 - DNA, 705 bp, Methylobacterium sp.
gtgtcgcgcggcgcggcagccggcacggaggcgggcgcggggtccggcgcggccatcgtcctggcgaacgcctccgcggcctatgacgggcgcccggttctgtcgggcctcgacctgaccgtgcgggcgggcgagcgggtcgcgctcatggggcgctcgggcgccggcaagtccaccctgatcggcctgatccacgggcaggcccccgagcgcgtggccctggtgccccaggcggccgccctggtgcggccgctctcggtgttccacaacgtctacatgggccgcctcgaccggcgctcgaccctgcacaacctgcgcaccctggtccggccggcgcgggccgacgtcgccgccgtggaggcggtcctcgaccgggtcgggctcgcggaccggctctgggcccgggccggggagctctccggcggccagcagcagcgcgtctcggtggcccgcgccctctacaacggacggccgatcctggtggcggacgagccggtctcggcgctggaccgccagcagggcggccggatcctcaccgagctggcccgcgggcacgagaccctgatcctggcgctccacgacgtggccctggccctcgcccacaccgaccggatcgtggtgctggaggccggccggatcgtcctcgacgcgccctcggccggcctcgacccggcgcggctcagcccgttctacgaggccgcctga

SEQ ID NO: 5717 - DNA, 1596 bp, Methylobacterium sp.
atgggctccgtcgccggcaaggccgcgggcagggccacggggaaggccaccggcaaggccgcgttcctgccgcggccgggctacgcggcggtgagccggtggttcctggccgcggcgctcgccggcctgctggtggcggacctgcaggtcacgacgctccaccccttcgccgacctcgcccggctgctgggcggcctgatccggcccgattttctcgcggtcgagggctggagcgtcctctacaccgtggccttcgcgatgctcggcgtcgggctcggggccggtacggggctgctgctcgccgtccccttcgcccgctcgcgcgccgtccggctcgcctgcgcgggcctgcgcgccgtccacgagctgttctgggcgctgctgctgatgcaggtcttcggcctgtcggcgaccaccggcgtcctcgccatcgcgctgccctacgcgggcatctgcgccaaggtctacgccgagttgatcgaggaggccgacctcgcggcgctccgcgtcctgcccgcgggcaccggcgcggtctcggccttcctgtacgcgcgcctgcccgaagtggccggacggatgcgcgactacaccctctatcgcctcgaatgcggcctgcgctccagcctcgtgctgggcttcatcggcctgccgaccatgggcttcgccttcgaatccgccttccgccagggccgctacgccgaggccggggcgctgctcctgatcttctacgcgctgatcggcacgcgccggctctgggtgcgcgcccggaccctgccaatcctcctcgtcggcgccgtgctggcgctgccgccgaccgtcggcagcgcggcgatcggcccgagcctcgcccgcttcctcggccacgacgtcgtgccggccccgctccggggcgcgccgctcgccgagcccgagacctgggcgcggctctggtcgtggctgcgcccgatcctgaccgagcaggtcctgcccggcaccgcccagaccctgatcctggcgcagatcgccctggccgccaccgccctcggggccctcgtcctgttcccgctgaccgcgcggcgcttcgccgggccgatcgggcggccgctggggcgggcgctcctcgtggtggtgcgctccacgccggaatacatgctggcctacgtcgccctgcagctgctcggcccttcgatgctgccggcgatcctggcgctggcgctgcacaatgccggcatcgtcgcctacctgatgggccggcacgccgacgcgatcccctaccgggccgacgcgccgcggggcctcgacctctacgcctacgagaccgtgccgcggctctacgggcagttcctggcctacctgctctaccgttgggagctgatcctgcgggagagcgcgatcttcggcatcctgggggtcgcgacgctcggcttctacgtggacgccgcaatctcggaactgcgcctcgacgtggccgtcgtgctgatcgctgccaccgcgctggtgacggtggcggtcgacgcgttctcgcgggcgctgcgccggtccctgcggatcgacgcgctgccgacccggctctccgggccgcagccgatcaccggggcggagagggagggcgtttga

SEQ ID NO: 5718 - DNA, 738 bp, Methylobacterium sp.
gtgagcgtccgcctcgccgatccggagcccgggatccggctcgtcacgatcgaccggccggagcggcgcaacgccctcgaccgggtgacctacgcgggcctgaccgacgccctggaggccgcgggacgggacgcggaggtgcgcgccctggtcctcaccggcgcgggcggctgcttcaccgcaggcaacgatctcaaggatttccaggacgtcgagaccggcggcgacagtcccggcctcaccttcctcaaggccctgcgcgcctgcccgctcccggtcgtggccgccgtggagggccacgcggtcggcatcggcacgacgctgctgctccactgcgacctcgcctacgcgggggacggggcgcggttccgcctgcccttcacggccctgggcctcagcccggagggcgggtcgagctaccttttgcccctggtggcgggatcgaagcgcgccgccgagctgctgatgctcggcgagcccttcacggccgcggacgccgccgcttccggtctgatcaacgccgccgtcccggccgggacggccctggagacggcactcgccaaggcgcgcgccctcgccgccctgccccgggtctcgatcgccgccaccaagcaggcgctgcggcgcggccacgacgacagcgtcgcccgcgccctcgacgccgaggcggaggtcttccacgccctccgccgcggtccggcggcgcaggcggccttcgcggcgttcctgcgccgatga

SEQ ID NO: 5719 - DNA, 396 bp, Methylobacterium sp.
atggaacagctttccgactaccggtcttgctccgcaatgagcatggatgaactggctctcgcggttggccttcccgggaaggtcggcgggcatgggtcggaggttgagggaatggttgagcgtggtgaaatcgacaaggttcgcgcctactgtgagggcgacgtcctaaatctgtttgggctttacgtgcgctgggctctcctcacgggccgcaccgatgcggctgggcacaacgcctctcttgaaagcctcatgggctgcctggaacgagagcgccacgaccgcccgcacttcggcgagtttctagagcggtggcaagccacaggaggacaatcgcccatgatcctccccctggcagggggcacagatgctgggatgcataccggggcgatatga

SEQ ID NO: 5720 - DNA, 771 bp, Methylobacterium sp.
gtgaacgccgtcgagctcgaccacgtcagcaagtggttcgaccggcgcgagggcgggccgctccacgtcctcgacaccgtcgacatcgcgatcccgcagcacgcgatcgtcgcgatcctgggcgcatcgggctgcggaaagagcaccctcctcaacatgatcgccgggctggtcgagcccgaccagggcgccgtcctcctcaacggcatcccgtcgcacgccttccgcgactggcgggccatgacctacatgttccaggaggaccggctgctgccctggcgcacggccgcccagaacgtcgccttcggcctcgaggccgggcgcatgggccgggcggagcgggcccggcgggtcgacgagaccctgcggctcgtcgggctggaagccttccgcgacgcctacccgcacgaattgtcgggaggcatgcgcagccgggtggcgctcgcgcgcagcctcgtgaccgagcccaagatcctgctcctcgacgagccgttctcgaagctcgatcccgagatccgcgcgcagatgcacgcggagctgctgcgcatcgccggcctgcgggcgatgaccctggtcttcgtcacgcacgacgtcgaggaggcggtggtgctggcgagccaagtggtcgtcctgcacccgcggccgggccggatcggcaccgtccgggcgatcgatctgccgtacccccgcgacccgctctcgacggaggtcgccgaggaggtccggcgcctgcgcatcagcctctccgccgcgagcgcgcgatgctcgtga

SEQ ID NO: 5721 - DNA, 429 bp, Methylobacterium sp.
atgaacaccatcgatttgaatgaaaagacctcggatctgaacacagacctgatcaagtgcacggcatcaccggtcgcggcctacgtgtctcggaatgcggtgggcgtgggcgacctgccggttctgatcgaccaggtgcacacggccatatcggtgctgcagggcggcggttcgggatccggtcccggctggaccggcccgacggcggcgcagatcgaggcctcgatccagcaggacggcctgatcagcttcatcgatggccggtcctataagaccctcaagcgccacctcacggcgcacggcctcacgccggagcgctaccgggcgaagtacggcctgccggccgactacccgatggtggccccgggctacgccgccaagcgctcggagatcgccaaggcgatccagctcggccacaaggcggcctga

SEQ ID NO: 5722 - DNA, 216 bp, Methylobacterium sp.
atggctgacacgccggacgacacccaggccgagcggatgccgcacggcgaaccggagcgcgcgggcctggccgacagcccccgcgacaccgccaccggcacggtcaggccgcaggacggcccgatggagcgggccggcaccgagaaggaggaggcgcgccggggcggggccagcctcggcgcggagcgcgatcggccgggcggaggccggggctga

SEQ ID NO: 5723 - DNA, 372 bp, Methylobacterium sp.
atgacgcttccgatcacgccaagccgccacacgccgctgccggttcattcacgcaatccgcgccgcgcctacgacgtcgatggcttcgagatcacgccgatgacgttccagcaggcgatggacaaaggggtgctggccgtccgggtgatctgcggctgcgggcacgtcgaagagaccccgatctatgtgggggcgtggccatcgacgagcttcgtgcctgatgccggcatgacgctccggtgcagcgcatgctcgacgccggacccatggactgagcccgtttggcccgccataccgagcacagatggtcttgaaccgtcctgtctgctcccagaccagctccccgagtcggatcccggcttggtccggtag

SEQ ID NO: 5724 - DNA, 705 bp, Methylobacterium sp.
atgggatccctggcgctgtgcgcctgtgcggccctgccgggcctgacgccggcaccggcccgggcggccgagccgacccggacggtgttcggcacgctgccggacggccggacggtggaggaggtgacgctgacgaacggcacgggcctcacggcgcggatcctgtcgtggggggcgctcctgcggagcctcgacgtgccggaccgctccggcaaggccgcggacgtcgtgctcggctacaacgacctcgcctcctacctggccaagggcaactacttcggcgcgagcgtcgggcgctacgccaaccgcatccgcgccgggcgcttcaccctcgacggccggacctacacgctggcgaccaacgacggcccgaacgccctgcacggcggcgcggccggcttcgacaagcggctctggacgatcaccgcggtcaagggcggcgcggccccctcggtcaccctgcgctacgtcagcccggacggcgaggagggctatcccggcacgctgacggcgaccgccacctacgcgctggacgacacgaacaccctcacggtcacctacgaggcgacgaccgacaggccgacgatcgtcaacctgaccaaccacagcttcttcaacctcgcgggcgagggctcgggccgctcgatcctcgaccagattctaccatcccggcggagcgcttcacgccggtcgaccccaccctga

SEQ ID NO: 5725 - DNA, 855 bp, Methylobacterium sp.
atgtcgagatccagcctgccggcgacgcgctcagcatcgtctccgcctcagaagctcaacatctcggcggtggacgccctcgtggagaagttccggtccagactggaggtggacccggcccatccgctgcgctgctccgtgcggcaggatttggcgccttcgaccgaggagaggcgcgagctctccgtcgccagagactacctggctaggcgcatcgagccgacggaagaccggctagaggtagaggctgtcatcacgacgtggctctcgacctacgacagtgggaagggtccggaagagctgaacatcgagatcaccgatgcccaatacgttcgcgctctgcgagtgagtggcttcagcgacctcgacgaagacccgttggacgacggcgtgacccggtactacccggtgcaggctatcgccgcagcgtgtgatcggctcaaccgcagccacaacctcgtaccccggaacccggccttccggccgcacgtccctcagctcgtcaacgaggtccgcgccggcctcacgaaggtgagggctcgcatccacgcgatcgagcgggtgctgaatgccagcgtctaccagccggctcccacgcgggctctgtcgcaggcggacgtcacgaagctgatcgacacggcgctcggccgcctgcgcgaaggcgacgaccgcccggagaacgagaaggcgatcgaggagagtaaacggtccatccagaaccgcgagcgaaccgaggccctggcccatctcgcgcgacggaaggccgaggtcgacgccgcgatcaaggcggaggaggaggcggcgcggctggcggcctcgcaacaacccccgccatccgagcaacgaccgaactaa

SEQ ID NO: 5726 - DNA, 900 bp, Methylobacterium sp.
atgaagaagcttctcacctctctcgcggcgttcaccgcgctcacggctgccgcttcggccgccgacctgccgcgccgcgccgcgccgccgccggtgttcacccccgttccggtgttcacctggaccggcgcctacttcggtatcaacgccggctacgcgttcgacgccagcagcaactccacccgcggcttcgtccagacgcccggcaacccggtcgctctggttccgggcggtctcgtcccctaccaggccctgctgccgaacggctcgtcgctggtctacagcaacgacagccgcgaaggtttctcgggcggtggccagatcggctacaactggcagctgaccccgggctccggcgccgtgatcggtttcgaggctgacgcccagtacctcgacttcggccgtcgcgcccgcttcgccaccaacgccgtggcgatcaacccgggcttcatcccggtcaacggcacgctcaacaccatcgacttcttcggcaccgtccgcggtcgtctcggctgggccttcgaccggaccctcgtgtacgccaccggcggtttcgcctacgccaccggcacggatgacggcgctcgcgtcggcctgcagaacttcgccggccgccggaacgacttcaagaccggctggacggtcggcggcggtgtcgagtacgccctgcccaccgactcgttcctgaacttcttccgctcctcggccgtcacgctgaaggtcgaaggtctgtacgtgaacctcgacaacaacaacggccgcgcccaggctccgctggtcggcgccgcgatctccccggtcggcctcgtgccggtgtactcgctcgccggcgccagccggaacgagaacgccttcgcggtcgtccgcgccggcctgaactacaagttcggctcgtactga

SEQ ID NO: 5727 - DNA, 1215 bp, Methylobacterium sp.
ttgacgatcatgacctcgctgttcgccggcatccaggacgcgccgctcgacccgatcatgcgcctgttcgaggccttcaacgccgacccgagccccaagaagctcaacctcgtcgtcggcgtgtacacggacgcggacggcaaggtgccgcgcctgcgcgccgtgcagaccgccgagaagcgctggatcgagaagggcctgccgaagacctaccggccgatcgagggcaccaagccgttccgcgacgcagtccaggagctcctgttcggcaagggcgcgccgatcctgtcacagaaccgggccgcgacgctccagagcatcggcggcaccggcgccctgaagaccggcgccgacctgctggccaagctctacccgaacgccaccgtggcggtgagcaacccgagctgggagaatcacaaggcgctgttcagccaggccggattcaccgtggtcgactatccctacttctcggccgagaccggcggcgccgactacccggccatgaaggcctatctccaggatctgccgaagggctcgatcgtggtgctgcacgcctgctgccacaacccgaccggcgccgatctcggcctcgaggaatggcgtgacctcgtgcccctgatggccgagcgcggcctgatcccgttcctcgacatcgcctaccagggcttcggcaacggcctcgacgccgacgccgagccggtgcgcctgttcgccgagtccggccaggaattcctggtcgcctcctcgttctcgaagtcgttctcgctctacggcgagcgcgtcggcgccctgaccatcgtggccgagaacccggccgcgaaggccaaggtcgagtccttcgccaagcgcctcgtccgggcgagctactcgaacccgcacacccacggcgcggcgatcgtcgagatcgtgctcaccgacccggagctgcgcgccgactgggagcgggaactcggcgagatgcgcgaccggatccgcgccatgcgcgagcggatggccgacagcctgcagcagcgccacccggagcgcggcttcgacgccatcaaggcgcagaagggcatgttctcctacacgggcctgagccccgccgaggccacccgcctgcgcgaggagcacgaggtctacgccctggaaaccggccggatctgcgtcgctgccgtcaacacccacaatatcgaccacgtcatcgacgcgatcgacgcggtggtgaagggctga

SEQ ID NO: 5728 - DNA, 342 bp, Methylobacterium sp.
gtgtcgcactccctggtgaaccgggacgcgctcgaagaactgacggccgtgatcggcacggagaagctcgtccgcatcctcgagcggttcgtcgtcagcctcaccaccgccttcgagggaccggatcgcgcgaacgacgattacggccgcgaggcgcacacgctggtctcgatgtccggcatgctcggctgcgccgagctgtcccgggcctgccgcggcctcgaggagtcggccatggcgggcgacgatctgacccgctcgctggtcgacctcaggatcctgcgcgaccggaccgtcgcggccctgcgggacctgcaggcggagacccggctgagcgcctag

SEQ ID NO: 5729 - DNA, 243 bp, Methylobacterium sp.
atgctgcatctcgccggcctgctcgaggaactcgagcggagcgagcccgcgcgggccgcgatgtcgatcctcgagacctcgctcgcgcgccgctcgacggaggagcagggcgcgttctggcgcgccgtcgacatctactacgtctcgcgcaaggccccgcccgaggcgaccgtgccgggccaactcgggtcaggcgaagtcgtgccgagccaggccgcgccggagctggctgccgcgtcctga

SEQ ID NO: 5730 - DNA, 1521 bp, Methylobacterium sp.
ttgaacggcgcgctgaggagccggcagtcggcccaggcggcgctgcgggagcttgatcggcaggactacctccagaaccacctccggttcgtgcagcgcttctttcgcgagaaagagggctacgacatgatcgtgggcccgcaccaccggatcatgtgcgagacgctcgaccgggtgctgcgcggggagatctcccggctcatcatcaacgtgccgccgcgctacaccaagaccgaggcggcggtggtgcacctgatcgcccacgggctcgcgctgaacccggcctcccggtacatccacgcgtcgttcaacggcccgctggcgctgctcaactcgaccagcgtcaaggacgtcatgcggctgccggcctaccgggagttctggcaccgcgagccgcgcgacgacctcgactcgaaagagctgtggcgcacccccgagggcggcgggatgaaggccggctcggccggcggcccgatcacgggtttcggtgccggcctgatgtacgagggcgcctggcgcttcaccggcgcgctcatcatcgacgacccgctgaagccgaaggatgcgcctcacgagacgatgcgcaaggcggtgaacgacaactggaacgccaccttcgcgagccgtctggcgaccgaagacgtgccggtcatcgtcatcatgcagcggctgcacgtcgacgacttctcgggcttcctcctgaagggcggcgctgggtgcaagtggcaccacctgctcctgcccgtgctgatcgacaacgccgcggagtacccggcggagttcacgcacggcatcccgatcgcgcacggcctgcctgacgggccgctctggccctacaagcacaacgccgagcagatcgaggccctgcgccacgacagctacaccttcgccggccagtacatgcaggtgcccgtcgtctcgggcggcaacctcttcaacgaggactggctgcacggctacgacgagctgccgaagctcgaataccggatgatctacgccgacaccgccatgaaggacggtgagcggaacgattactcggtgttccagctctggggcaaaggcgtcgacggccgcgcctacctgatcgaccaggtgcgcgggaagtggctggcgccggagctggagaaggtcgcccgcgccttctggtggatgcacgccgacatggagacccaccacttcggggcgctccgggcgatgaaggtcgaggacaaggcgtccgggaccgggctcatccagaccctcgtgcggccctacgccggcgagggcgggcgcaagggcatcgccattccggtgatcccgatccagcgcgacaaggacaaggtgcagcgcgccaacgacgcgctcccccagttcgcgtgcggcaacgtgcgcgtgccgaccgatgcggcgtggttcccggcctggaagagcgagctgctcgccttcccgagcggcagccacgacgaccaggtcgacccaacctgcgacgcggtcagcgacatgctggtcaacgtctcgaactcccgtctcgtgtttggttga

SEQ ID NO: 5731 - DNA, 1608 bp, Methylobacterium sp.
gtgaagccggaggcgcagcgcaaggccgagcgtgagaaggcggtcgccctgatccgggccctcgaccgcgaggagatcgtcaccgaggcgcgcgagcggttcatgccgttcgtgcgcttcaccatgccggacccgcaggacccggacgacgcgaagcgctcggcctacgatgaccaggacttccaccgtgcgatcggcctcgccctggagaaggtcgagcgcggcgacatgccgttcctgatcctgaccgtgccgccccgccacgggaagtcgcagctcacctcgcggcacttcccggcgtggctgctcgggcgcgacccgcgccggcacatcgtggtcgccgcgcacacggacaatctggccgaggacttcggcgccgacgtgcgcaacatcatgtcgacgccgcagtacaagcaggtgttccccgaggtggccttccagcggggcggcaacgccaagaaccgcctccagacgaccaagggcgggctcgccttcttcgtcggccgcgggacggccctgatcggccgcggcgccgacttcctgatcctggacgaccttatcaagaacgccgaggaagcccggtccgcggccgtgcgcgaggaagtctgggagtgggtcgtcaaggtcgccatgacccggcgcatgtcggcccgcagcccggtcgtcatcatcatgcagcgctggcacgaggacgacccggtcggccgcatcaccgacccgacgaacccgaagcacgacccgatgctggcctcgaaattcaagatcatcgatctgccggcgctcgcggtggacgacgacccgctcggccggccgaagggcagggcgctctggccgctgtcgaagggccagccgaagttcgacgaggagttcctggagcagcagcggcgcctcgatccgaccggcttccacgcgctctaccagcagcagccgtccgccgtggacgggacgctgttcctgcgcgacaacatccgcctctacagccccgacgagctgccggcgaacctgacgccctactgcacgtcggaccacgcggtcggcgaggaccggaagaagcacgacgcctccgtgctgctcgggggtgggctcgaccgcggcaacaacctctggctcaccaactgcatctgggagcgctgggcaaccgaccgcatcgtcgaggcgatgctggacatggcccaggagctgaacccgctgatctgggcggctgagcgcggccacatctcgaagtcaatcgggccgttcctgcgcaagcgaatgcacgagcgcaacatcttcttcccgctgcgcgagatcacaccgagcgagaacaaggaagtccgggcccaggctattgccggtcgggtcgcccagggcaaggtgttcttcccgcggcacgccgcctggactgagcgggcgatcgacgagctgctgaaattcccgaacggccggaacgacgacttcgtggacgccctggcctacttcggcatcctgctccagagcatgttcgcgcccggccggtccgagcaggagcggcgcgcggccgagcccaagacgggctcctacgcctggatcaaggcgatgcagaagcgccaggagcaggccgaacagttccgggaaggtggaggatactga

SEQ ID NO: 5732 - DNA, 888 bp, Methylobacterium sp.
atggacgtcttcctccaagtgctcgccaacggggtgatgctcggcggcctgttcgcgatcgtcagcgtcgggctgaccctgatcttcggcatcgtgaaggtcgtgaacttcgcccacggcgagttcctgatggtcgggatgtacctgacctatctcgcggtgaccgggctcgggctgcaccccttcgcggcggtgatcctcgtcgtgccggtcctgttcctgctgggcgccctgacccagcggttcctgatccagccgctgctcgccgcgggcgaccatcacatccagatcttcgctacggtcggcctgtcgacggtgctgatcaacctcgccctcctcgtcttcggggccgacatcgccaacacgccgccgtcgggcctgcgccagccgctggagatcggcccggtccgggtgctgctcgggcaggtggtgatcctcgggtccgcgatcgtgctggtggcggggctccagatgttcctggcgcgcacccgcacgggccgggcgatccgcgcggtcgcccagaaccgcgcggcggccgagctgatgggcatcgacgtcgaccggatctacgccctgaccttcggaatcggcgcggcctgcgtcggggtggcggcggtgctgatcgccccgctctatccgacctcgcccaacagcggcacctacttcgtgctgatcgccttcgtggtcgtcgtgctcggcggcctcggctccatccgcggcgccttcgtcggggcgatcctgatcggcctgatcgacagcgtcacgggcttctacgtcggcgccgacatgcgcgaggtcgcggtcttcggcgtgttcctggcgatcctgatcctgaagccctcgggcctcttcgggcggcagctccggctgtcccacgtctcgccgtga

SEQ ID NO: 5733 - DNA, 888 bp, Methylobacterium sp.
ttgcggacagtcctggcgcgtgtcggggcgcaggaagatctcaacttcctgctgacgaaccgcctgccgcgccgtctcgccacccgcttcatgggctggttcagccggatcgagcagccgctgatccgcgacctctcgatatcgacctggcggctgttctgcgacgtcgacctccgcgacgcgcgggagacacgcttccccagcctccacgccgccttcgtgcgcgccctgcgtcccggagcccggcccatcgcgaccgatccggccctgctgacgagccccagcgacgcgatcctgggggcccacggtcgcgtcgaggccggccgcctgctccagatcaagggcctgtcctacccgctcgccgacctgctcggcggggacgtcgcgctggcgcgcgcccacgagggcggcagctacgccaccctgcgcctgacggccgggatgtaccatcgattccacgcgccgcacgacctgcgggtcgagtcggtgcggcatatctggggcgacacctggaacgtgaaccccatcgccctgaaacgcgtcgaggcgctgttctgccggaacgagcgcgccgtcctgcgcctgcgcctcgcggagggcggccacgccgtgactctggtgccggtggcggccatcctcgttgccgggctgcgcctcggcttcctgcccgagggtctcgccctgcgcgagacgggtggacggaccctgcccaccgcgagccgcctcgcgaagggcgccgagatgggctggttcgagcacggctccaccatcgtggtgctgacgccacccggcttcacgctctgccccgggctcgccgtcggatcgattctgcgggtcggcgagcccctgatgcggctgccaccgcttcccggatcggccggcggctga

SEQ ID NO: 5734 - DNA, 612 bp, Methylobacterium sp.
atggcgagttttcgggaggcactgcgcgtccagcgctgggacgaccaccgctactaccaccacaaccgcgtcaatcagagcctgcacgtggtgagcgcgctcagcttcttggtcgcctacgccctggcgttcagggatccggccacggcggccctgatcggctggctggtggcgatgacctcgcggcaggccggccacctgttcttcgagcccaagggctacgaccacgtcaacgacgcgacccacgagcacaaggaggagatcaaggtcggctacaacctgcagcggaaggtcgtgctcctggcaatctgggccctgtcgcccctgccgctctacttcgacccgagcctgttcggcctgatcgcgccgcaccagagcaccgcggacctgatccgcaacgtcggctggatctggctgtggctggcgctcgccggcctgctgttccggatggtgcagctcttcgtccagcgcgacgtccagaccggcctcgtctgggtgaccaagatcctcaccgacccgttccacgacatcaagctctaccacaaggcgccgctggccctgctgcacggcgagctggtcgaggagcgggagccgcacgagcgcggcgcctga

SEQ ID NO: 5735 - DNA, 687 bp, Methylobacterium sp.
atggccctcggaatgcacgacaccggttcctcgcgcgcgggcacgctcgggcccgatctcgaccgcgacggcgtcgccaaggcctacggccgctgggccccggtctacgatctggtcttcgggcccgtcttcgcgcaggggcgtaccctggcggcggcggccgccgaacggatcggcggccgcatcctggaagtcggcgtcggcaccgggctgtccctgccggcctacaggcgcgcccgcagcatcgtcggcatcgatatctcggcccccatgctggagaaggcgcgccagcgcgtggcgcggctgcgtctgcgcaacgtcgagcgcctcgccgtcatggacgccgagcagctcgacttcccggacgccgccttcgacgtggtcgtcgcgcagtacgtcgtcacggcggtccccaatcccgaggcggcgctggacgagttcgcccgggtgctacgccccggcggcgagatcgtgatcaccacgcggatcggcgccgaggccggcctgcggcgcgcggtggagcgcaccctcgctccggtgacgagccgcctcggatggcggaccgagttcgcctgggagcgctacgcggcctgggccgccggcgcgccggtggagatcgtcgagcgccgggcgctcccgccgctcggccacttctccctgctgcgcctgcgcaagcgcgccgcctga

SEQ ID NO: 5736 - DNA, 804 bp, Methylobacterium sp.
atgaatgacgagaccgaggctcgcggcgcgggggaggacctgctgttctccgtcgcggagggtgtggccaccatcacgctgaaccggcccgagcggaagaacgccttcaccttcccgatgatcgaggcctggacggcggccctgcagcgctgccgcgccgacgcggcaatccgcgtcgtggtggtgaccggtgcgggctcggccttctgcagcggcggcgacatcgtcgagatgggcgagcgcctcgaccagccgccggcccggcgcaaggaggagctctacgggcggatccagcgcatcccgctgacgctggaggatctcgacaagccggtgatcgccgccctgaacggcgtggcgaccggcgcgggcctcgacctcgccctgatgtgcgacctgcgcttcgcggcgaagagtgcccgcttcgccgagacctacgtgcgggtcggcctcgtccccggcgcgggcggcgcccacttcctgccccgcctcgtcgggaccgcgaaggcgctggagctgttcttcaccggcgatttcgtcgatgccgacgaggcgctccggatcggcatggtcaacggcgtccacgccgatgcggacctgatgccggcggtggcggcgctggcgcgcaagatcgccaaggcgccgccgctgacgctgagcctgatcaagcgcgcggtctaccagggcatgcgcaacgacctgcgcaccaacctcgacctgatctcctcgcattacgccgtcatcaccgccacgcccgagcaccgggaggcggtgcaggccttcatcggggggcgcgacaggacctga

SEQ ID NO: 5737 - DNA, 576 bp, Methylobacterium sp.
ttggaggcccggcacccgggcctgcgcgagcgctatcgccgatccgccgacgccctggcggccggtccgctggcggacctgatggccgcccgccatgccgacgaggaggagctgcgggtactgcgccggcagcggatgtcgcccgagcgcgagcgggagctgctggaggcgaacaaccgcctcgtcgcccgcgccgaggccgccgagacggcgcggcacaatgcggaggaagcgctcgcgacgctgcgccgcgagcgggatgtcgcgcgggaagccgaggcgttctggcagcaattcgccttcgacgccgacgatctcgcgacccggcgcctcatcgagcagaccgaagcccgcgccgaggccgagcggcgggcgatcgaggagcgatgccgacgggaacgcgcggaggcggcgctgcgcctgttcgccgaccgggccgacgtcatgcccaaggagggatgggcgtcggaactggcgaaggccaatcgcgacatcccgctctggtggttccacgcggcccgcgtcgccctcgagccgccggacctgtcccgaccgaccgagagcggcgaggcctga

SEQ ID NO: 5738 - DNA, 252 bp, Methylobacterium sp.
atgtcccacagcccatcgccgctgtgcatcgccgagaccgaagcggtcgcggctgtcccgcgcgccgccgtccgcgcctacctcgccctcgtcgccggtctcggcggtgtcgtcacggccgtgatgctgatgatgtcggtcgcggccaacagcggcagcgaggcggagcgcatctcggcgacgcaggaagacagctacgcgaccacgctggtcggcgcgctcgcggtcaacctgtccaagcctctgcgctga

SEQ ID NO: 5739 - DNA, 1230 bp, Methylobacterium sp.
atgacgctccgccaccgcgccgcgacgctgctcgggagcttgtgcgcgctcggcgccggcgcggcgctcgcggccgacctcgtgccggtgaagatcggcgtgctgaacgaccgctccggcgtctacttcgactccaccggcgagggctccgtggtcgccgcccgcatggcggtcgaggacttcaagcctgaggcgcacgggctgaaggtcgaggtcgtcgccgccgaccaccagaacaagcccgatgtcggcgcctccatcacccggcaatggtacgaccgcgacggcgtcgacgcggtgttcgacgtgccgacctcctcggtggcgctcgccatcgcgcagatcaccaaggagaagaacaaggccttcatcaactcgggcggcggcaccgccgacctgaccggcccggcctgcacgcccaacaccgtgcactggacctacgacaccgcggcgctggccaacggcaccggcaaggccatcctcaagcgcggcggcaagacctggtacttcatcaccgccgactacgccttcggcctcgccctggagcgcgacaccaaggcggtggtggagaagaacggcggcaaggtcgtcggcggcgtgcgcacgccgttcccgaacccggacttctcctcgttcctgctccaggcccaggcctcgggcgcgcaggtgatcgggctcgccgatgccggcctcgacgccgccaacgccatcaagcaggcgcacgagttcggcatccgccagggcggccagacgctcgcggccctgctgatcgccatcaccgacatccactcgctgggcctggacgtggcgcagggcctcgccttcaccgcctcgttctactgggacctcaacgacggcacccgggccttcgcggagcggttcgagaagcgcatgcccggcaagaagccgacctcgtaccaggcgggcgtctacgccagcacgctgcactacctgaaggcggtggcggccctgcactcggccaaggacggcgccgccgtggtggcgaagatgaaggagatgccaaccgacgatccgctgttcggcaagggcacgatccggccggacgggcgcaagatccacccgatgtacctgttcgaggccaaggcgccctccgagtcgaagggcgagtgggacctctacaaggtgctggagacgatcccggccgagcaggccttccgcccgatgagcgagggcggctgcccgatgctggccggcatgacggcgaagtag

SEQ ID NO: 5740 - DNA, 438 bp, Methylobacterium sp.
atgcccagcaccatggcggacgacgcgacgacccggtccggacgctgccactgcggagcggtgcgcttcgaggcggccctcgacggggatctcgcgtcgatccgacgatgcacctgctcctactgccgcatgcgcggcgccgtcgtcgtcatggcgcggccgggcggggtgaggatcctggagggggcggaggcgctgacgacctaccggttccataccggggcggcgcagcacttcttctgctcccgctgcggcgtctacacgcatcatcagcggcggtcggacccgaacgtccacgccgtcaacgtggcctgcctggagggggtcagtcccttcgacttcccggaggtcccggtgatggacggcgtcaatcacacgaacgacaccggccagcccacgcgacgcgccggcacgctgcgcttcgtcccggcagagtga

SEQ ID NO: 5741 - DNA, 411 bp, Methylobacterium sp.
atgagatcccccctgatcgcgctcgtggtcggcgcgatggcgctcgcgctcgccgcctgcgatgccccgaagccgggaccggccggacctcccgggacgaagggtgatccgggaccgccggggccggccggtccggcgggggtgaacggcgccaccggggcccgcggtcccgcgggcgacccgggcccggccggaccggccggtccgccgggaccgtccctgagcagccaggtgcgcctcgacgtggcgtgccgccgtgacgaggaattgattggcgcttactgccgaggcatggcggttgtgccgtcggtgaccgtcacggacggcgtgtccacggtcggctgcctcgacatgaccgccaaggccgccaaggatgccaagcccgtcgcggtctgcatgaagaggccatga

SEQ ID NO: 5742 - DNA, 261 bp, Methylobacterium sp.
atggcgctgtccggacccatcgaactcgtcctccgcctgggagccgtcccgcgtagcggcgcgatcgtcctggtcgagcaggccgtcgacacctacctcgcgggctacgcgcatcccgaagagcgcgccatcgccctcgacatcctgctgcgcgacctcgcccgcctgcgcatccacgagcccgacctcgacgggttcgtcggcgaggtcgagcactacatcgacctgcttcaccgggacctcgcccgccaggccgcctga

SEQ ID NO: 5743 - DNA, 600 bp, Methylobacterium sp.
atgcgcaggccagatcagcccgccctgacggccgccgccaacggccgcgtgtccatgcccttcctgccgacgctggccgtcgtggcaatcctgggcgtggcatcgctctactgcccgacctcgaagccggggcaggccggcgcccgggtcgaagcgggcctgtccgccgctcccggacccacggatttcgcgccgatggccgccgtcgcggcgccgggccgcccgcccgccgtgatcgcgttcgccgagcagtacccgctcgacgccgtgatcgcgcggacgggctccctgcccgcacgtccggccgtggccgcacgggcgacctcccacgtcgcggccgccggccggcgcgcctgccccggccggcgctgccccgagacgccgcgcagcaactccgatcccatggcgcccgcccgcggggcggccgatgaggccgaggacgccctgctcccgtcgcaggccatgcccttcgcggcctcggtggtggagaccctggttccggccgcgcgggccgtcggcgacgcggcgaatctcgtgcgcagcagcgcgagggcggtccagggcacggtggccctggcggtggccgactgcctgcgctga

SEQ ID NO: 5744 - DNA, 792 bp, Methylobacterium sp.
atgggcctttacaccgcgctctcgaactcgatttccggcgcctcggcgcagtcgctggccctgaacaacatctcggggaacatcgccaacacccagacggtgggcttcaagtccaccgagacgcggttcgccgacatgctggccgagacccgggacggcacgcagctgaccggcggcgtgctgccgagcacgcgcaacagcctcaacatccagggcacgatgcagtcgaccggcgtggcgaccaacctcgcgatctcgggcaacggctacttcgtcgtcaagaagaacaccgggacgccggacagcccggccttcgccggcgacaccggctacacgcggcggggcgacttcgcgccggacgccagcggctacctctcgaacggcgctggctactacctgttcgccggcccctcggcgacgacccccgttcaggttccgaccggggcgagcaccctggcgagcctcgcggtctcgcccgccggcaccctcacgggcacggccgcggacggcagcaccctggccctcggcacgctgcagctggcgcagttcggcatgcaggacaatctcgcctcgctcgatggcggcacctacgtggccaccggccagtccgggacgccgagctacggcctcaacggcgcgaccatcacggccggctcggtggagcagtcgaatgccgggatctcggatcagttctcgaagatgatcgagacccagcaggcctacacggccaacaccaaggtcatgagcaccaccgaccagatgctgcaggacgccatcgcgatgtacacctga

SEQ ID NO: 5745 - DNA, 291 bp, Methylobacterium sp.
gtgcccaagggctacatcatcgtccggatgacggtcaccgacccggacacctacaaggactacgccgccatggcctccgaggcgatgcgcaagtacggctgcaagccgctggtgcgcggcggccgctgcgaggcgctggaaggcgagggccgtccgcgcaacgtcgtgctggaattcgaatcctacgaggcggcgcgcacctactacttctcgcccgagtaccaggctgccgtagccaagcgccggccagcgggcatcggcgaggtggtgctcgtcgagggcgtcgactga

SEQ ID NO: 5746 - DNA, 1962 bp, Methylobacterium sp.
gtggacggcggcaccgtggagaagatgcggtcggtggctgctttgaagacactcctcgtcggcgtgatcgggcacgtcgatcacggcaaaacgtcgctcgtccgcgcgctcaccggcgtcgagaccgacaggctcaaggaagagcgcgcccgcggcgtgtccatcgtgccgggcttcgcgctgctgaccgccgcgcagggcgagatcgacctcgtggacctgccgggccacgagcggttcgtccgcgccatgatctccggcgccaccggcatgcgggccgttctgctggcggtcgacgcccacgagggcatcaagccgcagacggtggagcatctcgagatcgccgccctcatcggcgtgcgccgcggtgtcctggcgctgaccaaggcggacctcgcgacgcccgagaccgtggccgcgcgcgccgccgagatcgcggccgcggccgcgcgggccgggatcgaggccggcccggtcatcgccacctcgaccgtgacgggcgacggcctgccggagctcgccgccgccctctcggcgctggtggcggagacggaaccggtccgcgacgacggcttcccctacctgccggtcgaccgggtcttctcccggccgggcttcggcaccgtcgtgaccgggacgctgcggcgcgggccgctcgcggtcggcgacaccgtcgagatcgcccccggcggccgcaccgccacggtgcgcggcctgcagattcacgggcgcgcggtcgagcgcgccgagcccgggcgccgcacggcggtcgccctgcgcggcatcgacctcgaccaggtcgcccgcgggcaggcgctgtcgctgccgggcctgctcgcgcagagcccgtggctcgacgtggcgatcaccgcggccccgagcctgccggacgccctggcgggcggcacagcctgccgcctgctgttcggcaccacagaggtcgaggcgcgactgcggctgctcgaccgcgacgccctggagccgggcgccagcacccaggcgcagctccatctcgtcgagccggtggcggtgccggcgcgggagcccttcgtgctgcggctcgattcgccctccgtgacggtggcgggcggccggatcctcgacccggcgagccgccgccgccggcgccacgatccccgggtcatggccgacctcgccgccctggcggcgggcggtcccaccgaggcgatcacggtccgcctcgggcagctcggcgcggcaggggcaccgctcaacgaactcgcccggatcgccggtagcgcgcctgaccgcgcccggcaggcgctctccgaaggcggtgcccgcgcgatcggcgaccgcttcgtcggggccgcggccttcgaggcgctgcgcaccggcacgctggccgccctggcccaccatcaccgcgacttcccgatggagcacggcatcgccctggagcgcctgtcccgcgccctggcgctgcctgaggcggtgaccggcgcggtcctgcgcgacctcgcggcggccggcggcgtcgctcaggcgggcgccctgtggcgacgggccgagttcgaccccgcgcggaacgagaacgaggccgcccgccggctggagcaggtcttccgccgcgccggcctcagcccgcccgacgaggccgaggccatcggccgggacgtgcgccgccgcgaggcgctgacctacctcgtgggtgccggcacggtgatccgcgccgtcgaccgggtgcagcgccgcgccgtgctgttccaccgggaagcggtggccaccgccaagagccgcctgatcgacgccttcccgacggcgcggacggcggagaccggattcctggcccgcgaggccggcgcgaccctgggaatctcgcgcaagttctcgatcccgctgctggagcacctcgacgccacggggttcacccgccgggccggggatcgtcgggtgatcgtcgccctcgaagccgggcgggcggtcccggacgccggctga

SEQ ID NO: 5747 - DNA, 90 bp, Methylobacterium sp.
atgagcgcccgtctcgaagacctgaagttcatgctgacgctcagcgccgtggtcctgctcggcagcggcctcggcgtcatcctgcgctga

SEQ ID NO: 5748 - DNA, 1260 bp, Methylobacterium sp.
gtgatcgtcggcggcggcgtcgccgggatcgaggtggcgacgagcctgggacgcggcggccgggcggacgtcacccttgccgatcgcagcctctcgcacgtctggaagccgatgctgcacaccttcgcggcgggcacggcccgggccgaccggcagaaggtggatctcttcgcccaggcgcgccgcaacggcttccggttccagcccggcgccctcgtgggcatcgaccgggcggcgaggcgcgtccggctcgcggtcgaggccgcggagggggttccggaggtggagcgcgcctacgatctgctggttctcgccatcggcagccgcgccgacgatttcggcacgccgggcgtggccgagcattgcctgaccatcgacgacctgaccgaggccgagcacttccacgaacagttgcggtgccatctcctggcccggctcgacggcggcggcctgctggagatcgccatcgtgggcggcggtgcgaccggcgtcgagctggccgccgagctcaagcacgccatcaacctcttcgcggtctacggctcgcccgacctgccggggcgcctgcgcctgacgctgatcgagagcgggccgcgcctgttgccggccttccccgagaaggtgtcgcgcgcggccgcccgtaccctgtcggatctcgacgtcgaggtccggaccggcgcgatggtgacggccgcggacgcggacggcttcatcctgaaggacggccgccgcatcccggccgggctgaaggtctgggccgccggcgtcaaggcgccggacgtgctcgccggcctcgacggcctggagcgctcacgggccgggcagctcgtcgtcggcccggacctgcgcacgacccgggatccggccatcgttgccctcggcgactgcgccagcctcaccgactcccggaccggccaccccgttccggcaaccgcgcaggccgcacgccagcaggcgcagcatctcgcgcgccatctcggccgcgcgctggcccgcggggatgcgcccgacgcggacctccctccgttccactatgccgagaagggcgcgatcgtctcgctggcggatttcaacggctggggcaccctcggccgctacacgttcggtggcgggcgcctgaacgggctctcggcgcggctgacgcacgacctcctctaccggcagcaccaaatcgggctctacgggccgctgcgcgggacgatgacgtgggtcctcgacgatctcgaccacctgatcagcccgccggtgcgcctcgactga

SEQ ID NO: 5749 - DNA, 243 bp, Methylobacterium sp.
atgacggtgcccgaattcacgctcgccgacccggggcaggtccccgaggtgccgccgcagccgacgccggtgccggaccgcccctacgatccgccgcaggcgccgacccagccgcccgggccggagatccccggaaataccccggcggaggcgccgggcatccagccgcccgagatacccgtcaacgatccgggcgtgcccgagatcagcccgccgacgggaccggccaacccgatcgcctga

SEQ ID NO: 5750 - DNA, 159 bp, Methylobacterium sp.
atggcgttcttcatcggcatcgcgtgtccgtggctgctgatcgcggtgctcgacaggatcgccgaggggcgccgcggcgccgagctctcggccctcggcatcacgccccagtcggccccggcgcgatccagctacctcgtcccggatcggccgtactga

SEQ ID NO: 5751 - DNA, 1065 bp, Methylobacterium sp.
atgttgaccgtcgatagcctctggcgcgcgcggcaccggctcgcgcagttcgggaagaagcggaccggctcgccgcgcatcctcgtgatcggcgtctgtcaggccggatccatcgccaagacgatgcgctacctgctgccgcacgcgcaggtggatttcgtctcggcgttcacggcctcccgccggttcccgcggctcgccgacctgatggcgcacgcggacggctacgaccacgtcttcaccagcatctacctgcccaagttcaagggcggcggcacgatcgacacgctgcggacgcaccccaaggtccggctgatcccgaccatcgtgttcagcgcctaccatcccgacctcgtccacgtgggcgttcaagatcacgtcacgctgaacggcctgatctcaggtccgatgggccactcgcactcggcgatcacgctgttcgcctacctgtcgggcttctcgcaggcgcaggcgctgcggctgttctccgagccggtcttcgagcgcctcggatacttcaatctctgggacgagtcggtcgcgtacctgcgcggcctcggcgtccaggccgggtacgatctcgacacgcacctcacgcgctgggcgcgtcggggctgcttcatgcactcgatcaaccacacgaagctctacgtcgtggccgacctcgcccgcggcctgctgacccgggccggcgtgccgttcgaggaatgcgacctcgacgcgttcctcccggacgatctcggcggccagggcagctggccggtctatccggagatcgcccagcattacggcgttcccggcagcgccctgttcttcaaggccgagacgcgccggtccggccccgcgcgcacgatgagccggcccgaattcgtcgccgcctcctacgcgaactacgaccggcgagagcggaagctcctgatctcgcagcgcgtccagggctggctcaacgacgcgccgacggtggatttcctgcgcgaggccgcgggccggggcgaggcgccggcgcggccggcgagccgggccccggcggtgaatgccggcagcctcgccggccacgcctcgtag

SEQ ID NO: 5752 - DNA, 342 bp, Methylobacterium sp.
atgcgcaaagtcttcgtcaccctcgccttgctcgggacattggcggcacctgaggcggcccgggcccagagccggaccaccctcggtgtcggctcgggcgcggtcgcgggagcgctggtcggcggcccgatcggtgccgtcgcgggggccgtggtcgggggtttcgtggggaactcgtcggagcgcgggcgccggcacgtccgccggggacgccgctacggctacgcggccccgcgccggtcctacccgcggcgggcggaggccgccgtgccgcggaccaccggctccgtggcccgcgccgcgccgccggcccagcccaccacctggaaagacccgcgctag

SEQ ID NO: 5753 - DNA, 534 bp, Methylobacterium sp.
atgccgctgatcgaccccgcccgctcgctcctcctcgtcatcgacgttcaggtccggctgatgccgacgatcgcggaaggggacggggtcgtcgccaatgcgggccgcctcctcgccgccgcgcagctgctcgacgtcccggtcctggtcaccgagcagaatgccggcggcctcgggccgaccgtgccggccctggcgcccgagcccgggacggccttcgcgaagatgagcttcggcgcgacccggacgcccggcttcctcgagcgcctgcccgcggaccgcgacctcgtggtcagcggctgcgaggcgcatgtctgcgtgctgcagacggttctcgggctgcgcgagtccggccgccgcgtcgccgtggtggccgacgccgtgggctcgcggcggatcgagaaccgggaggcggcgctcgcccggatggcggcccacggcgccgagatcgtcacgaccgagatggtggcgttcgagtggctcggcacggcgcggcacaggcggttccgcgacgtcgtcaggctcatcaagtag

SEQ ID NO: 5754 - DNA, 1194 bp, Methylobacterium sp.
gtgacgcgcctcgacgatctcgaacggcccggcgccgcggaaccgcgggcgctccccccaccgcccgcggaggcacggccggcgaagcccgtgcgcgacgcgcgggtcgacgtggtgcgcggcctcgcgctcctgacgatcttcatcgaccacatcccgcgcaacgcgccggccctgctgacgctgcacaatttcgggttctcggacgcggccgagatcttcgtgctgctggccggctactcgtcgatgatcgcctacggcgggctgttccgacgcgccgggatccggacggcgctcgcgcgcatcgccaagcgctgcctgcgcatctacctgttccaggccgggctgctgctcgcgaccctggtcatcgtccggatctggatggacctcaccggcctgacgccgcgattcggcgtcgcgccgctgctgcagatgggcctcctgccgggcctgctgcgcggcctcgcgctgaacgcgctgccgaactacctcgacatcctgccgctctacatcctgctgctggcgctgttcccgctgatctatctcgggatgcggcgcgggatctggggcgtgctcggcctgtcgggcgccctctggctcgccgccaacgtcgatcaccagctgaacctcccgaacgccgcggcggtggatgacgggtggtacttcaaccccttcgcgtggcagttcctgttcgtgatcggcgcggcgctcgcggtcacaatccgcgcccatgacggcctgctgccgcagcgcggatgggccgtggcggcggccgcggcctacctcgtcttcgcgttcctgcagggcgggtcctgggcggagtgggggcttccggacctccggccgctggcgatcgggccgcccgacaagagccacgtcgcgcccctgcgcctgatcaacatgctggcgctggcctacctgctgttcagcgcgcccgccgtggcccgcgcgagccggtggcggcggctgcgcctcgtcgacgcctgcgggcggcactcgctggagatcttcgccgccgggtgcctggcggcgctgatcggccgcatcctctaccggaccttcgaccccacctggccgctgcagatcgcggtcaatgtcggggggatcgcggtcatgctcggcctggcccacgtcctggacgcccgcgtccgccgggccgccgggaccgaccccgacgcgcgccggcccggatag

SEQ ID NO: 5755 - DNA, 306 bp, Methylobacterium sp.
atgcgttgggcatcggtcgattcgaaaggcaagggagcggggagttcaggctccagatcctccagcgtcgagacgctggcgctccatatcgggcggctgctgcgacatcccgcctaccggcgcgaggcggtcgtgagcccgctcctgcggcgccacctgccgttcgaggccggctacgcctggaacggcgaggccggcctgcgcgcccggctgacgagcgccgccctcgacgaggcgagcatcgatcacctgatccgcaacgtgcaggccgagttcctgcgcctgcgccggcccgccgatacctga

SEQ ID NO: 5756 - DNA, 1038 bp, Methylobacterium sp.
gtgcccgccctcgggcgcgcctgcgcgctggtcgcagccatgctgatcgccggcggctccgcgcgcgcggctgatccggccgccggccccctgacgatcgccgagcagggcagcttcttcgtcggcggccgcgacgtccagtccgacacgctctcgacgctgccggcctacgcgccgtcgggcacgatcagcgtcgaccagatctacgtccgctatcaggtcccggtgaatgccgcacggccgccgctggtcctgatccacggctgctgcctcaccggcaagacctgggagacgacgcccgacgggcgcatgggctgggacgagtatctcgtccggcgcggcttcccgacctacgtgatcgaccaggcctggcgcggccgctcggcggcgagcccggcccagatcaacgccgtgaagacggggcaggccgaccccaagacgctgccggtcgtcttctcggccgggcgcgagccggcctgggcgatcttccggttcgggccggaatacccgaaggtgttccccggcatgcagttccctctggaggcccagggcgagttctggaagcagatggtcccggactggtcggccgccctgccggtgccgaacccgaccgtgccggccctgtcggagctcgccaagcggctcaagggcgcggtgctgatctcgcactcgcagtctgggatctacccgttccagaccgccgccctcgatcggaccggcctgcgcgccatcgtggccatcgagccggccgcctgcccggacccggccaaggacgacctcgcgccctacaaggacctgccgatcctcgtcctgttcggcgactacgtcgacgcctcgccccgctgggcgccgcggctcaagcagtgccgcagcttcgtggcggccgccaacgccgcgggtggcaaggcggagctgatcctgctgcccgagatcggcatccacggcaattcgcacatgctgatgcaggacaagaacagcctcgacatcgccgactggctggtcggctggatcgacaagcgggcgcccggcaagtcctga

SEQ ID NO: 5757 - DNA, 405 bp, Methylobacterium sp.
gtgcggcgtgtcggtgtccccactcttgccctgacgcttgccctgacgctgcgtctcgcggggacggccgccgcgcaggtgcccgccacaccggccaacccggccgcgccggcctcggccctcgacaattacgcctcggcggcggccacgaccatcatcgccgagcaggcctgcccgggcgtgcaggtccgggccggccagctgacgacgctccgcctcgcggcacgcgtcaatgccgggcaggaggcgatcctggaggagaagctgcgcacccgcgccacgcaggtgcgccagcagctcgccgccgacggccgggagacgtggtgcgcgcaggccctcgccgccttcggcccggcgggcagcgtcgcgaagggcatcctgtcgaccggcgcgccgatccggtga

SEQ ID NO: 5758 - DNA, 1416 bp, Methylobacterium sp.
atgcggcgcacgatggtctgggccgtactggcgctgctgatccccgcgggggcgcgcgccgagccgaaggacagcttcgcccggatcgaccagatcaaccgcgcctccctggtgatgacggtggagaccggcatcgtgccgcgggcgctgggcgcgaccgtcgcccgcgccctcgaccaggtcgccgccgacgccgccaagccgggtgccgagcggccggacgactacctgcggatcgagccgctgatcaccgccatcgcgggggccgacgccacccggatgcattccgggcgcagccgccaggacatcatcccgacggtgctgaagctcgagcaacgcgaccgcctcctgaacctcgccaaggccctcgacgagacccgggcggccctgttggcggtggccgagcgcgagcccgacacgatcgtcccggcctacaccaacggggtccaggcccagccgacgacgctcggccacgtctacctgggctacgcggccgtcctcgcccgcgacgccgaccgcctccgggagacctgggcgcggctgaacctgtcgcccctgggcgcggccgccctcggtacgtcgagcttcccggtcgaccgcgagaggctggcggcgctgctcggcttcgacgcgccggtggagaacagctacgattccggccagctcgcgccgatggacatggggatcgagctgaccgggctcgcggcgaacctcgcgaccacggccggcagcttcgcgcaggatctctacgcgcagtaccaccagacccggccctggatcctgctgcgggagggcgcgctgaccgggccgagcagcatcatgccgcagaagcgcaaccccgtcgcgctctacagcctgcgcatgaaggccagcgacgtcgtcggggccgcccaggccttcgtcatcatggcgcacaacgtcgattccggcatgccggactacaagcgcaaccaggccgagccgccggggcggaccctggccgaggccgccgagatgtgccggcgctggacgcgcgtcctcgacgggctggtcgtggaccgggcgcgcgccgccgacgaggtcgcggcggactattccaccaccaccgaactcgccgacacgctccagcgcgaggccgacgtgccgttccggctcggccaccacttcgcgtccgagctcgtgagctacggccgcagccacgacctgcgcccggacgacctgcccttcccggaggtgcagcgcatctacgccgaggccgcggccgggtcggggctgaagccggacctgcccctcgacgaggcccgcttccgggcggcgctgtcggcccgcggcatgatcgacgccgcgaaggggctcggcggcccgcagcccgcggaggtccggcggatgctgggcgccgcgcaggcgcggctgcggaccgaccgcgactggctccac

SEQ ID NO: 5759 - DNA, 213 bp, Methylobacterium sp.
atgacccttatcaagccgctggagaccggcgagacccgttcgtcgaagctcgccgccgatccggcgcgcagagccgcccaagccccgtccgccaccctgatcccgttcccgggcgcggaggcgcggcggacctgccggatcccgcgctccggcgagcggcgcggcgagatcctcctgttcctcggcgtgcgctacgagcgcctcgcgtcctga

SEQ ID NO: 5760 - DNA, 1395 bp, Methylobacterium sp.
atgcagctctggcgtctgacggcgaccgacctcgcggccctgatccgctccggccaggtctcggcccgggaggtggcgcgggacgccctcgaccggctcgacgcggtcaacgggcggatcaacgccgtggtcgagcaccgccccgaggacgtgctggcgcaggcggacgcggtggacgccgcccgggcgcgcggcgaggcccccggaccgctggcgggcgtgccggtcaccattaaggtcaacgccgaccagcgcggcttcgcgacgacgaacgggctgcgcctccagcgcgacctcgtggcgacggacgacaaccccgtcgtcgccaacctgcgccgggccggcgccgtgctgctcgggcggaccaacaccccggccttctcgctgcgctggttcacaaccaaccagctccacggcgacaccaggaatccccgcgacccggcgctgacgcccggcggctcctccgggggcgccggcgccgcggtggcggccgggatcggcgccatcgcgcacggcaccgacatcgccggatcggtgcgctacccggcctatgcctgcggggtgcacgggctgcggccgagcctgggccggatcccggcctggaacgcgtcctcgcccgagcgcggcatcggaccccagctgatggcggtctccggcccgctcgcgcgcagcatcgccgacgttcgcctcggcctcgaggtcatggcggcacccgacccgcgcgatccgtggtgggtgccggcaccgctcgagggaccgcccgtctcgcgcgcggtcgcgctctgcgtgcggcccggggggctcgctaccgcaccggaggtcgaggccgccctgcgcgaggccgcgcgacgcctgagtgaggccgggtgggcggtcacggagatcgccgacaccccgccgatccgggaggcgtgcgaactccagctccagctctggctcggcgacggctacgcggcggtccgggccgcggcggagcgggaaggggatccggcggcgatcggtctcctggagagctttcggccgcgggccgaggcgatggcgcccgacgccatcgcccgggcgctgacccggcgcgcgacgctggcgcgggactgggcgctcttcctcaccgagaaccccgtgctgctggtcccggtctcgggggagttgcccttcccggacggcctcgaccgcaccggcgacgcggggatcgcccgggccttcgaggcgaacctgctgcaggtcgggctggcgccgatcggcgtcccggcgctcacggtgacgaccggcctcgtcggacggacccccgtcggcgtgcagctggtcgccgcccgctaccgcgaagacctctgcctcgcggccggcgcggcgatcgaggccggcggcgtgccggagatgccggtcgacccggcctga

SEQ ID NO: 5761 - DNA, 1593 bp, Methylobacterium sp.
atgaagcgacgcaccctgctgaccggcgccggagccctgatggccggggctctcgcccggccggccctggtccgggcggcctccgcgacgaccctgcggttcgtcccctacgcggacctcgcgctcctcgacccgatcatcaccaccaattacgtcacgcgcacccacgcgctgatggtgttcgacacgctctacagcctcgacaccgcctaccgcgctcagccgcagatggtggcgggccacgaggtcgcgtccgacggcctcacgtggcgcctgaccctgcgggacggcctgcgcttccacgacgggacgcccgtcctcggccgcgacgtggtggcgagcctgaagcgctgggcgcagcgcgatgcctacggcggggccctgttcgcgacggtggacgaactctcggcgccctccgacacggtggtccagttccgtctgaagcggcccttcccgctcctgccggacgcgctggccaagccgacctcctacgtcccggtgatcatgccggagcgcctgagcgcgacgcccgcgacgcagccggtgccggagatcgtcggcagcggcccgttccgcttcgtccccgaggagcgggtcccgggctcgctcaacgtctaccgccggttcgaggcctatcgaccgcgccccgacggcacgccgagcttcacggcggggccgcggatcgcgcatttcgaccgcgtcgagtggcgcacgatccccgacggcgcgaccgcggccggcgccctgcgctcgggcgagatcgactggtgggagcagcccctcgtcgatctcgtgccggacctgaaccgccagcccgccgtgcgggtggatctggtggagaccgccgggctgatcggccagatccgcctcaaccacaccctgccgcccttcgacaatcccgcgatcagccgggcgctgctcgcggccgtcgaccagaccgagatgatggacgccgtcgccggcagcgacccggcgatccggcgcgggcccgtcggcatcttcacggctggcgggccgatggcgtcctcggccggcatggaggcgctgaccgccccccgcgacctcgccgccgcgaagcgggcgctggcggcggcgggctacaagggcgagcgcgtcgtgctgctctccgggaccgacgtgccgcggatcaacgcgatctgcgaggtgatggccgatgcctgccgcaagatcgggatgaacctcgacgtcgtcgccaccgactggggaacggtcaaccagcggatcctgaacgcgaagcccctcgaccagggcggctggtcgatgttcggcatcttctccggcgggctcgaccacctctcgccggcctaccatctggccgcccgcgggaacggccgggccggcgtgccgagctggctgaccgacgcgcccctggaggagctgcgcggcgcgtggttcgacgcgccggacctcgacgcccagaaggccctggcggcgcggatccaggcgcgggcgctggaggtcggcgcctacctgccctgcggccagtatttccagccgaccgcctaccggcgcgacctcgagggcatgctgaccgggctgccgctgttctggaacctgcgccggtcggcctga

SEQ ID NO: 5762 - DNA, 1290 bp, Methylobacterium sp.
tccgggggcggccccgtcccggacgcggcggcgatccgggccgcggcgtcggcgcggctcgccgccgagcgccggccgtcgctgcggccggtcttcaacctgaccggcacggtgctgcacaccaatctcggccgcgccctgctgccccgctcggccgcggaggcggtggccgccgtgatggtgcaggcgagcaacctcgagttcgatctcgagaccggcgcccggggcgagcgggacgaccatgtcgagggcctgatctgccgcctgaccggcgccgaggccgcggtggtcgtcaacaacaacgcggccgcggtcctgctggtgctgaacgcgctcgccatgcgcaaggaggtcgtggtctcccgcggcgaactcgtggagatcggcggctcgttccgggtgcccgacgtgatggtgcgggccggatgccgcctgcgcgaggtcggcaccaccaaccgtacccacctgcgcgactacgcggaggccctcggctcccgcaccggcctcgtgatgaaggtgcatccgagcaactacgccatcgcgggcttcaccgcggcggccgatcccgtggccctccacgccctctgccgggagcgcggcgtgccgctggcggacgatctcggcagcggcagcctcgtcgacctcgcggcctacgggctgccgcccgagcccacgatccgcgccgccctggagcgggccgacgtcgtcaccttcagcggcgacaagctgctcggcgcggtccagtgcggcatcgtggccggccggaaggacctgatcgcccgcgtgcgcaggaatccgctgaagcgggccctgcgcgtcgacaagatgacctacgcggccctcgaggccgtgctgcggctctacctgcacccggagcggctgcgggcggagctcccgaccctgcggctcctcacccgcgaccgcgatagtatcgccgcccaggccgagcgcctcgcccccgcggtggcggagcggctcgccggccgcgccgcggtcacggtcgcggagtgcatcagccagatcggatccggcgccctgccggtggagacgctgcccagcgccgccctggtcctgacaccggcctcggcgggcggccgcggggcgggcgggcggtgccggcggctcgccgaggcgttgcggcggctccccgtgccggtgatcggccggatcagcgacgaggccgtccgcctcgatctccggacgctcgaggacgaggccggcttcctcgacagcctggcggcactcccgcccgtcctggacggggggcgaaccccgagacgaaccccatag

SEQ ID NO: 5763 - DNA, 915 bp, Methylobacterium sp.
atggcgagcatgaccccggccgagatggcgcgcgtgctgggctctggcctgctgtccttcccggtcacgcatttccgcgacgatctcagcttcgacgagaccgcctatcgggacaatctcgggcggctggccgactacagggtgtcgggcctgttcgccgccggcggcaccggcgagttcttctcgctgacgcccgccgagatcgaccgcgtcctgcgcgccgccgtcgaggagacccgcggccggaccccggtcatcgcccccgccggccagggcaccgccctggcggtcgagatggcccgggccgccgaagccgccggcgcggacgggatcctgctgctgccgccctacctcgtgggctccgagcaggccggtctcgccgcccatatcgaggcggtctgccgggcgacctccctcggcgtcatcgtctacaaccgcgccaatgcccagctcaacgagcagacgctggccggcctgtgcgagcgctgcccgaacctcgtcggcttcaaggacggcgtcggcgacgtcgagctgatgacccgggtctacgccgctctgggcgaccgcctgacctatgtcggcggcctgcccaccgccgagaccttcgcgctgccgtacctggagatgggcgtcaccacctactcctcggcgatcttcaacttcctgcccgaatgggcgctgtccttctacgacagcgtccgccgccgggaccgcgacgcggtttaccgggagctgcgcgacttcgtcctcccctacatcgcgatccgcaaccgcaagcgcggctacgcggtctcgatcgtcaaggccggcatgagcgccgtcggccgccacgccggcccggtccggccgccgctgaccgagctcgacgcggccgagcgcgccgagctgacggccctgatcggcgaccgccgctga

SEQ ID NO: 5764 - DNA, 1080 bp, Methylobacterium sp.
atgagcgtcgccaacctgttccccgccgagcgccaggacgcgaagaccgtcgaccggatcacgatccggcggccggacgactggcacatccacctgcgcgacggcgcgatgctgaaggcggtgctgccctacacggcggcgcagttcgcccggggcatcatcatgccgaacctcgtgccgccggtgaccacggtcgccgcggcgcaggcctaccgggagcgcatcctcgccgcgctgccggccggcatggacttcacgccgctgatgacctgctacctgcgggacgacaccgatccggacgagatcgagcgcggatttcgggagaaggtctggatcgccgccaagctctacccggcgggcgccaccacgaactcgcacgcgggcgtcacggacctcgtcgggatcacccccgtgctggagcgcatggagcggatcggcatgccgctgctgatccacggcgaggcgaccgacccggagatcgacatcttcgaccgcgaggccgccttcatggaggggagcctggtcccgctgctcgctcgccaccaggggctgaaggtcaccgtggagcatgccaccacggcggaaatcctcgacgtggtccgggagcaccggagccggtgcgcggcgacgatcacgccgcaccacctcgtgatcaaccggacgcacatcttccagggggggctgcgcccgcacctgtactgcctgccggtggccaagcgcgagcggcaccggctcgccctgcgccgggccgcgacctcgggcgaggcctgcttctacctcggcaccgacaccgcgccgcatgttcgcggcgccaaggaggcatcctgcggctgcgcgggcgtgttctgcggcccgagcgcgctccagacctacgtgcaggtcttcgacgaggagggggcgctggacaagttcgaggccttcgcgtcgctcaacggcgcccgcttccacgggctggagcccaatgccgggactgtcactctcgagcgtcgggagagtcgcatcgccgaggccgtcgcggtcgacgatacggcagtcgtcgtttttcggggtgaggagaccttgccctggtcggtggtgtga

SEQ ID NO: 5765 - DNA, 864 bp, Methylobacterium sp.
atgctcgacgatcacgcccacgaggcggccgtcgccctcgacctgccgaacgacgatgccggccgcaggcggacctcgatctaccagcccgagcaggccggcctgatcttcccggagatcccggacttcgccgaccacgccgaggagcgggactaccgcaagaagcacctcgtcgccgcctgccgcgccttcgcgatgcacggcttcgactacggcttcgccggccacctgacgatccgcgacccggagcgtccggagctgtactggaccaacccgatgtgcgtgcacttctcgcaggtgcggatgtcgaacctgatcctggccgaccacaagggccgggtggtcgaggggcgccacgccatcaaccgcgcgggcttcgtcctccacgccgccgtgcacgaggagtacccggaggtcatggcgatgtgccacgcgcacaccacctacggcaccgcgtggtgcgccaccggccggccgctggagatgatcagccaggacgcggcggccttctacaacagccacgccgtgatcggcgcctcggcgggcgccgtggcggtggagaaggagagcggcctgtcggtcgcccagcagatcggccgcaaccgcggcgtgctgcaccagaaccacggcctgctgacctgctcgcagcacagcatcgacgacgcggccttctggttcatcgccctggagcgggcctgccagcagcaactcctggtcgaggcctccggcatcaagccgcagctcctctcggagaagaccgcccgctacagccgcgagcacgtcggcagcgactacatcggctggctgcacttccagacgctgtacaaccacatcgccgagacccagcccgacatgttcgcctga

SEQ ID NO: 5766 - DNA, 909 bp, Methylobacterium sp.
atgcgccggatcccgagcttctccgccctgcgggccttcgaggcggccgcgcgcctgggcagcttcgcccgcgccagcgaggagctgcacctcacgccctcggcggtgagccaccagatccgggcgctggagcgctggttcgggcgcgccctgttccggagggcgaaccgccaggcgctcctcaccgccgacggccagcgcctgctggccgggctctcgagcgccttcgacgctatcgaggctgtctgcgccgacctcagcccgccgtcgcccacgtcgctggccgtgcactgcacgccgagcttcgcggcgaagtggctcgggccgcggctccccgccttcgtggaggcgcatcccgccatcgccatccgcctctccaccagcgccgaccgggtggatctcgggcggcacgaggagatcgacatcctgatcgcctacggccggccgccgcacgggcccggcctgaccgtcgagtccctcggtccggaggagatcgccgccctctgcgcgccggaggtcgcccgggccgcgcagccggacgcggccggatcgatcgggcccttcacccggctcgactcgtccttcagccccgtccgctggccggactggttcactcataacggcctacccttgccgaccggggcagccggcgcggctttcgaccggggctcgctggtgatctcggcggccgtccaggggctcggcgtcgcgctggagaccctgcggttcgcccaagacgagctcgccgccgggcatctggtgcgcctcggcggcgatcgggtcgcgagcctggcccgcgacctccacttcatctgctaccgcgagcgcgacggggccctggagaagatccgggccttccggcactggctcctcgacgtggaggcgcggagccgggccgaggtggcctga

SEQ ID NO: 5767 - DNA, 168 bp, Methylobacterium sp.
atggccgaggcggatccgcgcaaacccggggacgaggccccgcccggcacgccgggcaccggcgagaacctgtgccggacctgcgggggcaccggcaaggtcgccgacgcgcagtgctccgaatgccggggcagcggcacggtgacgaccggcatcggcggcgcctga

SEQ ID NO: 5768 - DNA, 225 bp, Methylobacterium sp.
gtggggctcgccgccttcgtcttcttcgtcgtcccttggatggccgtcgcgatctggatgtcgatgcggccgtccggcgcgcgcctcggcactccgtccgccccctggcgcccgctgacggattacccgccgccggcccgggaccagcggcaggccggcgagacgcgaagcatggagtcgggctccgcccacgacggcaagcacgcgccgatcgaggccgtctag

SEQ ID NO: 5769 - DNA, 369 bp, Methylobacterium sp.
gtggtcgagcgccgccgcactgcccgacgccgcgtctgcctgggcgggcggctacgcgtcgcggccttcctgccggagatcgactgcacggtccgcgacgtgtccctcgacggggcgcggatccgactgccggcggaggccgtgctccccgactgcgtcgagctgttcatcccctgtcgcggcgaggcccggcgcgccttcgtggcctggcgcgcgggcgaggcggtcggcctcggcttcgccgagacccgcgcggcgacggagcccgaggcggtcgcgcgccggctcgccgccagcgaggcggaggtggcgcgtctgcgcgccgcgctcctcgacggaaacagcccggagccgggtcgcgttcactga

SEQ ID NO: 5770 - DNA, 996 bp, Methylobacterium sp.
gtggccaacttcttccggcggaaacccgcggctccggccgcggacaagaccccgaaacccgccgaggccccgaagccccgccgccgggatttcagcgagctcaagcccgatcccgacaagatcgggatctcgggctcggtcccgttcgtgcgcctgccggatcctgcgacgctgttcgccgaccgggccgcacgcctgacggaggccgcgcccgggcacccgctggaggcctatctccggttcgtcggtgaggtcgcccgcgcccaggcggcgatccaggcacggtttccggccccggcggcgccggatcccgccgatcaggcgctgcggagtgagcacggcatgccgccgctgtcgcggcacagcctcgaggccgaccaggatttcgacgcgtgcctcctggcgctgctcgacgcgctggatctcgcgaccgcgcccgaggcctcggccgcggcgcgggatgccctgcgggccgccgcgccggaggagcgccgcgatctcgccgtgcaggttttcgagggcgcgctgccggtcgaccggatcgccgaatgcctgttcgtctcggccgcgctgcaggtgcgcttcgccgagcgggccgcgtgcctcgacacgaggacgctgaagcccgtcgcggacggcgtctgcccgtgctgcggcggcgcgccggtggcgagcgtcatcgtctcttggaccccggccgacaaggcccggtatctcagctgctcggtctgcggcacgtactggaaccacgtccggatccgctgcaccgcctgcggcgacggcgagggcgtcagctattacgggctcgacgaggtctcgaaggacgtccaggtcgagacctgcacgacctgccacagctacatcaagcacctccaccagcaccgggcgccggccctcgacccggtggcggacgacatcgcgtcctacgggctcgacctgaagatcgccgaggacgggttccggcgcgccggactgaacctgctgttcgtgatctag

SEQ ID NO: 5771 - DNA, 933 bp, Methylobacterium sp.
atggctgactacagctccctcgacatccgccagcgctccgcctccacggagacgccgccggagatccgccgtcaggtggaggtcgccaaactcatcgacgtgtcgaagtgcatcggctgcaaggcctgccagtcggcctgcgaggagtggaacgacctgcgcgacgacatcggtgtcaacacgggcacctaccagaacccccacgacctcacgccgaagtcgtggacgctgatgcggttcaccgagtacgacaacccggagaccaacaacctcgaatggctgatccgcaaggacggctgcatgcactgcaccgagccgggctgcctgaaggcctgcccgtcccccggcgcgatcgtgcagtactccaacggcatcgtcgacttcatcgaggagaactgcatcggctgcggctactgcgtgaagggctgccccttcaacatcccgcgcatcagccagaccgaccacaaggcgtacaagtgcaccctgtgctcggaccgggtggcggtggggcaggccccggcctgcgccaaggcctgcccaaccggctcgatcatgttcggcaccaagcaggccatgatcgatcaggcccacgaccgcgtcgaggacctgaagtcgcgcggcttcgcccatgccggcctctacgacccggccggggtcggcggtacgcacgtcatgtacgtgctgcaccacgccgaccagccgaacctctacgcgggcctgccgaacgacccgaagatctcgccgctggtcgccttctggaagggcggcgccaaggtgttcgggctcgccgcgatgggcttcgcggcggtggcgggcttcttccactacgtcacggccggccccaacgaggtcgtgcccgaggaggaggaagaggcggtcgagtacgacgaggccaagcgccgggagaatggcggcgaggcccggccgcactga

SEQ ID NO: 5772 - DNA, 2421 bp, Methylobacterium sp.
atggacatcaagcacgcggacgtgatcaccgtgatgggcggcaatgccgccgaggcgcacccctgcggcttcaagtgggtcgtggaggcgaaagcccataacaatgccaagctgatcgtcgtcgatccgcgcttcacccgcacggcgtcggtggccgatctctactgcccgatccggcaggggaccgacatcgcgttcctgtcgggcgtggccaagtacctgctcgacaacgacaagctgcagcaccgctacgtctccgcctacaccaacgccgggtacgtggtccgcgagggctacgacttcagcgagggtctgttcacgggctacgacgcggacaagcgcgactacgacaagaccacctgggactacgagatcggccccgacggctacgccgtggtcgacgagacgatgcagcacccgcgctgcgtgatgcagctcctcaagaagcatctcgcgatctacacgcccgagatggtcgagaagatctgcggctcgcccaaggagaccttcctgaaggtctgcgagctgatggcgacgacggcttcccccgagaagtcgatggcctcgctctacgcgctcggctggacccatcactccaagggctcgcagaacatccgctcgatgtgcatcgtgcagacgctgctcgggaacatcggcgtgctcggcggcggcatgcaggcgctgcgcggccactccaacatccaggggctgaccgatatcgggctgatgtcgaacctcatccccgggtacctgaacatcccggtggagaaggagcccgactacgcgagctacatcgccaagcggcagttcaagccgctgcgtcccggacagacgagctactggcagaactacaacaagttcttcgtctcgttccagaaggcgatgtggggtgacaaggccacgaaggagaacgactgggcgtacgactacctgcccaagctcgacgtgccgacctacgacgtcatgcgcgggttcgagctcgccaagcagggcaagatgaccggctacgtcatccagggcttcaaccccctgctgtcgttcccgaatcgcgccaagatgacggaagccttctccaagatgaagttcatcgtggtgatggatccgctcaagaccgagacggcccgcttctgggagaaccacggcgagtacaacgacgtcgatccgaccaagatccagaccgaggtgttcgaactcccgaccaccctgttcgtggaggaggaaggctcgctgtcgaactccagccggtggctgcagtggcactggcaggcgcaggaggcgccgggcgagtgccgctcggacatcgagatcatgtcggagatcttcctccgcatgaaggcggcctacaagaaggatggtggggccttcccggacccgatcgtcaatctgaagtgggactacgcgatcgccgaggcgccgaccccgaccgagctcgcccgcgagctgaacggctacacgctggcgccgacgccggacctgaacgggaccgtcatcccggcgggcaagcaggtcgacggcttcgcccagctcaaggacgacgggacgaccgcctgcggctgctggatctactcgggctgctacaccgagaagggcaacatgatggcccgccgggacaacaccgatcccggcgatcgcggcatcgcgccgaactgggccttcgcgtggccggccaaccggcgcgtgctctacaaccgcgcctcgtgcgaccccgagggtcgcccgtggtcggagaagaagaagctcatcgagtggaacggcaagcagtggatcggcttcgacgtgccggattacggcgtcaccgtcgcccccgataagggcgtcggcccgttcatcctgaaccaggagggcgtcgcccgcctgtggacccggggtctcatgcgcgacgggccgttcccgacgcactacgagcccttcgagtcgccggtggccaacctcgccttcccgaagatcaagggcgcgcccgcgtcccgcatcttcaaggacgacctcgccgatctcggcgacgcgaaggagtttccctacgcggcgacgagctaccgcctgaccgagcacttccacggttggaccaagcacgcccggatcaacgcgatcctccagccggaggccttcgtggagatctcggaggagctcgccaaggagaagggcatcgccaagggcggctgggtccgcgtctggtcgaagcgcggctccctgaaggccaaggcggtggtgacgaagcggatcaagccgctgatctgcgacggcaagcccgtccacgtcgtcggcatcccgcagcactggggcttcatgggccacaccaagaaaggatggcacccgaactcgctgacgcccgtcgtcggcgacgcgaacaccgagacgccggagttcaaggcctggctcgtgaacatcgagccgaccacgcctccgtcggacgcggtcgcgtaa

SEQ ID NO: 5773 - DNA, 591 bp, Methylobacterium sp.
atgacggtccaggtctcaaggcgtggcctgctcaagggggccggtgccggcctcgctggaggctcgctgggcgcgctcggattcggcggcctcgagcccgccatggccgccgcggtgcggccgtacaagctcgcgcagatgcgcgagacccgcaacacctgcccgtactgctcggtcgcgtgcggcgtcatcctctacagcctcggcgaccgttcgaagaacgcgcgctcctcggtgatgcatatcgagggggatccggatcacccggtcaaccgcggcacgctctgcccgaagggcgcggcgctgctcgacttcgtgcacgccgagacgcgcaccaagtacccgctccaccgcgccccgggttcctccgagttcaagcgcgtgtcctgggacttcgccctcgaccgcatcgcgcagctcatgaaggaggaccgggacaagaacttcgtggccaagaacggcgacctcacggtcaaccgctggaccacgatgggctttctcggggcctcggccaccaccaacgagacggcctggctgacctacaagacagtccgaagcatgggggccctggtcttcgataatcaggccagg

SEQ ID NO: 5774 - DNA, 342 bp, Methylobacterium sp.
gtgtcccgctcgattcccctgatgatgtcggtgctcctcggtctcgcgacggcggcgtcgccctgtctcgcgcagacgaaaccgggcgagatcaagggcgtcgacgcgatgggcgacaagtcccgcagcgcgcaggacggctggagccaagccccggtgccgcgggagcagtcggccgccaaggacgcgccggatccgggcggcaactcgatcaaggagaatgccgaccgtcccgtgccgccggcccagcccggcggcacctccgccaccgagccgcaggcgccgctggagcaccgcacggccggcccgtcaggcgccaatccggccaatcccagcaagtaa

SEQ ID NO: 5775 - DNA, 156 bp, Methylobacterium sp.
atgtccctcgtcaccatcctgctcatcatcctgatcatcctggccttcggcggcggcggcttcctcggcggcggcgcgtatcgcggccccggcttcggcctgggcggcatcctgctcatcgtgctgatcgtgctcctggtcaccgggcggctctga

SEQ ID NO: 5776 - DNA, 786 bp, Methylobacterium sp.
atgcgccgcgcgccgcccgccgccctcctcgtcgcggccctctcggccgtcgcggccctgtcgtccgccgcggcaccggccgcagccgcgccggacccgagccgcgacgtgctgtgggccgccctgaagacctgcgtcctcgccaagcggctcgccaaccggaccttcccgtgcctgtcggtcgatctcggggacggtgaccgtcccggctcggcggtcctgcgcgcgcccggcgagccgacgcacagcgtcgtcatgcccaccgacaccgtgccgggcctggaggcgccggtcctgcgggggccgcgcggggccgcctactggcgggcggccctggcggcgcggccgctcgtgtcggacgtgctgaaggggaggctcacccccgcggaagtcgggctggcggtcaactcggcccggggccgcagccaggaccagctccacatccacctcgactgcctgaggccgagcgtgctcaaggcgatccgggcgcacggccggcaggtgcgccacacctggaaccgcttcccggtgccgctggccggcgaccgctactacgccctgcgcgtgccggaggcggaggccgcgcagttcaacccgttcgcggcgctgcacaccctgccgggcgcccggccggacctgcaccggacgagcttcgcggcgctcgccacgcccccgggcgatcccgagccgggctacatcctgctggcctaccgggcgccgagcgccagcgccgaggacgtgatggaccacagctgcaggctcgcggcgtcccgcagcggcgcctga

SEQ ID NO: 5777 - DNA, 1740 bp, Methylobacterium sp.
atgaaccgcgccgacgctccgcagggctacgatgccgacgtgatcgtcgtgggtgccgggcccatcggcctgacgacgggcaacgccctgcgccaccatggcgtgtcgtgcctgatcctcgaagagcggaccgacgtgaaggcctactcgcgcgccaacaacctctgggcgcgaccacaggaactgctcgccggaatcggcctgcgcgacctgctggccgagaacagctacgcgatccacaccatcaatttcttcgtcaacggcacgccgacgacgcccatccccatcgccgacgtcgcgagcccctacccgaaggtgctctacagcggccaggacgtcatcgaacggaccctggccggcgagttcgcgtcgcggggcgggaagctcgaccggggttgcacggtgaccggcgtcgaacaggacgacgagagcgtcacagtggtactccggcggggcaaggacgggccggaggagcgccgccgctgtcggtatctcgtggcagccgacggcgccaagagcactattcgaccgatgctgggcctggatttcgagcccgaacgcttgccgaactgcatgaaccggcaggtcgacgccaagctgtcatggcgccgttcaatggagcccgaccagctctggttcttctactacgagcggggctttgccggcatcctgccggtctggggcggctaccaccggttgttcttcctggccgacgacgcgggcgtcccagaccgagatccgacgcttgatgagatgcaggcggtggcgcgagaggtgacgggtgacgagaccctgaccctgagcgacccgcagtggttgacgcacagccgcttccagtacggcgtctcgcctgagtacgtgcgcggccgcgtgttcctggcgggcgatgccgggcacctgtccctgcccatcggcggccagggcatgaacgcgggcctgcacgactcggtcgagatcgcgtggcggttggcgatgaccctgcggggcgaggcgggtccggttgtcctcgcctcctatgacggcgagcgcggcggcgagcacgcccggctgagcgcgcagcaggcccgggggttccggtggaccgtctaccgcggggcggtcaccgacacggtactggggttggccgcgaaggctctgccgaacctgggttcgctgctgcagggtaccgacgacatgcaacagatgggcgtcgagtacccgaagagcctcctgaacgaggaccgcctctccggcctagcgaccttgctacggtcggggccgaagccgggccagcgtgcaccggacgcggaggtgacgcataacggcgaggcgacgagcctgtttccattcctctgcaacccggatgggcacaccaccggctgggcgctgctgtgcttcgacggtcggtcctcggacgcgggggaatcgctgctcgacatcatcgaggccgtcgcgccttggccctgggtgcggccgcgcctcgtgctggctggtccgatggtcgatagcaggagcgtccccgtcctgtcggacatggacgggaaggctcacggagcgtacgggctggagggtcggccggcgttggtgctcgttcggccggacggccatatcgccttccgcagcgatgccgatcgagccgattgcctggtggcctattgccggaaggttttcggctccgcgcgcgaagctcccgaggctgacgcgcggcgaatggagccgaggctcatgaccgaagaatgtcgtggtcgccagctagactaa

SEQ ID NO: 5778 - DNA, 2505 bp, Methylobacterium sp.
ttgacgagtctcggtccgattacctcgctcatcgagagtgccgtcgacgtcggtgcggcggacgagggcggatcaccgcttcccggcgcgctggccgataccgcgaaccagatcgtcctcgacacccatgcgcagctcgagaacgcgggtcatcaggtcgcggcgctgaacggcccgctccacggtctgaccaatctcggcgagacggtcgggctcggtcatatcggcgaggccggcaacctgatcacggacctgaccggcgccgtcgccaacccgaccgatgccggcagcgtcgtcccggtgctgaacgatgccgggcaggtcgccgcggctgccggaaccttgctgaataccgtcacggccctgcccgtggcgggcaacggccttgtcggctccggcggtacgctcgcgccggcggtggggattctcaaccaagccgtcctcgacctgcacacgacgctggaggatgtcggccaccaggtcccggtgctcaacgcgccgatccacggcctcaccggcctcggcgagacggtcggcctcggtcacatcggcgcggtcggcaacctcctgacggacacgctcgccgtgccgggttcgctcctcaccggcggcggcctcgcctcggccacgccggtcctcgcggatctcggttccgtcctcgaagcgaccgacacgctgatcacctccgtcaccggggccgcgacggccggcgggctgctcgcgtcgggcggccttctcgccccggtcgcgaatctcgcgaacaccgccgtcctcgacgtccacatgaccctcgagaacctcgggcacgagatcccgctgctgaacggcgctgtccacggcctgaccaatctcggcgagaccctcggactcggccatctgggcgagggcggaaacctgctgaccgacgccgcggccctgcccggtgccctgctgggcggccaggggctcggcgcattgtccccgattctcggcgacgtcggcgcggtggccggcgcggccggcggattgctcggcggcgtcaccggcatcgtcggcgacctggggggagcgggcgcgccggacgcgggcagtctcctcacccccgtcaccgccgcggtggatggcctgctcggcaccgtgaccggcggcgcaccggacggaaccggcatcctgctcgggccggacgcgccgctgcagccggtgggcgctgtcgccaacacgctgatcgacaccgtccacggggcgctggagcaggtcggacacgacgtgccgctcctcaacgacccgctccacgcggtgatcgcgctgggcaacacggtcggactgggggaactcggcgacagccacaacctgctcaccgacaccatcaacctgcccggcgcgatcctgaccgggaacgcgcccggaggcgtggcgcaggtcgtcgacgacctcgggcacgtggcgggcgcgctgggcggcgtcgtcggctcggcggccggcctcctcgactcggctggcggcggtctcggatccggcctgccgggcggcggtctcctggcaccggtcacctctgccctcggcggcctgacgggggaccagggtgccggagccctcgacggtctcctgggcggcctgaacggaggcccgggttccggcgcggccggtgcgctgctcgggacgaacgcgccgctgcagccggtcggagacgtcgccaatacgctgatcgacggcgtccacgcggccctggaacaggtcggccacgatgtgccggccctgaacgacccgctccacgccgtgatcaacctcggaaccacggtcggcctgggggaactcggcgagtcgagcaacctcgtgaccgatgtcgtcaacctgccgggggcggtcctgaacggcgacggaggccccgcggtgacgcaggtcgcgagcgatctcgggtccgtgacggaggcggccggcggcgtcgtggcctcggtggcggggatccttcccgcggccggcggtgacggccaccaagcgggctccccggtcgacggcgtcgtcgcgaccgtgaccacggtcctgggcgggggcgagaccggcggggcggggagcgccgtcggcaacctgctcggcacgctcaccggcggcacgtcgggcgagccgggagccgagacccacccgttgatcgacgtgtcggcgggcccgacgaccccgacgccggtggcggacgtcgccgtgctcacgcccgccgccgatccggcccacaccgtcgacgtgagcgcggtcgcggtgagcgccgatcagccgagtctggccacggcgaacctgctcagcggcgacagcatccacctgccgcagacgggcggcggtgccgactccctcgtcggccacctcgtgaacgcggtgtcggggacctccgccgcgccggccgaggcgggcgccgcccaaggcgtgagcgtcgatctcggcgtcgccacgatcgatctcggcggccacaccgaggtccagcacacggacccgactccccacacggccacgagcggcctgcacctgctcggcctgtga

SEQ ID NO: 5779 - DNA, 1179 bp, Methylobacterium sp.
gtgccgatcgtgctgcagcttcccggatccctccgtctcctcgccctggcagccgtcgcgggactcgccgccggttgccgcgatgcgaaccagtacgttcccccaccgccgccgacggtctcggtcgcgcaaccgctcgtgcgcacggtcacgcgctacttcgagctcaccggcaacaccaaggcattcgcggccgtcgagctcgaggcgcgggtccagggcttcctggaggcgatcacctacaaggacggcgccgtcgtgaagaagggcacgccgctcttctccatccagcgcaacacctacgaggcgcagctcaagcaggcgcagggcgccctggcggcgcagcaggccgccctggcgaatgcccagtccgagtatcagcgccagtccacgctgggccggcaggaattcgcctcgcaggcgcgcgtcgaggacgcgaagaccaagcaggaccaagccagcgccgccgtgatggaggcgcaggccaacctcgacatcgccgccatcaatctcggctacacgcaggtctccgcaccgttcgacggcgtggtcaccaaccacctcgcggatgtcggggcgctcgtcgggatcagcggaccgaccaagctggcgcagctcgtacgcatcgatccgctctacgtctacttcaacatcagcgagcagcaggtgctgctggtcaaggagcacctgctcgccacgcaccggacgctgggcgacctatccaagatcccggtggggatcggccttcagaccgagaccggctatccgcatgccggcaagctcgactacctcgcgccgcaggtcgacccgtccaccggcacgctgatggcccgggcgctcatcgagaacggcgaccacgcgctcctcccgggcctgttcgtgcgggtgcgggtcccggtcgggcgccaggacaaggccctgctggtgcgcgacgacgccatcgggacgaaccagcagggcagctacgtgctcacggtcggcgccgacgacacggtctcgcagcgggtggtgacgctcgggccccgggacgggcgctaccgggtgatcgagaccggactcgcacccggcgactgggtcgtcacggacggcatccagcgggcgatccccggggcgaaggtcgcgccccagaaggtggcggtggccgaagcctcgcccgacccggcgccactcccgcggtga

SEQ ID NO: 5780 - DNA, 915 bp, Methylobacterium sp.
atgcgcgctgtgttcgtggatgccagcgagaccctggcggcggtggcccggcggctgctgcggccggacgatccgcccttcgcgatccacgcggatcccggaatcgcgccggaggatctgcccgcgatcctcgacggcgccgagaccgcggtgatcgaccacaccgccctccccctcgacgtggcccgggcctgcgcgggcctgaagcacgtcgtgttcctcggcaccggcgcccgcagctacatggaccccgaggcgctccgggacgccctcggcgtcaccgtccacaccatcaagggctacggcgacacggcggtcgccgagtgcgccttcgcgctgatgtgggccgccgcccgcggcctgcccgagatggaccgggcgatgcgcgccggatcctggctgcgcacggaggggatccagctcaccggcaagaccgtcggcctcgtcgggttcggcgggatcgcggccgagatggcgcgcctctgccggggcgtgggaatgcgggtgctcgcctggaaccggaccccgaagacccatcccggcgtcgacttcgtcccgctcgaccgcctgctcgccgagagcgacgtggtctcgctccacctgctcctgaccgacgcgacgcgtggcttcctgtcggccgcgcggatcgccgccatgaagcccggcgcgatgctgatcaacactgcccgcggagcggtgctcgacgaggacgccctggtcgcggccctgcgcaccggccacgtggcgcgggccgggctcgacgtgttcaccgtcgagcccctgccggcggatcacccgctggcgcacctgcccagcgtcaccctgtcggcgcactcggcgttccggacgcccgaggcgagcgacaacctgatcggcgccgccctcgaccattgccggcggatcgcctccggctga

SEQ ID NO: 5781 - DNA, 1353 bp, Methylobacterium sp.
  modified_base (938)..(963): a, c, t, g, unknown or other
atgacccacatcgccgtgatcggcgccggcatcaccggcgtgacgaccgcctacgcgctcgcccagcgcggctaccgcgtcaccgtcctcgaccggcagcgctacgccgccatggagacctccttcgccaacggcggccagctctcggcctgcaacgccgaggtctggaacaagctctccacggtgatgcagggcctgcgctggatgctgcgccgggacgcgccgctgctgatgaatcccaagccctcctggcacaaactgtcctggatggccgagttcgtccgcgagatcgcccattaccgcgccaacacggtcgagaccgtgcggctggcgctgaaggcccgggaggccctgttcgccatggccgaggccgaggggatcgacttcgacctgaagacccgcggcatcctgcacttctaccgggaccgggcgagcttcgagaaggcgaccgtcgtcaacgccctgctgcgggagggcggcctggagcgctacgccgtgacccccgaggagatccgggcgatcgagccgaccctggccggccgctaccacggcggcttcttcacaccctcggacgccaccggcgacatccacaaattcacccgcggcctcgcggccgcctgcgcccgcaagggcgtccgcttcgttcaggacgccagcgtcgagacgatcgcgcccggggaggggggctacgccatcggctggcgcgaagcgggccggccggccggcgacgcgcgggtcctgcgggccgacgcggtggtgatctgcgcgggctgcgccagccggcacttcgcggcgatgctgggcgaccgggtcaacgtctacccggtgaagggctactcgatcaccgtgaacctgctgaccccggaggcgcaggcggcggccccggaggtgagcatcctcgacgaggcggccaagatcgtcaccagccgcctcggcgnnnnnnnnnnnnnnnnnnnnnnnnnncctcggcgacgagcgcctgcgggtcgccggcaccgccgagttcaacggcttcaaccgcgacatccgccacgaccggatcgagccgctggtcgactggacccgcgagcagttcccgcgcgtcgacaccgaccgggtggtggcctggagcgggctgcgaccgatgctgccgaccatgctgcccaaggtcggccgcggccgactgcccggaatcttctacaacaccgggcacggccatctcggatggaccctctcgggcgccaccgccgagctcgtcgccggggcggtcgccgccgagcacgccccggagccgacgatcctgccgctcgcggcctgacccgggtccccgaagggcccgaggcccttcggcaggctgtcacggcggagccctga

SEQ ID NO: 5782 - DNA, 1269 bp, Methylobacterium sp.
atggcggaccgggacagttcagccacggacggaaccgtcccgcccgcccgcggcggccgccggtggctcgccctgctggcgctggcgggcctcggcgtcctcggataccgcctgtggccggacgcgtcgcgcgcggcgagtccggtcgccgccgaggcgaagccgccgaccgtgcgggtcgccgccgcggcccgggcctccgacaccctgagcctgacccagacgggcaccacccaggcgttcgacatcgcgaacctctacccgcgggcgaccggctacatcgtcgagcgcaaggtcgatatcggctcgcacgtgaaggcgggcgacctgctgttccggatcagcgcgcccgacctcgaccagcagctggtccaggcccagtcgcaggtgctgcagctccaggcggcgctgatccaggcgcgggcgatggtggaccaagccgaggccaaccgccacctcgccgacgtgaccaaccggcggacctcgacgctcgccggcaccggggtcgagacccggcagaacgccgacacctcccaggccggggtgctggcgcagaccgccaacgtcgacgccgccagggccgccgtgaaggtcgcggaggccaacatcgccgcccaggaggcgcaggtcgcccggctcaaggtcctgaccggcttcgaggagatccgcgcgcccttcgacggggtggtgacggcccgcaacaacgacgtcggcgacgcggtcacggcggacacgaatacgggggcgccgctcctcacgctgaaccgggacgacgtgctgcgcatggcggtgaacgtgccgctctacgccgccgacggcgtccgcgacgggctggccgccacggtcgaggtggcgcagatcccgggccggaccttccccggcacggtctcgcgctcgtcgacgacgctgctctcggccgcgcgcacgctggtcacgcaggtcgacatccccaaccccgacggggcgctgcggccgggcctctacatcacgatcacgctggagatcccgcgggtctcgcccgccgtgacggtgccgaacgacgcgctgatcttcgaccagcacgggacccgcgtggccgtggtcgaggcggccggggacggggggggcgtggtgcggatgcgccccgtcacgatcttccgccagacccgcacgctcctggagctgcgcgacggtctgaacggcggcgagcgcgtcgtcgtgggcccgccggcctcgctgcgcgacggcgacagggtcaccctgcgtccggaggaccgggcaggggcgtga

SEQ ID NO: 5783 - DNA, 1155 bp, Methylobacterium sp.
atgcgcatcgaggcggagaccgtggagcggatggtcgcgtggcggcgcgacctgcacgcccatcccgagctggccttccaggaggtccgcacggcggatctcgtcgcccgggaactggccgcctgcggcctgtcggtgaagaccgggctcgggcgcaccggcgtggtcgggaccctgagccggggcgacggcccgaccatcggcctgcgcgccgacatggacgccctgccgatccaggaggcgacgggcgccagctacgcgtcccggacgcccggcgtgatgcatgcctgcggccatgacggccacgtggcgatgctgctcggcgcggcccggcacctcgcgtcgcgcaccgacctctccggcacggtgcacttcatcttccagccggcggaggaatgcgagggcggcgggcgcgccatggtcgaggacggcctgttccggcttttcccgtgcgattccgtctacggcctgcacaactggccgggtttgccgctggggaccttcgcgacccgggtcggcgccatcatggcctccctcgacacgttcgagatcgcggtcgccgggttcggcacccacgcggccatgccggagcgcggcaccgacacgctggtggtcgcctccgagatcgtcctagccctgcagaccatcgtgagccgccggatcgcccccacggacccggtcgtcctcagcgtcacgcagatccacggcggcgacgcctacaacgtcatccccgagcgcgctttcatccgcggcacggtccgctgcctggacgaggccgtgcgcaagcgcgtggccgaactcgtcgcggcgatcgcgggcgggacggccgccacgcacggcgcccgcgcggaggtggactaccggttcggataccccgccaccgtcaacaccgccgacgccgtcggcaccgccctggaggcggccggggccgtgccggacatcaccgcgcgccggggcgaggtcggaccctccatggcgtcggaggatttcgcctacatgctcgaggcctgccccggcgcctacgcgtggatcgggaccgacgggacgcgcaagagcctgccgctccacaatccgggctacgacttcaacgacgaggctctgccggtcggtgccgcctactgggccgcgctgggggcgcacagcctcaggccgtga

SEQ ID NO: 5784 - DNA, 231 bp, Methylobacterium sp.
atgcccggcgagacaccgcacggcccgcacctcccggaggcgctgacgcggctcctcaaggcaccccgggcggcgatctggccgacaccggaggaccggaaccgcctgcgccccggccggtcgcgaccgcggcagccgagccgcgccgtcctgggtgtctggatctgggcgatcctctacaacgttctcggcttcgcgatcctcgcggccctgtggtggacgatgcgctga

SEQ ID NO: 5785 - DNA, 387 bp, Methylobacterium sp.
atgaccacgatcagcgcgaaggacctagtggcgcaggccaaccgggaggtggagaccctgtcggccgaggaggcgctggcgcgcctgggccagccgggcacggtgctcgtcgacgtgcgcgagggcgaggagttggccaaggccggcaggatcgccggggccgtccacgtgccccgcggcttcctggagttccaggccgatcccgcgagcccgacccaccgggccgagctcggcgggggcaagcgcctagtgctctactgcggctccggcaaccgctcggccctggccgccaagtcgctcaacgacatgggcctcggaccggtcgcccatgtcgcaggcggcttcactgcgctggcgaaggccggagcgaccgtcgcgccagcctga

SEQ ID NO: 5786 - DNA, 657 bp, Methylobacterium sp.
gtgccgcgctcgcgcggggcgggcgaggccgaccgggtggccgccatcctcgcgcgcctcgccgagcgggatccggatccgaaggccggattcgaccgcaccgacccgttccgcctgctcgtgaccgtgctgctctcggcccagtccaccggcccgaccgtctcgcggatcgcggacgcgctgttcgccgaggcccgcgatcccgccgccatggcggccctgggggaggcccggatcaccgagatcgtccggccggtcgggctcgggccctccaaggcgcgcaacatcgtcaggctgtcggcggtcctgctcgcggagcacggcggcgccgtcccgcgcagcgccgcggagatgcgccgcctgccggggatcggccgcaagagcgccgaggtcacggcgaacttcgccttccacgagccggtgatcgcggtcgacacccacatcttccggatcgcgaaccggatccccctcgccccgggcgcgacggtcgacgcggtggccgacggcctcgcccggatcgtgccggacgcgttcaaggacaacgcccatgtctggctgttccggcacgggcgcgacatctgcacggccaggaagcccgcctgcccccggtgcccggtctcggacctgtgcgcgtggccgggcaaggcgacggcctag

SEQ ID NO: 5787 - DNA, 225 bp, Methylobacterium sp.
atgtcgttcgcgctggtgcccgtcgccgaggcggccctgttcacgttcgggtgcctggtgatccacgccctgcggcgccacgccgacgtggtcaccgcgacgctcgcgtgcctcgcgacgctcctcgtcctgatgatcggcatcgcctgcgcgccggaatccttcgcgaagtatcaggcggcgagcgtcgccgacttcgcccgcctggatcaggccatctactga

SEQ ID NO: 5788 - DNA, 231 bp, Methylobacterium sp.
atggacgaaccgaaacccaactacgatcacccggcccggtcgatcgccaccgagctggtggtgcgcatcatgctggagatgatggagcgctccgatccggcgctccgcgccgagatcttgcggcaggcgacggcgcgcgccgccgcgatgaccgagcacatgcccaacgcggacttcttccgcggccgggtcgaggcggcgctggcggagatcgtcgggccggacgcctga

SEQ ID NO: 5789 - DNA, 978 bp, Methylobacterium sp.
atggccgccgccttcgtcgcgctggccctgtcgatgttcggcctgttcgacctgcaggcgccgcgctggtggcgggaccgcttcggcgcaccggcggcgcagggaggatcggtcgccggcgcagcgttcctcggcttcagctcggccctcgtcgtcggtccctgcgtgacgccgccccttgccgctgccctgctctacgtcgcccagacggggaacgtcctgcgcggggcgcttgccctcttctccctcgggctagggatgggcgcgccattggtgctggtcggcgcgttcggtgcgggcatcctgccccggtccggcccgtggctggtgcgggcgaagcaggctttcggcttcgttttcttggcgcttgcggcctcgctcgtgacacgcctgctgccggacgggttgtccctcctgctttgggcggcgctcgccatcggcaccggcgtggcgctcgcggtgctgacctcgaacggccgcccgtcccgtgcaggtcgcgcggcgggcttagttgccgtcgcctacggggggctcctcctcctcggcgctgccacgggcgcggacggcccgctgcggcccctcgccggcctcgcgccgtcgcacccgaaccagatcgccgaggcgcggatggtctccacgcttcccgccttcgaggcggccctcctggcggcccgagccgagggcaagccggtgctggtcgaggtcgccgccgactggtgcaccgtctgcaagacgaacgagcggacggtcctggcggacgccggcatccgggagaggctcaaggccgtctcggtcatccgggccgacgtcacgcgcgacgacgacgccacccgcgccctgatgcgccgcttcgaggtggtcggaccgccgaccctcatcctgatgcgcgccgacggcggcgaggtccgggaggcccgcaccgagggcgagctgacggtcgaggacctgaagcgccgtctcgccctcgtcggtgcctga

SEQ ID NO: 5790 - DNA, 654 bp, Methylobacterium sp.
atgaaggccagcgaagcggagcgctccagcggcgccggcgcctacgagcggctgctgcgggcgatcgaggagggcgagctcgcgccgggcagccgtctgcgcgaggcggagctcgccgagcggttccagatcagccgcacgccggtccgcgaggcgctcggccggctggaggcgcagggcctcgtcgcccacgagccgcaccggggcgccagcgtggcgcagctcgactacgggcaggtgagcgagctctacgacctgcgcgaggtgctggaggggacggccgcgcgcctcgcggcgatccacgccagcacggtcgagaccgagatcctggaggagatggtcgcccgggaccggacgctgctcggggacgcgcccgcgctggcacggaccaaccgcctgttccaccggcagatccacggggcggcgcgcaaccgcttcctgcagagcacgctggagacgatgcgcctgtcgctggtgctgctcccgggcgccaccacgctggcggcgcccgaccgcgccgcggaatcgctcgccgagcacgccgcgatcgtggcggcgatccggacccacgacggggatgccgccgaggccgcggcccgggcccatatccgggccgccttcaaggcacggatccggatctggcaggagagctga

SEQ ID NO: 5791 - DNA, 690 bp, Methylobacterium sp.
atggcaaaactgacgacgctcgccctgatgagcctgctggccatcaccaccggtgcgcaggcggcaccgaaggtcgagcgcctgcgcgggaccgtcgaggcggtcgcgggcggcggcttcacgctgaagacacgggacggcgcgtcggagaccgtggcgctcgcccccgacgccaaggtttcctgggtggtcccgtcgagtctcgacgcgatcagggacggggtcttcatcggcacggccacgaagggcgagccgccggtggccctggaggtggtgctgtttcccgaggcgatgcgcggcaccggcgagggacactacgactgggacatgatccccgaccacacggccggcggggcgccggtgcggagcgccatgaccaacggaaccgtgaaggcggacgtgcgctcgaccgcgcccgacgcgccccgcgtgaagagcgcgatgaccaacgggacggtcaaggcgagccgcggcggggcggagcggaccctcacggtcgattacggtcagggccagtcgctgcagatcctggtgcccccgcaggcgccggtcgtcagcttcgagcccgccaacgccgcggccgtggcgcccggcgccaaggtcttcgtgatcgccgcgcgcggggacgatggccgcatcacggcccggcgcgtcgccgtcggaaaggacgggctgacgccgcccatgtaa

SEQ ID NO: 5792 - DNA, 612 bp, Methylobacterium sp.
gtgcgggaacggatcggggtgatcatgagcgcgatcgtcgattttctcacaaagacccgtgacaccttccaggccgctctcgacgattcccgcttccacgcgaccctcgctgagatcgccgatctcgtgaccgtgtccctgcgcggcggcggcaagctcctgacgatcggcaacggcggcagtgccgccgacgcgcagcacatcgcgggcgagttcgtctcgcggctcaattacgaccggccgccggccgcggccgtggcgctgaccaccgacacctcggtgatcaccgcgatcggcaacgattacggctacgagcacgtgttcgagcggcaggttctggccctcgggcggccgggcgatgtcctgctcgcgctctccacgtcggggcggtcgccgagcgtgctgacggcgatggacgcggcacgcggcctgggtctgcgggtcgtcgcgttcacgggcgcgacgggcggggtgatgcccgagcgggcggatctctgcctgcacgcgccgtcggacgccacgcccctgatccaacagatccacatcaccgccgcgcacatcgtctgcggcctcgtcgaggaaagcctgttcccgcgcgggacggcagcgtga

SEQ ID NO: 5793 - DNA, 438 bp, Methylobacterium sp.
atggtgctggtccatacaggcatcgcgcgccgcgcgacgacgacggtggccgcgcagatcgcggtcacccgcgcgcgcgcgatcgacaaggaattgtccgaactctaccgcctcgtcgaggaatgtgtctcgctgctggaagcgggaacgagcggctggctcggccaactcggcgagatgctctccgcctcgtggcgcatcaagcgaaccctgtcgcgtgaggtctcgaacgcggtgctcgacgatctgttcgaagcgatcgtcgggtcgggggcttacggggcgaagctgtgcggtgcgggcggcggcggcttcttcctcgctctcatcgaccccgaccggcttccggctctgatcgagcgggtcgcgccgctgtccgtcgttccgatcggcatcgatgtcgacgggtccaccctgatctatcgccagacgcgctga

SEQ ID NO: 5794 - DNA, 270 bp, Methylobacterium sp.
atgcgcactggacgacgcttctccctcttctcgctcccgatcgatccctggccgcaggcgtccctggccgagcggaccgccgtcgggatggtcctgaccggcctgctgctcgtgccggcctgcgcggtcggggccgcgctcctcgtgttcacgacgctcgcggcccacgtgtactggtcctacgatctcggcgcctccctgcacgcgttcatcgcccggcatgccggggccgccgtcgcgcggcgcggccggctcgtccacaaggcctga

SEQ ID NO: 5795 - DNA, 495 bp, Methylobacterium sp.
atgcgaagccgaatccttctcctgtcgctcgcggccctcggcctcgcgaacgcgccggcctccgcgcaggacgccagcgtgatcggcaaggacacgatcctgccggccacggggccgggaacctcgacggacggcaaggggggcgggcggctgacggaggcggcgagcgccgaggacgccgccaagcgtcaggggctcaagcccgtcaccttcctgaccacgaagatgatcggcgtgacggtgcgcaacgccgccggcgacagcgtcggcaagatcgaggatctgctcatcgccgacggcgtgacgctcaaggccgtcgtgatcgatgtcggcggcttcctcggcctcggcagcaagctcatcgcggtcgagccgggcgccctggtgctgcgtcccggcggtgaccgcttctcggcggtcctcaacatgggcaaggacacggtggcagcggcccagcccttcgatccggccaaggtgatcgcgccgccccgataa

SEQ ID NO: 5796 - DNA, 567 bp, Methylobacterium sp.
atgacggggcagagcggccacgccaccgcatcgcggaccgtctggctggacttaccggagcggtacggccgcgtcagccgcggcttccactgggtgatggcggccctgttcgcctggcaattcactggggcgctgctctacgtcacgatcggcgatgcggcgctgacccgcctcatcgggggcagccacttcaccctcggcttcaccctgttcgtgctcgtgctcctgcgcggggtgtggggcctcgcgaaccttcaccggcgccccgcccatccgggtgcgccggggcgcgcggtcgcggccggtcacggcctgatctatctcctgatggtcctggtcccgagcctcgccctgctgcgccaatacggatcgggcaagcccttcgcgccctacggcatcccggtgatgccggcgcgcgagacgaagatcgagtggatgatgctgcccgccgacctgttccactactggctgggcttcacgctcctcgtcgtcgtgctcggccacgccgcgatggcgttcctgcaccgcaggctctggaacgagaccgtcctgacccgcatgacctga

SEQ ID NO: 5797 - DNA, 1341 bp, Methylobacterium sp.
atggcacgtactgacgtcgacgcggagattctccgattcgaatctgagacgggggagatccggcaggcccctgaaccagttggcctccgagtgactacgctcgtcctcgccgccttcctcacgattggcgtgggactctcggccgtcgcccgggtcgaccgggtcgtgaccagcgatcgtggtcggatcatcccgagccaaggtccgatcctgtttcaggcgctggacgcgtcgatcatcaagagtctcgatgcccgagagggcgagcaggtccacaaggggcagctgctggcgacgcttgatccaacattcgcgtctgccgacgttgaccaggcgagcaagcaactcgcgagtctcgatgcgcagatcgagcgggcgaaggctgaacaggcccatcggtcctacgacccgcacagcagcgacccggaccgcgtcccctacgataaactgcagaaacagctcttcgaccagcgagcctcccagctcaagtcccagctcgccagcttcgacgccaagatcgcgcagacgaaagcgaccatcaagaagctggaaggcgacgaggcgcgctacacggagcgcgaaaagatctccgggcagatcgagggtatgcgtcagcaacttgtcgagaagcaggccggcagccttctcaatctgctgatcgcgagcgactcgcgccttgagatgctgcgcacgatggagaacgggcgcaacgccatggtcgaggcacgccagcagctcagttccctgcaggctgaccgagacgcattcctgcagcaatggctctcgcagagcagccaggatctcgtcaccgcgcagggaacccgcgatacggtcgtcgcccaactcgcgaaggctgcgcgccacaaagatttggtgcagctccatgcgcccgctgatgccgtggtgctgacgcgggccaaagtctcggtcggatccgtcctgcgcgaaggtgacaccctgatgaccttggtcgcgctcgacgcacccattgaggcagagatcaacattgcggcgagccaggtgggctttgtgcgcgcaggcgatccggtcacactgaaagtcgacgctttcaacttcgtggagcacggctttgcggaggggcatctccgttgggttagtgagggctccttcagcttgaatgaagatggtcaaccggttccgccttactacaaggcgcgcgtctcgatcgatcagctcaagttcacgcgagttcctgtcggatttcgcctgatccccggcatgaccctaaccgcggatatccacatcggtgaccgctcggtgctcgcctatgttctaacaggcgcgtcgcgcgggctaagcggggcgatgcgcgaaccgtga

SEQ ID NO: 5798 - DNA, 1686 bp, Methylobacterium sp.
atgtcggaagcgaacacggccccgcgcgtgctgatggtgttcccgaagttctacgaaaactccatgtggaacttcaaagaggccatggagctgcagggcgcccgcgcgcctgcgccgccgctgggcctcatcacgctcgccgcgatgctgccgccggcctggcaggtgacgctcgtcaaccgcaactgcgaagagctgacggacgcgcagatccaggcggccgacctcgtgatgaccggcggcatgctgccccaggagccggactgcctcgtggtcatcgaccgctgcgtggcgctcgggaccccggtctgcgtcggcggcccggccccgacctcgacgccggaggtctacgacaaggccgacttcctggtgctgggcgaggccgagggcatcctcgacaagttcgtggccgcctgggaggccggcgagcgccgcggccggctcacggccgagaagttcaaggccgacgtcaccaagagcccgatcccgcgcttcgacctgctgaccttcagccactacctctacatcggcgtccagttctcgcgcggctgcccgttcacctgcgagttctgcgacatcatcgagctctacggccgcgccccgcggaccaagaccacgccgcagatgctggccgagctcgaccggctctacggcctcggctaccgcggccatgtcgacttcgtcgacgacaacctgatcggcaacaagaaggcgatcaagctgttcctgccgcacctgatccagtggcaggaagaacacggctacccgttcaagttctccaccgaggcctcgctgaacctcgcggacgacgacgagctgctcgggatgatgcgggacgcgaacttcttcgccctgttcaccgggatcgagacgcccgacgaggcgaccctgatccagacgcagaagaagcagaacaccaagcgctcgatcgccgacagcgtgcacaagctctacgagcacggcatgttcgtcacggccggcttcatcgtcggcttcgacaccgagaaggacagcatcagcaaggcgatgtcgctgtgcatcggccagaccggcatcccgatcgccatggtcggcctgctcttcgcgctgccgaatacgcagctctcgcgccgcctgcgcaaggagggccgcctctacgagaactacgcggcgaccacggccgaccagggcgaccagtgcacgcagggcatcaacttcgtgaccctgcggccgcagcgcgacgtgctggccgactaccgcgacgtcctccaggagatctacgacccgccgaacttcttcgaccgggtccgggtggtcgcccggcgggtgaagcggccgaaattcgccgcccagaagctcaactggggccacatcgcccacgatctctactcgctgctgcgggtgtgctggcggatgaccgtgcggcgtccggaactcgccaagcacttctggagcgtgttcctggagaccgcccgccgcaacccggccgccctggaggccgtggtcaccaacatggtgatctacctccacgtctacccgttctcgcgctacgtcatccgcgagatcaacggccggatcgccgacctcgatgccggccgctgggtgcagccgccggtcctggcgcccgaggcggagacctgcaaggcgccgccggtcggcaaggtggtggccaaggccgaggtcaagcacctcgccgcagtggcctga

SEQ ID NO: 5799 - DNA, 900 bp, Methylobacterium sp.
gtggccgctaccgtcgccgcccgcgggctcttcccggtgaaggtcgtggccgacgtgctcggcgtggcccgctccaacctcgtcgagcagatacggagtgggtcgcggtcgcgcggtccctatcgtcgtgccgacgacgaggccgtcctgatcgccatccgcgccatcacggacgtgcggccgacctacggctatcggcgagtgacggcgatcctgaaccggacgcggcgcgccactggcgagcccgccctaaaccacaagcgggtgttccgcctgatgaagcgggacagcctactcctccagcgccacacgggcgggcgacccgtgcgcgcccacgagggccgtgtgatcgccgcggcctcgaaccagcgctggtcctcggatgggctggagatcggctgctggaacggcgaggcggtgcgggtagccttcgccatcgacacccatgatcgcgaggtgatcgcctgggtggcctccacgggtgggatcaccggccagatggtgcgggatctcatgctgacctgcgtggaggcgcgcttcggcagcctggaagctcgcttcggcagcctttgcgcgacccatcccgtgcagtggctggccgataacggctctgcctttacggccgccgagacgctgtccttcgcggcagccctgaacctcgtgccctgcttcgcgccggtacgctcgcccgagagcaacggggtgagcgaggcgttcgtgaagacgctcaagcgcgactatgcccgcgtccaaccccggcccgacgccaacacggtcctggcgcggatcggcgcctggatcaccgactacaacgaacaccatccccatcgtgggctcggcatgcgctcgccgcgcgagttcatccgtgctcagatgcaaccagccccgtgtccggtttga

SEQ ID NO: 5800 - DNA, 411 bp, Methylobacterium sp.
gtgcgctggtgctcggatcacctcgaactgcgctgccgggacggagcggtcgtccgcgtgctgtttgccatcgacgcgtgcgaccgtgagatcatcgcgtggtcggcgaccacgacgggcgtctcggccgagatggtctgcaacctgatgatcgcctgctgcgagcgccggttcggcgcgacgaagaccccgcacccggtcgagtggctgtccgacaacggctccgcctacatcgccaaggagactgctcagacggccgccgcgctcggcctacggctgctgcacaccccggtgcgttcgccgcagagcaacggcatcgcggaggcgttcgtgaagacgctcaagcgcgactatgcccgcttggcgatcttggccgacgccgagaccgtgatgcggcttctgtcggcttga

SEQ ID NO: 5801 - DNA, 459 bp, Methylobacterium sp.
gtgcgggtcgccttcgcgctcgattgctgcgatcgggaagcgatgagctacgtggcgaccacggcgggcatcacgggcgaggacgtccgcgacctgatgatggcggccgtcgagcatcgcttcggggcggtcaaccagctaccgagcctgatcgagtggctgactgacaacggcagttgctacgtcgcccgcgacactcgccgcttcgcccgcgaactcggcttgataccgaagacgacgccgctggagagcccgcagagcaacggcatggccgaagcgttcgtgcgaaccttgaaacgcgactacgtgcgtgtctcggtgctaccggatgccgagagcgtgctgcgccagctccccgtttggctggcgcactacaacgaccttcatcctcatcgcgcgctcggctaccgctcgccgcgcgagttcatcacccgatcaacccaggagaccctgtccggt

SEQ ID NO: 5802 - DNA, 249 bp, Methylobacterium sp.
atgaacgtcatgctgggccgcgtctcgctcgcggccgctctcgtgatcggcgtctcgggcgctgccctggcgcgcgatgccgggccgaaggcccacggcgccaagggcacggccggcctgcacgggatcggcttcaacgagccgaagttccgctcggacctgcgcaccggcaaggagcagccctacacgtggccggtgagcgaccgctatcgcccggtctcgcagcccttctacggccgggcctactga

SEQ ID NO: 5803 - DNA, 180 bp, Methylobacterium sp.
atgaccagccgcaccgttcagtccgccctgctcgccctcgccctcgttgccggcagcgccgggatggccgccgcgcagagcacgcccaacggcaacacctcgtctcccggcgcccctgcgggtgacaacagcaccggcaacggcgccaccggcagcggcgcggccccgagcggccggtaa

SEQ ID NO: 5804 - DNA, 786 bp, Methylobacterium sp.
atggcgagacccgtgatcggcgtcatcggcaacgcgcgcctgatcgacagccgcttcccggcgcagatcgtcggcgagaacaacatgcgggcggtcgccgcggtggccggcgccctgccgctgatgttcgccgccgtcccgacgatcaccgacctcggcgacctcctcgacatcgtggacggcgtcctgctcacggggggccgcgccaacgtccacccggcgcgcttcaacaccgagccctgcgcggcgcacgagccctacgacgaggatcgcgacgccgtggcgctgcccctgatcgaggcctgcgtggcggggggcgtgccgctgttcggcatctgccgcggcttccaggagatgaacgtcgccttcgggggcagcctgcacccggagatccgcgatctgccgggccggctcaaccaccgcatgccgcgcctcgcgaacggcgagatccacccggacctggaattgatcttcgccgaccgtcacgaggtccggctgacgcccgggggcgccttcgcccgcctcctggagcgcgagacgatccgggtgaactccctgcacggccagggcatcctggagccgggcggccggatcgtggtcgagggcgtcgccgaggacgacacggtcgaggcgatccgcgtgcgcgacgcggcgggcttcgcgctgggcgtccagtggcacgccgagcacgatccggcgaccaacccgatcaaccgcaccctgttcgaggctttcggggccgccgcggcgacgcggcaccgggcgcggcgggccggccggggctga

SEQ ID NO: 5805 - DNA, 2223 bp, Methylobacterium sp.
atgtgcgtcgatttcgcccccgctccgtccgatcgaccacagaagcgcctcccgtattgggggccgctcctgctgtcggcggccgtcggtatcgcgttgcccgccgacgaagtggccgcgcagccggtgagcggcgggcagactgctgtcaccctcgacgagatccaggtcgtcggacagggaggattgtcgcccaacacggcgaccgggccggtcaacggttacgtcgccaaggcgagcgcgtccggcacgaagacggacacgccgatcatcgagacgccgcagacgatcaacgtcgtgggggcccgtcagatacgcgacgagggggcctcgacgctggccgaggccctggcctacacgcccggcctgagcagccaggccgtgggcggcttcgccaaggtctccgacggcttcacgatccgcggcttcaccgtcgaggcgggcaactcggggctgctgcgcgacggcctgaagctgcaatcgggcgtctatgacgggacgcaggagccgtacgggctggagcgcctggaggtcctcaagggcgcggcgtcgatcctgtacggccagctctcgcccggcggcatcgtcaacgccgtcagcaagcatccgctccagacgccgttcaacgagatgaacgtcagcttcggccagtacaatcgcaaggaagtgtcgggcgatttcaccggaccgctcaccgacgacggcgcctggtcgtaccggctgaccgggctgatccgcaacagcgacagctatctcgcgtacacgcccgacgacaagcgctacatcgcgcccgcgatcacgtggcggccgtcgacggcgacctccgtcacgctgctcggctactatcaggagatccacacgcgcttccagccgccgctctcggcggtcggcacgctgctgcccaacggccggttcccccgcttcgccatcgaccggttctacggcgagcccgccttcgaccggtacgattcccggtcgggcgcgatcggctaccagatcgaccacgccttctcggactcggtccggctgcgccacgccctgcgctactaccagtccggggtcgactgggactacctgctcccgaacgggctgctggcgaaccggcaggtcgcgacgcgcggcatcagcatgcgcaatgagaacgcgacgggcgtggcgtcggacacctcgctcgagacgaagttcgtcatcggcccgaccgcgcacacgctgctgaccggcatcgactactaccgcagcttcctgaactcggagcgctacaccaacggtaccgtcggcaatctgaacgtctacgccccggtctacggcctgacctacccgcggatcaattacgcgatcaacaccggctcgaagagcctgctcgaccaggtcggtatctacgtccaggatcaggtcaggttcgaccgcttcgtcttcctggccggcggccgacaggacttcgcgcgcacgcaggtcctcacctatcgcaccggcacgcagctcgatcagaacgacagcgccttcagcgggcggctcggcctgctctatctcggcgattacgggctggcgccctacgtgtcctacagccagtccttccagaccttcgcggtcaccgaccggaacggcaatcccttccagccgtcgctcggcgagcagtacgagggcggcctgcgctgggaggtcccgggcgccgacaccctgctcagcgccgcgttctaccggatcaaccagacgaacgcgctggtggccgatccggtcaacccggtcttcagcacgcaggccgggcaggtccgctcgcagggcttcgaggccgaggcgcggacgaatttcggcccgctggaggccgtcgcctcctactcgtacaccgatgcccggcagacgcggaccacggtcgcggcgaacttcaaccagcgcctcgacctcgtgccctacaaccaggccggcgtgttcggcacctacgacatgggcatgttcgggatcccgggcctgcggctcggcggcggcgtgcgctacgtcggcagctcgaacatctcgggcgcgaccttcgactcgcgcgcggcgaccctgttcgacctcgtggcgctctacgatttcggcgccgccgacccgagcctcaaggggtggcgcgcccagatcaacgcccgcaacgtcctcgaccattcctacgtcacctgcgtcacggtgaatggctgccggtacagcgagccgcgcaacgtgttcgggacgctcacataccggtggtga

SEQ ID NO: 5806 - DNA, 1914 bp, Methylobacterium sp.
ttggcgatcaccggcactgagcagcgatacaacacggtcgcggccgtcgaagacggcgggcggtggcgcatgatcctgccttttccgcaggactcgatccgggccgccgccctggtcggcgctgcgggactggtctgcctgtccgatgacggggaactctgcctgatcgactggcgggcgggccgggatcgcgtgcggcgccgcctgccgggcgagggacccttcaatcacaagctgttcgtcacccgcgatgccgaccggatcgcggtctatcggagccatggtccgaagaacgacgagcagtacttcgacgacatcgtcgtcctgcgggcgtcggatctcgagatcctgcagcacgggcgcggactcgtctggcatgccgatggccctgtcgggtccctgtcgcccgaggaggcctatccgccgcgcccggacgggccgaccatcctgaccattcacggcgacctgttcgaggatcccggagggcgactggccttcatcggcttccggtgcgggccggacgggtcggcctacgggctgtgtcggctcgaacgggccggcgcgacgctgcgctacgacccgctgccggacgcggtgaagccctactggttcagccccagcggccgctacgccgttacgccgcactccgatcccgcgcgcgggggcccaccggaggcagcggccgatacgggggacgccggccctccccgcctcggacaggccgtcgaactctggacgaccgggcccgtcgcccgcgcggcgacgctcgtcgcgcgggccggctccgagcctccgcgcgcgatcaccgaggtggcctgggagcccgacgagcgggcgttctggatcaagtcggggtatttctgggatcggaccacggacttccagcgcatcggcctggacggcacgcgctcgcccgtcttctccttcgcgcgctacgacggcgcgaaggccgtctccgccttcgccgacgtggcggatgcggagcgggtcgagatccgcttcttcagcgactccgtctacatcccgcgcgctcgatgcgccgacgcggcgcccgcccggacgatcaccccggaggaggacggctatcggccccggccgtcggcaggcccgagcgcgtcggcggtccggtgcttcctggcgcgctcgcaaccggtggtcaccgtcgcggcgttctcggccgccgccatcgccgaagccctggacgcgctcaccggccggatccgagcggatctggggggactcctgcggggcgacgtgctcgcgttgaccttcgaggtcggcgggcgggcgatgacggaatcggccttcttcgcgcgcatcgcccgcgagcgcgttgccgtggtcccggcgctgcgcgcactcctcacgacttatctcgcggtccagccgggggtggtggaggccaggaagctgtatcgccagctctgggggcccgaggacgatcagggtgcgctggcaccggccatgcaggcgctgctccacctcgatccgacggcccacgacgtcttccgcgactacctcgcccagcgcgacggggagcacgaggtctactccaccgacgtgatgatgaggacctacatcgccgaggcgggctggcgcgaccgggccatgatccggttcggcgtctatttcgcgctgatccggtacagggatggcctgatcaccctgagtggcggattcctggaggagtacggcgtcctcgatgccgccgagggcctgctggagcccgccgacttcgccgcgctcatcctcgaggaactcgacgggttcgcggcgcgccccgatctcgactgtcgcctcgggagggacgacctctaccgcgagctccgcgcgagcctcgcgaccaccgcttacgggcggacggtcctgacggcgctcgcggcccgatccgccgcgtcgtcccgcctcgcgtga

SEQ ID NO: 5807 - DNA, 168 bp, Methylobacterium sp.
atgcccggtgacctgatcccctgcagcctcttcctgatcgggatcctcgtttcggtcgccgcggattgccgcctgcgccgtgtcgaggcggccccgtgggccaacggctgcatcacggccgccggcgccgccctggtcttcgcggcctgcgcggccgccatgcgctga

SEQ ID NO: 5808 - DNA, 339 bp, Methylobacterium sp.
gtgcagattcggatcgctctggccttcggggccatcacgctgggcggcggcgcgctggcacccgccccggcccaggcctatcagctcgacacggtgaacctggtcggctgcgcgcaggagggcggcgtctgccggatgccctatcccaccaacgtctattacggcgtgcccggccggacgaacggccggccgttcccgcagggcggcgtcgtgccctgcaatacccagaccttcggcgatccggcgccgggccaggcaaagagctgctggtacgccccgcggatcaacgcgggcggcggcgggggctacggcggcggtggctacggcggcgcgcaccag

SEQ ID NO: 5809 - DNA, 861 bp, Methylobacterium sp.
atggattcgggaaaccggcggcgcgggcggccgaaggggttcggcggcgccaagcccgcggcgaccatccaggcgctcgaccgcgccctcgatgtcctcgacgtcctggcgggcggcgacgggctgacgctctcggaactggccggcaggctcgagcaatccgtggcgaccatgcaccgggtcctcgcgacgctcgagcgccgcggcctcgtcgagatcagcgccgacaagcaggagtggcacgtcggtgcggaggcctaccggctcggatcggcgttcctgcgccgccacaacgtcgtcgagcggagccggtcgatgatgtggacgctgatgcaggagaccggcgagacctccaatctcggcgtcgagaaggacggcaacgtcctgttcgtcagccaagtggagacccacgagacgatccgcgccttcttcccgccgggctccctgtcgccgctgcacgcgtcgggcatcgggaaggctctgttgagcacctacgcgccggcccggaccgagcgcctgttccggggaaagaccttcgcgcggttcaccgacaagaccatcggctcgctggaccagctgcgcgacgacgtcgaggcgacccgccgccggggctacgcgatcgacgacgaggagcggagcatcgggatgcgctgcgtcgccgccccgatcctcaacgtccacggcgaggccatcgcggggatctcggtgtcggggccgacgcaccggctgtccgacgagaagctgcgcgcgatcggcgagcgggtgcggagaggcgccgccgcggtctcgcgcgccctcggcgcgcccgccgcgacgatgaccgcgacgcccgacgcgccgggtgcgcccgaccgggactga

SEQ ID NO: 5810 - DNA, 2067 bp, Methylobacterium sp.
atgacggcgccgcgcccgcccgtcgccccgccggccgcgacagcgccgccgcgctggttccgcctgccgctcgcggggaagttcgcggtggccttcgtgggcctcgtcagcctcgtgctgctcatcaacggcgccgtcgacctgacgctgaattaccaggacgccaagcggaccgcgatcgagacgcagcgcaccaaggcgcgcgccgccgccgagcgcgtcgacgccttcctgtcctcgatcgagggccagatcgggtggacgacgcgcgccgagtggcggcgcgtctcccccgagcagcagcgctacgacttcatccgcctgctgcgccaggcgccggccatcaccgaggtggcctacctcgatccggccggcaaggagcagctgcgcgtctcccggctggagccggacgccgtcgccagcggcaaggatttctcgacctcgccgcgcttcacccaggcgctcgcccagaagacgtggttcggcccggtctatttccggcgcggctccgagccgtacatgaccgtctcggtggcccatgccggccgcgacccgggcgtcaccgtcgcggaagtcaatctcaagctgatctgggacgtggtcagcgcgatcaacgtcggcgagcacggctacgccttcgtgacgacggcgaccggtcgcctgatcgcgcacccggatctgagcctcgtcctgcgcgacaccgacctgtccggcctgcccgaggtcgcggccgccctgcccggctcgcggatggctggtcaggactacgagatcacgaccggcctcgacggcggctgggtgctggcggcccacgccaccatcccgcgggtctactggatcgtcttcgtgcaggaatcgctgcgcgacgccatggggccggcgctcgaatccgtgatccagaccacgtcgctgatgggtctcggcgtcctgctggcggcagtggcgggcaccttcctcgcgcggcgcatggtcgtgcccatccgcgagctcgaggacggggcggagcggttcggcgcgggcgacctgtccgagcggatcgtgatccgcaccggcgacgagatcgagaccctcgcccaccggttcaacacgatggcgagccgggttcaggattcctacgagacgctcgaggccaaggtggaggagcggacccgcgacctcaaccggtcgctcgacgatctccagcgggcgcagagccggctcgtccagtccgagaagctcgcctcgctgggacagctcaccgccggcatcgcccacgagatcaagaacccgctgaacttcgtcaacaacttcgcgtcgctctcgaacgagctggtggacgagctgcgggaggtgctcgaaccgaccgccctcgatccggacacgcgcgcggaggtcgaggagctcgccggcctgctcaagggcaatctcgagaaggtcgtccagcacggcaagcgcgcggactcgatcgtcaagaacatgctgctgcactcgcgcaccgggtccggcgagcatcgcccggtcgaggtcaacgcgctggtcgaggagagcctgaatcttgcctatcacggggcccgtgcggcgaaacccggcttcaacgtgaccctcgtgcgcgattacgatccggcggccggcctcgccgacctgtatccccaggagatcacgcgggtcctcctgaacctgatgtcgaacgggttctacgccaccgagaagcgggccgccgacggcgagcccggctatgcgccgacgctctcggtcgccacccgggaccggggcgacggcgtggagatccgggtgcgcgacaacggcaccggcatcccggacagcgtcaaggccaagatgttcgacccgttcttcaccaccaagccggccggcgagggaacggggctcggcctgtcgctgagccacgacatcctcgtcaagcagcacggcgggacggttgacgtcgccacggaaccgggtgccttcacggaattcatcatcaccctgccgcggcagaatgttacgccggaggcgccgcctcggccaccgaccgtggcggcgacagagccggcgaccgaggcggcgaccgagactgagagccagccatga

SEQ ID NO: 5811 - DNA, 1410 bp, Methylobacterium sp.
atggcgacgcgtacggcagtccgggcttccgacgagggtctcgatcccggcgccatcctggcccgcctcgaccggcttccggcgacgccgacggtctggcgcctcgtggtgctgctcggcctcggcttcttcttcgagctctacgacctgctgttcaccggctacgtcgcgccgggcctcgtcaaggccgggatcctcacgccgacgaccccgggcctgttcggcgccagcggcgtcgcgagcttcgtggcggccctcttcaccggcctgttcatcggcaccatcgcctgcggctggctcgccgaccggttcggccggcgggcgatcttcacgtggtcgctgctgtcctacaccgccgccaacgtggtgatggcctgccagagcgacgccttcggcctcaatctctggcgcctgatcgcggggatcggcctcggcctggagatggtgacgatcggcagctacctgtccgagttggtgccgaaggcgatccgcggccgggccttcgccctgtgccagggcatcggcttcaccgccgtgccggtcgtggcgttcctgtcctacctgctgatcccggcagcgcccctcggcatcgacgggtggcgctgggtggtgctgatcggcgcctcggcggcgatcgtggtctggtggatgcgggcgggcctgccggagagcccgcgctggctcgtcgagcacggccgtctggcagaggccgaggcggtcctgcggcggctggaggcgcggatcgcggccgagcatgggcgcccgcttcccgcaccggccgcgccggagccggtgcagccgcgcggcgcgtttcgcgacatgtgggtccagccctaccggcgccgggccctgatgatggcggggttcaacgtcttccagacggtcggcttctacggcttcgccaactgggtgccgaccctcctggtggcccagggcatcacggtgacgtcgagcctcgcctacacggcgctgatcgcgctcgccgccccggtcgggcccctgataggcctcgccatcgccgaccggttcgagcgcaagcacgtcatcgtggccgccgccctcctctacatcgcctgcggcctggccttcgcgcagacgcgggacgtcaacgccatcgtggcgctcggcatcggcctgacgctggcctcgaacgtgatgtcgtacagcttccacgcctatcaggccgagctgttccccacgggcatccgggcccgggcggtcggcttcgtctattcctggagccgcttctcggcgatcttcaccggcttcgtcatcgcgttcgtgctgcgggaggccgggacgccgggcgtgttcctgttcatctcggcggcgatgctggccgcgggcctgctcgtcgggctgctgggcccccggacgcgggacgtcgcgctggagaagatcgcggggtga

SEQ ID NO: 5812 - DNA, 195 bp, Methylobacterium sp.
atgagcgatacgaacaacccgggcgacaagactctgaaccggacttccccgaagccgctcggcctcaagcggccgatcgaggcgggcaccgtgcgtcagagcttctcccatggccgctccaagcaggtcgtggtcgagacggtgaagcgccgcgtcatcggtgcggcgccggccgcccctgcccgtgaacccgca

SEQ ID NO: 5813 - DNA, 252 bp, Methylobacterium sp.
atgaacggtgaagatccgcaggacgacgagcgcggtgcgctggttcgcatcgcccgtacgttgggcgtcccggttgcgaccttcctgacggccgatcctactgatactccggatatcgaaacggtcgttgagggccctgatcatctcgcagaattcgtggccctgctgcgtctgttcgtgcggctgaagagccccgaggcccgggcgcgctgcctcgcctacgtcgtgcaggaagccacgcacgacagctga

SEQ ID NO: 5814 - DNA, 183 bp, Methylobacterium sp.
atgctcgtttcagcggcgatcgcggtgctcggtctgctggtggcgctcgggtacgtcggccacccgatcgacgcgcagctcgtcagcaactacggctggagcatcctgatcatcggcgtcgcgctgttcgtgctgttcacctgggcccggtacagccggacgcgccggcggcgctccgtctga

SEQ ID NO: 5815 - DNA, 177 bp, Methylobacterium sp.
catatggcccagccccacgtgccgccggccccgcgcgctccggccgcccccgcggtcccgcagtatcgcccggcccagggcaacctcgacgggcagggccgggccgcgccccagccgcggatgatggacgacgatcagctcgagatcccggccttcctccgccgtcaggcgaactga

SEQ ID NO: 5816 - DNA, 162 bp, Methylobacterium sp.
atgatcatgatcctcatctgctttctcgcgccgtggctcgccatgttcctgcgcggaaaggtgttccagggcatcctctgcatcatcctccacctgacgatcatcggatggatcccggcgacgatctgggcgctcgtcgtcacccgcaaggaagcggcctga

SEQ ID NO: 5817 - DNA, 270 bp, Methylobacterium sp.
gtgacgctgctgctcgccggattctggcccgggctcgccggggcggccgcgctcggcctcgtggtcggcgcgctggtcggctggccggaccgcctcgccgcctcgctgggtctctgcgtggtggcggggctcgtggccgcggcggcgatcgccgggttcgtgccgggcctgcccggcctgtggctcgacggcgcggccctgatgctgccggtctactgcgcggcctgcctgctcggggcgctgggacgccgcctcgccggccggacctga

SEQ ID NO: 5818 - DNA, 447 bp, Methylobacterium sp.
ttggccgaggatatccgcaagctcctgctcgccgccttcgacgtcgagcaccgggagcacgtcgcggcgatccgcggggcgctcggcagcgccaccccggactggaacgacgtcttccgccgcgcccacagcctgaagggcgcctcccgcgccgtcgacctcccggcggtcgaggcggtggcccaccgtctggagacgctgttcgagggcgtgcgcaccggcgccaccgccctcgaccgcgaggcggccaacgccgtccacctcgccctcgaccggatcgaatcctacgtcgccggcctcaccgacgggtccggaccggacatgccggccgacgccctggcggccctcggccaggtcctccggctcccgggcgagacgccgccgccggcaccacccgcaccgcccgccgcatcgcccgccgcatcgccgcccgcaccgctgccggat

SEQ ID NO: 5819 - DNA, 549 bp, Methylobacterium sp.
gtggccggcctcgtcctggccgggctcgcagcgggaaccctggggatgctgccggcctccgccgcggctccgaccgccgccccgcccgcgaccgacctgaagagcgaggggccgacgcagccggccaaggtccaggacggtcagtacaccgacaagaacggtaatccgacctaccacgtcacggacggcggcaagatggtcgactggtacaccatgtccggctacgtccggtacagcgcgaactgcatggcctgccacggccccgacgggctgggatcgagctacgcgccgtcgctggtcgacgccctcaagggcatggactacgcgcagttcgccggcatcgtcgtgggcggcaagagggacgtgaacgcctcgcaggagctggtgatgcccgccttcggcgagaacaagaacgtcacctgctacctgccggacatttacacctatctccgcgcccgctccgacggggcgctcggccgcaaccggccgtccgagcacgagcccaagcccgcggccttcgagaaggccgaggatgcctgcatgaagtga

SEQ ID NO: 5820 - DNA, 549 bp, Methylobacterium sp.; identical to SEQ ID NO: 5819

SEQ ID NO: 5821 - DNA, 732 bp, Methylobacterium sp.
atgaccgacttcaaccgggcggcgttcttcaacgccgtgcgggcgtccggcctgtgcggcaagacgctctctcagactgtcgtcgacggcctctcggggatcctcgacgcctccgcccagtaccagcccggcgcggacctgcgccacgtctcctacccgatggcgaccgcctggcacgaggcccgcctgaacgccgccatccgcgagatcggccgcggcgccgggcatccctacggcaagcccgccggcccctacggcctggtgtactacgggcgcggcccgtgtcagctcacctggtacgacaactacgtcaccttcgggaagctgatgggcgtggacctcgcccggttccccgacaaggcgctggagcccgagatcggcgcggccgtgctgatcgtcggctcgcgcgacggcctgttccgcaagggcaagagcctgtcccggttcttctcggccaccgtcgacgacgcggtcggcgcacgcgacatcatcaacggcgacgtgaagaagaacggcgcgatgatcgccggctaccaccgcgtgttcctggccgcgctcaaggccgccggaagcgtcgggccggtcccggttgccgccgcgccggctcccgctcccgcgcccagcgccaaggccaccgccacggcggccgtgcacggcctcggggccggcatccgcgacgctctcgatagcgtccacaccgccatccacgacgtgctccggaaggccgcctga

SEQ ID NO: 5822 - DNA, 816 bp, Methylobacterium sp.
atgaccgctgccctggaccggcaggcgttcttcaacgctgtgcgattgaacccctttccgggccacctgacaccggcgcaggtgtccggcatggaggcgatcctcgacgcctgcccggtcgacaccccgtctgagcacctggcctacgatctcggcacctgtcctattgagaccggctggacaatgcagcccatcaaggagaagggcggcgccgcgtacttcgccaagatgtacgacatccgcggggaccggccggacaaagcgcgcgagctcggcaacctcagccctggcgacgggatcgccttctgcggccgcgggctggtgcagctcaccgggcgggcgaactaccggaaggcgaccctgcggctccgcgcgctcggcctgctgatcaccggccaggatctggagacggtcccggacctcgccatgcacccggatgtcgcggccgccatcctgttcatcggcacgcgcgaggggtggttcaccggcaagaagctgtccgactacctcggcggcggcaaagccgactggaagggcgcgcgccggatcatcaacggccaagaccgggcgagcgagatcgcgcttcacgcgcaggccttcgccacggcgctgaagaaggccggctacgcgcccggcgccgtcgtgacgaagatcccggtcccgccggtccaggccgcgcccgtggccccgctcgtcgcgcccgcgccgcggcgggccgccgacccgcctccgcccgacaccggcggcgtcaccgctccgcccgtcgggctcgtcgcgtggctgaagaagaccctgttcccgaagaaggctgcatga

SEQ ID NO: 5823 - DNA, 411 bp, Methylobacterium sp.
atgccggataccagcgccctcaactcggccgccggcgccctggccgccggccggcaggtgcagagcgggcggatccgcgcgatctccgagaacctcgccaacgccgattcggtcccgaccaccccgggcggtgccccttacgcccgcaagatcgcggtgttcgccccggtggcggccgacagcccccgcgacccggtcggccggatcgtccgcgacaccaccggcttccgcacccgatacgacccgaccaatcccggggccgacccgaccggctatgtccgtctgccgaacgtcaacgtcgcggtcgaatcggccgacctccagcgggtggtccggaactacgaattgagcctgagcgcctcggcctcgatcaagacgctcgcccaggccaccatcaacctgatcagctga

SEQ ID NO: 5824 - DNA, 99 bp, Methylobacterium sp.
atggtcctgaagggcttctcctacgcgatgatcggcgccttcctgggcggcctcgcgatgacggtgaccggctcggccggggtgctgatgggcttctga

SEQ ID NO: 5825 - DNA, 1827 bp, Methylobacterium sp.
atgctgagcggcgacggaacggtccggcacgacgatgccgcgtcgcccatgggcgcggtgacgtccatcgagggatccaaggtccatctcgaactcatcgtgcagggcggccggcccagggtgcgcgtcactgtcggcaatctggtccggatccgtgccggagaggcgatcctcgtcggcatcgtcaccacgctgtcgtcgggcagcgagcgcgggcaccgtccgggcgcctacgcgagcctcgacctgctcggtgagatcgtcgcggcgcacggcgcgcgccgcttcagccgcggcgtgagctgctacccggcgatcggcgacgatgtggaactcctgtccgccaccgacctccggatcgtccatcaggtctcggcgaccggtacggcggccgtgggcgcgctctaccaggatcccgagaccccggcctgcatcaagatcgacgacctgctctccaagcacttcgcggtgctcggtgcgaccggtgtcgggaagtccagcggcgtcaccgtcatcctggacgaggtgatgcgggcgcgaccgtccgtgcgcgtcttcctgctggacgtgcacaacgagtacgccgccagcttcggcgaccgcgcgagcgtcatcaacccgcggaccctcaaactgccgttttggctgttcaacctcgaggagatcgccgacgtcatctacggcggccggccggccgtggacgaggagatcgagatcctggccgaggtgatccccctcgcgaagagcaagtacggccagtacaaggaggcgagcgaccgccagatcgtcaagcggcccttcggcaagggcgccggctacacggtcgacacgccggtcccctacatgctgcaggatctgctcgcgctcatcgacgagcggatgggtcggctcgagaaccgcgtctcccggatgcactatcaccggctgatcacccggatcgaggcgatccggaacgatccccggcacggtttcatgttcgacaacgccaatgtcggcggcgacatgatgggcgagattttggcgcacctgttccggctcgatcccgacgggcggccgatgacgatcatgcagctcgccggcctgccgatggaggtcgtcgacgccgtcgtgtgcgtgctgtgccgcctcgccttcgagttcggcatctggagcgagggcgccgtcccgctgctgttcgtctgcgaggaggcccaccgcttcgcctcagccgaccggtcggtgggcttcacgccgacgcggcgcgccctggcgcggatcgcccgagagggccgcaagcacggcgtccatctcgggctggtcacccagcgcccggccgagctcgacgcgacgatcatgtcgcaatgcagcaccctgttcgccatgcgcatgaccaacgcgcgcgaccaggccttcctggccgcggccgtttcggacgccgccaacctcctcaccttcgtgccgtcgctggggaccggcgaggtcatcgccttcggcgagggcgtcccgatcccggcgcggatgactttccggccgctgccgtcggcccgtcacccgcgcaacgacgcgagcggcagggccgccgaggacgacgcgaccgtcgccggcgcggccttcgtcggcgccgtcgtcgagcgctggcgcggcgccaccatgaacaaggtcgccgggtacgacagcgatccggccgcggcggcgcgcctcgggcgcgagacgggctcggacagcccgcacggcgccgccctcgagcaggtgcatcgccgtctcctccgccgccccctcgagggcggcgaccaagcccagaccggagcccaacctgccaagcccctttggcagcagggcggggcatga

SEQ ID NO: 5826 - DNA, 1689 bp, Methylobacterium sp.
atgagcgagcccgctttcccggagcgtcgaaccctgctcgaggccgccctccaggcgctccctgtcggggtcgtggtccatgacacgcagggtcattgcgtcctcgccaacgccgccgcgcgcgccctcggcgacagggccgtccaggcgcttcccgccgcggcgggaagcgcctgggacgccgcgaccgtcgaggcgctcaacgaccggatgttcgaggtgcggacgcggccggtcgccgagggccgggacggtttcacgctgacgaccctgaccgacatcacgcaccatcaccggatccagcgggagctgatcaccaaggccttcatcgacgcgctgaccggcctgcccaaccggacgatgttcgagcagagcatcgcggatgtcctggcgggatccgcgccgggggaccggttcgccctggccttcatcgatctcgacaacttcaagcacatcaacgactactacagccacgccgcgggcgacgccctgctgcgcaaggtctccgaccggatcggcggcgcgctgcgcccgagcgaccttctggcgcggatcggcggcgacgagttcgtgctgctcctcgcccccgtcaccgacggggacgcggcgctggccgccgtgcgcgccatctcggagcgcctgaagcagccgttcttcatcgacgggcacgagatcttcgcctccgcctccatcggcgtcagcctcttcccggagcacggtgacagctacgagaccctcgcccgtcaggccgacaacgcgatgtaccgggtgaagggcgagctgaagggcggcgtcagcgtcttcgacgacgcgatgagccaggccgccacggcccgcatggccgtggagcagcgcctccggctggcgatccgcgaccgctgcttctgctgcgccttccagcccaaggtcgacatgcgctcccacgcggtcacgggcgtcgaggtgctcctgcgctggcgcgacgaggtcggcatgatccaggcgcccggcgacttcatcgccctcgccatcgagctcgggctgatcaacgagatcaccctgcagctcctggcagagacggtgcgggcgatgcccgacatcgacgaggtgttcggacccgacgtcaccgtgagcctcaacatcgccgccaaacaggcctgcgacgtgccgttcatgaccgccttctgcgcggctctcggcgagaccggcctcgcggagcgcttcgtgctcgaactgaccgaggaggccttcttcacgacgggccgcttccagcgcgaggtcctgccgaagatccgggcgatcggcgcgcgcgtctcgatcgacgatttcggcgtcggctactcgtccctcgcggccctggcagacatcaccgcggacgagctgaagatcgatcgctcgttcatcaccgacatcgacaagcggccgcgcagccagatcgtcctgaaagcgatcgagtcgctcggtgcggcgctcgggatgacggtggtggccgaaggcgtcgagaccttcgaggaggtcgcctacctgctcggcgccacgcagatccgctgcgcccagggctactacttcgcgcgcccgctgctgctcgaccagatccggcaggccgagccgccgcgcatgtccgggtcgcgcggtccggccacgcgcggccgcgcgtcggacctgcgcgcgtcggacctgcgcgcgtccagcctgatgcggcgcgcctga

SEQ ID NO: 5827 - DNA, 1221 bp, Methylobacterium sp.
atgagagttctggcgcgtgcactcgccgccgccctcgtgctgggcgccgcggcccaggcggcgggaccgacgacggcccgagccgccgacgtgaaattcggcgcgctcttcccgttcagcgggcagctcgccctgctcggcgaggagagcgcccgcggcgtcgagatcgccgtcgacgagatcaacgccgccggcggcgtccaggggcagaaggtggtgctcgcccgcggcgacgccgtcgacaacaaccaggcgatcggcgaggcgcgccgcctgatctccctggagaaggtggcggcgatcttcggctcctactcgtccgcccgctccatcgccgcgagccaggtggccgagctgtccggcatcccgtatttcgaactcggcgcggtggccgaggaggtgaccgggcgcgggctgcagtacctctaccgcaccaacccgacggccgaggacatggccaagctcgcggtggagatgatcgtcaacaaggtcgccgccgggctcggcaagaagcccgaggacctgaagatcggcatcatctacgaggattcgagctacggcacctcggtggcgggcttccagaagaagttcgccgcccaggccaagctcaacgtcgtgaccgcgcagggctacccggcctccacggtcgacatgtcctccctcgtcctagacctgaaggggcgcggcatcgacgtcctgctccagacgtcctaccagaacgattccgtgctgttcctgcagcaggccaacgaggcgggcttcaagccgggcgccatcatcggtggcggcggcggctactcgatgcagcccaccgccgacgcggtcggccacaaggtcatcgagggcgtgctcgacacggatttcacacagtacctcgtcaacacgaagtacacgcccggcatcgagaacttcgtcgcggcctaccagaagaagtacgggagcgccccccgctccgggcactccctgaacaactacgtcggcgccaagctcatcctcgaggccatcggcaaggcgaagggcttcgagcccgacaccatcgtcaaggccgtccaggccatcgacgtgaaggacggcgtcaccgcggtcggctacgggtttaagttcggcaagaacaaccagaacgagcgcgccgcgatgatgggcatgcagtggcagggcggcaagctcgtcacggtctatcccgacagcgccgccgtcgcgcccatggagatgcgcaagtaa

SEQ ID NO: 5828 - DNA, 177 bp, Methylobacterium sp.
atgctcgcgctcatcaccgcccggatccccggcccctccgtcgagaccgccgatcgcgatcccggcttcctgaccctcatcttcgcggtcgcccgcacgctgcgcggcggcgcggagagtgccttcgcccgccgctgcgcgctcgcccgctcgatcggtggcccgaaccctctctga

SEQ ID NO: 5829 - DNA, 318 bp, Methylobacterium sp.
gtgacacgcggcacgctcgtcgacggtcgtgtctgcctcgcccggaccgacgcggagcgcgccccgctggtccggcgactggcgcggatcgagggtcaggtccggggcctgcgggcgatggtcgaggccgaccggcactgcctcgacgagatccagcagatccgggccgccaccgcggccctgcgcgaggtcggcctcctgatcatcgaccagcacgtggccgcgggactccgtctcgcggcgcgcgatccggaccgggaggcggtcatggcggacctcctccgggttctgcgggcggccatggcggaggccggatag

SEQ ID NO: 5830 - DNA, 396 bp, Methylobacterium sp.
atgtcgccgctctccatgctgccgcgcgccgtgatcgccgctgccgtcgtgttcggcctcgccctttcgtcggcggcggtggcggcgcggaccgcaccgggacccgccgtgcgggcttggctctccgacctcgtcacgcggatcgatgccgcggaccgcgccgggacgcggccgggatcgggccgtggccgcggaaccgtggtcgtccatgtgcagatcgccgcggacggcgttgtccagggcgcagagatcgaggagagctcgggctcggcgaacctcgatcagcgggcgctccgcgccgtgcaggggatcagcccggcgcccgcgccgcccgccgcactcctgggtgtggacgggatcgtcgatctcagcatcccggtcgcgctcggccgctga

SEQ ID NO: 5831 - DNA, 507 bp, Methylobacterium sp.
gtgcgcgcaatcctgttgatctgcctgctcggcttcctcggcgtgacggccgtcctgaagctgcgcgacgccacgaggccggcgccggtggccctcgccgtcacgccgccgccggagccggttcccgcagtcgatgccgccggcgtggctctccaggccgggcgcaacggccacttctacgtcaacgcgctgctggacggccgctcgctgccgatgatggtcgatacgggagcgagcgcctgcgccttctccgaggaggacgccgcgcggatcgggatccgggtgactccagccgatttcacccgagtctggaacaccgcgaacggcacggtccgcgtggcgccgatccggatcgccatcgtgcagatcggatcgatcacggtgcgggacgtggatgcggtcgtgatcccgcgcggactcctgtcgacgagcctgctgggcatgtcgttcctcaggcgtctgcgcgatttcggtatctccggcagcacgatgacgctcaggggctga

SEQ ID NO: 5832 - DNA, 963 bp, Methylobacterium sp.
gtgagctttaccttcgcacccgccgccagcttcaccgagcgcgccggcctgttcgtcagcctcaccgggggcaccaacagcggcaagacgtactccgcgatgcgcctcgcccgcggcatcgccgggcccgagggcaagattgcagtcctcgataccgagggcggccgcacgctgcacctgaaggacgccttcgcgttcgacgcgaacgtcatggacgcacctttccggcctgagcgcttctcgcaggccgcgcaggcagcagagcaggccggctacgcagccctggtgattgacagcttctcaatggagtgggtcggcatgggcggcgtgctcgactggcaggctgccgagcacaagcgcctgggcggctcggacgcgaagaagggtcagtcctggatcgcgccgaagatggcgcacaaggccatggtctacgcgctcctgcagcgccggatcccgatcatcttctcgatccgcggcgaggagacgttcatcccgccgaacacgaaggtcttcaagtcgatcaccaaccggatgtttccgttcgaggtgacggtctcgttcaggctggagagcgagcggaagggctacctcgatttgtccgacccgaagtcgtggaagatggagggcgcgcaccaggagatcttccggcacggcgatcggctcagcgaggagcacggcgctcggctcgcggcctgggcccgaggtgagcgcgtcgcgccggcggaggagaagcagacagaggcacccgcgccggcggcagccagcatgacgaagcgcgagctctacgccgccgcgcgcgccgcagcggcgaaggggcaggacgccttcgacgagtgggtcaacccgctcccggaagccgcatacgacgccctcgggcagatctgggccgagctgcaggcgctgatcgccaaggccgatgagggcttcccgggcgacaccccagccgctgggcaggccgcctga

SEQ ID NO: 5833 - DNA, 1473 bp, Methylobacterium sp.
atgcccaagtccctcgagacgcgccgcccgctggtcctcgccgcggtgatggcgtcgatgttcatgatcgccatcgaggcgacgatcgtctcgacggcgatgccgcagatcgccggccatctcggcgaccttcacctctacgcctgggtgttcgcgtccttcctgctgacgcagacggccaccacggtggtgttcggcaagctgtctgacctctacgggcgccggccggtcctgctgttcggcatcgcggtgttcctggcgggctccctcctgtgcgggctcgcgtggtcgatgccctcgctgatcctgttccgcctgatccagggcgtcggcgccggggcgatccagcccgtgagcctgaccgtcgtcggcgacctgtacgcggtgcgggaacgcggcaaggtccagggctacctcgccagtgtctgggggatctcgtcggtggccggcccgctggtcggcggcctgatcatcggccacctgagctggccctggatcttctggatcaacctgccgatcggcgtgatcgcggccggcctgttcctgcgcttcctccacgagggcgtcgagcgccgcccgcgccggatcgacgcgatcggtgcggccctgttcaccgccgccatcgcggcgctgatgatcgcgctgaccgaggcgggcgagtcggccgaagcggccctgtggccggcgctggccttcgtggtggccgcgatcctcttcgtcgtccaggagcggcgcgcgccggacccgatgctcgacatccgcctgtggttgcagcgccccatcgcgaccgccaacaccgcgacgctgctctccggcatgacggtgatcgggctcacggcgttcctgccgatgtacgtgcaaggcgtgctgcggcagtcgcccctgatcgccggcctgaccctgaccctgatggtgctcggctggccgatcggcgccacgacggcggcgcgcagcttcgtacggttcggcctgcgcccgatcctgctggtcggcgcgacgctcctgcccctcggcgcggtcgccttcgtggccctcgggcccgacacctccccggcggtggcggcctgcggctcggtcgtgatggggctcggcatgggcttcctgtccacggccgccatcgtgatcatccaggacagcgttgcctgggcccagcgcggggcggcgacggcctccaacatcttctcgcgcaacctcggctcgaccctcggcgcgaccgtcctcggggcggtgctgaattaccggctcgcgaacccgtcgagcggcccggcggtgaattccgatcagctgcgccgcttgctcgacgatccggcaagcctcggggccggcggcgaggcgatccgggccggcttggagcacgccctgcacggcacgttctggacggtgttcgccgtggcggggctgaccctgctcctgtcgctgctggtgcccccggtggcgatctccgaccggccgcgcgagctcgccgtcgagtag

SEQ ID NO: 5834 - DNA, 1158 bp, Methylobacterium sp.
atggcgggaccgaagccgttgctgctcacgccgttgacgatccgcggcgtcacgctgccgaatcgcatcgcggtctcgcccatggcgatgtaccgggcgcaggacggctttccgacgccgttccacctcgtccactacggcaagttcgccctgggcggcgccggcctcgtctacgtggaggaggctgcggtcacgcgaacggggcggatcaccaacggatgcctcggcctgtgggacgacgcccacgccgaggccctcgcaccggtcgccgccttcctcagcgccgagggctccatccctgcgatccagatcaaccacggcggccgcaaggccagcgcgcagcgggcctgggagggcaacgggcgcctcaccccggagaacgtcgccaacggcgacgagagctggcagccgctcggcccgtccgacaatcccttctcggagggctggccggtgccccggcccctcaaccgggacgacatggatacgatccgcgaggccttcgtcgcggccgcgctcagggccgtccgggcgggcttccggatcgtcgagatccacatggcgcacgggtacctgctgcaaagcttcctgtcgccgctggccaatgcccgcacggatgcctacgggggagcgcgggagaaccgcatgcgcttccccctggaggtggctcgcgcgatccgcggggcgctgcccggcgacgtgccggtcttcgcgcgcatctcggcggtggactggatcgagggtggctgggagatggacgacagcgtcgccctcgcccgtgccctcggcgaggcgggcatcgacctcgtggattgctcatcgggcggcaacctgctcaagggggcgaccaatacgaacctggcgcgggcaccgggttaccaagctcccttcgcccgccgcctgcgggaagaggcgggcgtgttcacccaggccgttggtctgatccgcaccccgcagctcgccgaggagctgcttcaggccggctccgccgacatcatcgccgtcgggcgacagatgctctacgatccgttctgggcacaccacgcgacagaggcgctcggcgagacaggggccttcgaggcatggccccgcccctatgcatggtggctggagaagtgggcggccggcctgcgcagttcgggcgaggcgcccgcggcatga

SEQ ID NO: 5835 - DNA, 1065 bp, Methylobacterium sp.
atggaagcgatcgtcccgtccgatggcacggcgccccgcgtcgtgcggcgccgcatcggtctgctctacctcgtcctgatcgcggccaacgtcgccgcctggtcctgggcctacagcctgttcgcggggcagccggccctgctctcgaccgcgctgctggcctacgtcttcgggctgcgccacgcggtcgatcccgaccacatcgccgccatcgacaacgtcacgcgcaagctgatgcaggcgggccagcggccggtctcggtcggcttctggttcgccctcggccactccaccgtcgtggtggtggccgcggccgcggtggcgctggccgccaccagcctgatcacggcctcggaaggctaccgggaactcggcggcctgatcggcaccggcgtctcggccgccttcctgatcctcatcggcctggtcaacctcgtcgtcctcgcgggcgtctggcgcgcgttccggcaggtgcggcgcaccggccgctacgtcgaggccgacctcgacatgctgctcgccaaccagggcgtcctcgcccggatcctgcggccgctgttccgcctcgtgacgcgctcctggcacatgtacccgctgggcctgctcttcgcgctcggcttcgacaccgccacggaggtgagcctcttcgggctctcggccgctcaggcgagccagggcatcgatctctggacgatcctggtcttcccggcgctgttcactgcgggcatgacgctggttgacgcgaccgacggcgtgctgatgctcggcgcctacagctgggcctatgtccagcccatgcgcaagctgttctacaatctcaccatcaccctggtgtcggtggtggtcgcgctggtggtcggcacgctggaggcgctgaacctcctggcggacaagctcaacctccagggctggctctgggagcggatcgccgcgatcaacgaccatttcggcgtgctcggcttcggcatcgtcggcctgttcgcggcggcgtggctcctgtcgttcctcatctaccgcctcggccggttcgaccggatcgcggtcgaaccggccgatatcccctga

SEQ ID NO: 5836 - DNA, 981 bp, Methylobacterium sp.
ttgctcgccggagcggccctgctcggtgccgcgcgggcggccggggccggctgggagccgtcgcagcgggtgccggacccggcggtggagatcctcgacccagccttcgccaagtacaggctagcctcggcgacggtggagcgggtcgccacgggcttccgctgggccgagggaccggtctggttcggcgacatgggcgcgctgctgttcagcgacgtggtcaacgaccggatcatgatgtgggaggaggcctccggcgcgctctcggtgttccgcaagccgtcgaactacgccaacggcaacacccgcgatcggcagggtcgcctgatcacctgccagcacaagacgcgcagcgtgacccggaccgagcacgacggcagcctgaccacgctgatggaccggttcgacggcaagccgctgaactcgcccaacgacgtggtctgccattccgacggcgcggtctggttcaccgacccggccttcgggccgaacccgcacgaagcgatggccgcgccggagcttcccggcaacgtctaccggattgatccgaagacgggacaggccagcgtcgcggtcgagggcgtggcgggtccgaacgggctctgcttctcgccggacgagtcgaagctgtacgtcgtcgaggcgcgggcgaagccgaaccgcctgatccgcgtctacgatgtggtcgagaacggcaccaagaccgcgaacggccgcgtcttctacgatgccggcaccggcactccggacgggttccgggtggatgtcgacggcaatctctggtgcggctgggggatgagcgaggccgaggacggggtcatcgtgctctcgccgcaagccaagctgatcggccggatccgcctgccggagcgctgcgccaacctgtgcttcggcggcctcaaccgcaacctgcttctgatgacgtccacgcactcggtctattcactgtacgtgaacacgcgcggtgcggggacctgctga

SEQ ID NO: 5837 - DNA, 861 bp, Methylobacterium sp.
atgttcgacgcgaccaagatgctcgccgacgccctcggcgagcacctggccctgacctaccagcggaccttcggcagccgggagccgcgctacgccgagatcatcgaggccgcggcgcgcctgacgatcgagcggatcgtcgggagcgacgccctctaccacgacggcgaccacacggccctcgtcaccctggtcgcccaggacatcctccgcggccgcttcctgcagcagggcatcacgcccgaggactggctgcacatgatcctggccgccctctaccacgacatcggctacgtgcgcggcgtctgcgccggagaccggctgcaggccttcgtcatcgacgcgcagggcacgaccgtcagcctgccccggggcgcctcggacgcggcgctggcgccctaccacgtggagcgctcgaagctggccgtgcaggagcgcttcggcacgcacgatctcgttgacgcgtcccgggtcatccgggcgatcgagctgacccgcttcccggtccccgaggacgattcccatcgcgagaccgggaccgaggccggcctgctgcgggcggccgacctgatcggtcagctcggcgacccgctctacccgcgcaaattgaacgccctgttccacgaattcgccgagatcggcgtcaacgcggaactcggctacgacagcccggccgacctcgcggagcgctacccgtctttcttctggggcaagatcgagcccgtgatcggggacgcgatccggttcctcgacctcacggtcgaggggcggggctgggtcgcgaacctctacgcccacgtcttcgccatcgagcacgaccgccggcgcatgggcccgcatccgggaccggaccccctctga

SEQ ID NO: 5838 - DNA, 216 bp, Methylobacterium sp.
gtgacacccgtcacggtcgaggaattgctgcgccagaaggccgagacggaggcgtggcgcaagcgcagcgcggccgccgcagaccgtcgccggaagcgggagcgcgccgaccaggaggcctacgtggcggagcagcgcgcccggcaggcggagcgcgaccggcactgggcgcgcgcccgcgcggatcgcccgggggcgccggaggacgggacctga

SEQ ID NO: 5839 - DNA, 1119 bp, Methylobacterium sp.
atgccggattccggtgatccgattccgaagacgatgccctacctgccgcagctcgacggggtgcgggcgctcgccatcctgatcgtgttcgcggcccattgcggctacagccacgtggtgccgggcggcttcggcgtgaccgtcttcttcttcctcagcggctacctgatcaccacgctcctgcggatcgagcgggcgcggaccggcacggtgtcgcttccggccttctacctccggcggagcctgcgcatcctgccgcccatgtacctgaccctgctcgcctccggcgcgctgtacgcggcggggtggctcgactggatgcaggtcgcgccggcggcgatcctcgggcaggcgaccttcctgacgaactatcccggcctgttcggcacggaggcggtgctgccggtgccgctgtggagcctcgccatcgaggagcacttctacctcgtcttcccgctggtcttcctgctctggctcgggcgcctgcggccgcgccgcgcggccctggcctgcctggggctctgcgcagccgtcctggcgatccggtgcgtcaacgtctggcggctgccggattacagcctgaactacagctggacccacacccggatcgacgcgatcctgttcgggtgctgcctcggtctgtggaacaacccggtggtcccggccgaccgggcgtggcgccccgcgccctggcacgtcgccgcgagcctcgcggtgattctcgggaccctggcggtccgcgaccccgccttccgggagagcctgcgctacacgctccagagcgccgccctgttcgtgcccttcgcgtacctgctgcacggcgacgggcctctggtgcggctgctggccagccggccgatgcgccggctcgggctctggtcctacagcttctacctcgcgcacatgaccgtggtggccctggtgctgcacctgcggcccgggctgcacggcgtcggcctgatgctggcggccttcccggtgaccctgctgtggtgctgggggatgtacggcctcgtcgagcgcccctgcgcgcgcctccgccgccggctcctggcggaccggccgccggagccgagcctggccgaggacggccgccgggccggcgtcacgcccgcctga

SEQ ID NO: 5840 - DNA, 729 bp, Methylobacterium sp.
atggcagatctttccggaaagacggtcctggtcacggcggcggggcaggggatcgggcgcgccagcgcgctcgccttcgcccgcgccggggcgcgggtccacgccaccgacatcaacgcggacgccctcgccgacctgcgcgccgacaacctcagcaccgcgaccctcgacgtgctggacgcggaggcggtcggggccctggtcgcgcgcatcggcgcggtcgacatcctgttcaactgcgccggcaccgtccacgccggcaccatcctggagatgcgcgacgacgagctcgacttcgccctcgacctcaacgtcaaggcgatgatccgcacgatccgggcggtcctgcccgggatgctggagcgccgcgacggcgccatcgtcaacatggcctcggtggcctcctcggtgaagggagtgcccaaccgcttcgcctacggggtgacgaaggcggcggtgatcggcctgaccaaggcggtggccgccgactatgtcggccacaacatccgctgcaacgccatctgccccggcacggtggagagcccgtcgctgcaggagcgcatccgccagcagggcgactacgagcagacccgcgcggccttcatcgcgcgccagccgatcggccggctcggcacgcccgaggagatcgccgacctcgccgtctacctcgcgggcgcgacctacacgaccggccaggccgtcgtgatcgacggcggctggacgatctga

SEQ ID NO: 5841 - DNA, 981 bp, Methylobacterium sp.
gtgatcaccggtccgtgcctcatcgtccagccgatccacgcggcgggcctcgaccggttgcgcgcggccgggctggagccccgcccggcgagcgggaccgatcctgagacgctggcgcgcgaggtcgccgactgcgtcgccgtcatcacccgcaacaccggcttcccggcccgcgccatcgcggcggcgccgggcctgcgggtgatcggtgtccacggcaccggcaccgaccacgtcgccaccgccgaggcgaccgcggccgggatcgcggtggtcaatacgcccggcgccaacgccgtctcggtggccgagcagacgctggcgctgatcttcgccctggccaaggccctgccggaggccgaccgctcggtccgggccggcgacgacagcttcaagttcaccgcccggctggtcgagctcgccggcctgacgctgggcctcgtcggcttcggggcgatcgggcaggcgaccgcccggctcgccgccgccctgggcctgcgggtgctggcctacggcccgagccgaccggacgccgacttcgccaatgccggcgccctgcgggccgcctcggtcgacgcgctcctggcggagtccgacatcgtctccctgcacgtgccgctgaccccgggcacccgcggcctgatcggccgggaccagctcgcgcggatgaagcgggacgccttcctgatcaacaccagccgcggcggcctgatcgacgaggcggccctggtggaggcgctggaggccggcacgatcgcgggcgccgggctcgacgtcttcgcccgggagccgctgccggtcgaccacccgctggcccgccagccccgggcgatcctgacgccccatgtcggcggctccaccggggcggccctgatccgcaccgccgagaccgccgcgacccgcgtggtcgacgtcctcgccggccggcggccgggcgggctggtcaacccggacgtctgggagcggcgccgcggagtgtga

SEQ ID NO: 5842 - DNA, 933 bp, Methylobacterium sp.
atgggagcgaagacgtacaccatcggcgatctggcgcgcctgtccgggcaaccggtcaggcggatccggttctactcggacaggggcctgctgccacccgccttgcgatccgcgtccaattatcgggtctataccgactcggatgtggccaaactcgacctcatccacgcgctgcgcgaggccggaatcggcctggacgtgatcgggcagctgatggcccgcaagctgtcgctgcacgacgtgctgcgaacccgtctggagattctggaagccgagatcgccgccaagcgccggagcgccgcggtcctgcgcgccacgcttcgcgtcccagaccctgccgaaagcgatctacggaggatttggaccatgagcacggtgagcaaccagcagatgaaagccctggccggggaattcgtcgacgccatcggggcgggcacgactctggagggggagtggcggcgacgggttctcgccatgagcgtgccggacctgccggatgacccgacgccggagcaactcgcggcctgggatgcgctggcgaatctactggccgatccgaccttcatccacgaggttcaggacggcacgaaggctttctggacggacgcactcgatcccgccgcctacgagaccgcatcgcgcagagcctacgaggcggcgactgacgccgtggcacgcggcctacctccggagagcccggaggctcacgcgattgcgcgcgcgtggctggacgaatcggcccacgcgctgggacgctcgcccgatctggcgctcctgcaatggcacttcgatcagtatgagaagaacgccggccggctcgggcaatatcgcgccttcctggcgacgctgaacaagcagtcgccgaccgccgccgatcccactgtatggggttggctgaacaacgcgctcaagatgctgtcgtccgcgctgtaa

SEQ ID NO: 5843 - DNA, 114 bp, Methylobacterium sp.
atgttcgccagcccgcacgccttcgtcctgcaccatcgcgagcgcctcgccgtgctcgtctcctcggccctgttcctcgcgggcgcgctgccgctgttctgggccatcggctga

SEQ ID NO: 5844 - DNA, 261 bp, Methylobacterium sp.
gtcgccaagcgcgcgatcccgggctcgggcgccagcctcgtgcgcgtggtcgtcccggccggcgtctcggcgccggcgcacagccacgatcacgagcagttcgtgcaggtgctctcgggctcggggatcctggagaccgagcagggccgcgagccgttcgcggccggcagcgtgttccacttcccggccggggcgtggcacgcggccgcgttcgagaccgagacggtcctgatcgagacgaacctcgtgccgggagcttga

SEQ ID NO: 5845 - DNA, 915 bp, Methylobacterium sp.
atgcgtctgctcgctcccctcatcgccgcgctcctcctcggcgcccccgcgggggccgcacgcgccgccgagctcaccggcaccctcaggaagatccacgacagcaacaggctggtcctcggcgtgcgcgataccgccacgccgttcagctacctggaccaggaccagaaggtcgtcggcttcgcggtcgacatctgcctgaggatcgccgacgcggtgaagcgcgaactgaagatgccgggcctcgaggtcgggatggagttcgtcaactcctcctcccgcatcccgctgatgaccaacggcacgatcgatctcgaatgcgggacgaccaccaacaacgccgagcgcaagaagcaggtggacttcaccaacacgcacttccttacggcgacccgcttcgtctcccgcaaggaccagcacatcgccggcctggacgacctgcgcggcaagacggtctcgtcggtcgccggctcgaccaacatcctgatgctgatcaaggccaacaacgagcgcaagctcggcatcacggtgatcgccgccaaggacgtcccggaggggttcctcatggtcgagaccggccgggcggcggccttcgtcatggacgacgtgcagctcagcgtggtcgcggcccagtccaaggagcccgccgcctacgcggtcagcgacgagaccctgtccaacccggagccctacgggatcatgctgcgcaaggacgacccggccttcaaggcggtggtcgaccgggcgacggccgatctctaccggagccccgagatcacggtgctctacgaccgctggttcctgaagcccgtgccgccgcgcggcctcaactacaacgtgccgctgtcgtcggccctgcgctgggccttcgcgcacccgaccgacaattcggatcccgcgttctacgcgcactga

SEQ ID NO: 5846 - DNA, 396 bp, Methylobacterium sp.
atgccgtccgtcgatacgctcgtcccggtgggtgccttcgcgctgctggtcctggcgttcgccgtgaagcacctcgcggcggacttcttccttcagaccaactggatggcgcagggcaagcagcggtcgtccgcctggctcgcccccctctgcgcccataccggcctgcacggcctcggcacgctgctgatcgcgctggcggtgaagccggccctgtggtggctggcgctcgtcgatttcgcgatccacacggggatcgatcgcggcaaggtgctggtcggtcggcggacgagcctgccgcccacggacgcccggttctggtggctgatcggcatcgaccagttcctgcaccaagtcacccatctcgggctcgccgtggtgctggcggcggcctga

SEQ ID NO: 5847 - DNA, 1539 bp, Methylobacterium sp.
atgtccggcacgccgcactcgcccgccgccgaccgggtcgccgccctcctggccgacctgttgccgggcggccgcatcggcagcgtcgtggccggcgagatcctcgccgggaccggcgccgccctcgatctcaccaaccccgccgacggcggcgtgctggcaagcttcgccgatgccgggccgtcggtcgtcgaggccgccatggcggcgacccgcgacgcccagcgcgcgtggtggagcatgagcgccgccgcccgcggccgcgcgatgtgggccgtggccgccctggtccggcagcacgccggcgcgctcgccgagctggagaccctctcggccggcaagccgatccgcgacacccgcggcgaggtcgccaaggtcgccgagatgttcgagtactacgccggctggtgcgacaagctgcacggcgacgtcatcccggtcccgacctcgcacctgaactacacccgccacgagcccttcggcaccgtggtgcagatcacgccctggaacgccccgatcttcacggcgggctggcagatcgcaccggcgatctgcgccggcaacgccgtggtgctgaagccctccgagctgacgcccctgacctcgctggcgctgggcctgctctgcgaccgcgccgaggggatgccccgcggcctcgtctcggtgctggcgggggccggcccgaccaccggcgccgccgcggtggcccatcccgagacccggctggtcgtgttcgtgggctcggccgaggcgggcgcgcagatcgccgccgcggcggcccgcgccatcgtgccgagcgtgctggagctcggcggcaagtcggccaacatcgtgttcgccgacgccgacctcgaccgggcgctgatcggcgcgcaggccgcgatcttcggcggcgccggccagagctgcgtggcgggctcccggctcctcgtgcaccgctcgatccacgcgtccttcgtcgagcgcctgtcgcgcgccgccgcgcgcatccccgtgggcgcgccgaccgacccggcgacgcagatcggcccgatcaacaatcggcgccagcgggacaagatcgccgacatggtcgaggccgccgccgcggcgggcgccacgatcgcggcgggcggggcctgccccgccgccttacgcgacacgggcggcttctactacggcccgaccatcgtggacggcgtcgcgccggacgcggcgatcgcccgggaggaggtgttcggcccggtcctggcggtcctgccgttcgacggcgaggacgaggcggtcgcgctggccaacggcacgccctacggcctcgccggcgcggtctggaccggcgacggcgggcgcggccatcgggtcgcggcggctctgcgggccggcaccgtctgggtcaacggctacaagaccatcaacgtggcctcgccgttcggcggcttcggccgctcgggcttcggccgctcctccggccgcgaggcgctgatggcctacacccagaccaagagcgtctgggtcgagaccgccgccgcgccggccgtgaccttcggctacgtgggctag

SEQ ID NO: 5848 - DNA, 1371 bp, Methylobacterium sp.
atggcgggggaactgtttgcgacgaacacgcggccggtcgcgccgcccgtctcgggcgggggtaagctgacgctgttcctgctcgccctcgtcatcgtcgtcatcgcggaggcgatcggcaacatcagcatcccggtgggcgccggcaagatcgtgctgctcccgctgctctgggccctgctgctgggcggcgcgctggggctgatgagcccgcgcctgcccgcgccgctgcggctgtcgggcgccctgcagaacgcggccggtgcctacctgcagcccgcgctcctgatcttcatcgccaagctcggcctgctcgtcggcggctcgctgccgaagatcctcgcctcgggctgggccctggccttccaggaattcggccacttcttcggcacgatggtgttcggcctgccggtggcgctcctgctcggcatcaagcgcgaggcgatcggcgcgaccttctcggtcggccgcgagcccagcctcgccatcatcggcgagcgctacggcatggattcgccggaggggcgcggcgtgctggccgagtacctgaccggcacggtgttcggcgcggtgttcatcgccctgctggccgggctgatcaccagcctcggcatcttcaacccgctggcgctggcgatgggggccggggtcggctccggcagcatgatggccgcggcctcgggggcgatcgcggcccagcagacgcccgaggtcgccaaggacgtcgccaccttcgcggcggccagcaacctcgtgaccaccacgatcggcacgtacttcaccctgttcctgtcgctgcccttcacgatctgggcctacggcaagctggagccgatcctcggccgcaaccggccggacgccgcccgcccggcggccgccgacccgcaggcgccggcccatcagccggcccacgaggaggtgcggatcggcctcggcgagaccgtgctcgcctggatcctgatcggcgcctacgggctcatcggcaactggctgacctacggaatcgtcccggacgcgcaggtcgtcgccgggatggcgatcatcatcggcaccgtgctcgccggatggggcctctacctgctcctcggccggcggttgcccgccgtcctgtgggtgtcgatcatcggcatggcgctgacctatcccgggacgccctacgcggccgagatcgccgccctgaccggcaagctcaacttcctggcgctggccacgccgatcctgaccttcgcggggctctcggtcgccaaggacgtgcccgccttccgacgcctcggctggcggatcgtcgtggtctcgttcatggccaatgccgggaccttcctcggcgcggccctcatcgcgcagttcttcatgcacccgccgctggggtga

SEQ ID NO: 5849 - DNA, 531 bp, Methylobacterium sp.
gtgacgctcgtcctctgttcgctctctcggggagacgatgatcgtcccgacacttttgaacaggggcgcatcgtggctctgtcgggcgaccggtggcacgcgacagggggggcgaacaggcagcgatggaaggacatcggcgaaggcgcacgcccgcatgtcgtgctcaatgtggccggttgcaccatcgacgcggccaacaccggagacacaccgttgaccagccgtcccaagatcagctccgttccgatcgtccccagtgaggtcgaaggtactctcgaagctcccgtcatctacttcgaagccacatcgacgcatggcttcggaggaggcgtcggtcgcctcgctcttgagatgatgctctccgagcccagcgcggacggcactccgatcagtcggcgaaagatagtcgtacatctgcgcggcccgatgggggcgttcataagcctgaaagccgcgattgaacacattgaggaaatggccgccggcccgcttacggcggacatcgcggaagatgggaagcccaattga

SEQ ID NO: 5850 - DNA, 321 bp, Methylobacterium sp.
atgggcccgatttcgctcgtggacccgatcatgcccaaatcagctgcaagtgctccgaaacctaaggtcgacttcgtcgagggccataacgcacccatcatcagcttcgatgaggtgcccttcttcggctctctggatggcgtcggacggattaccatcgccgcgcaggtgttctctcagacgaacgatgacggcactatctcggccgagcacgtgatcaccgctcacctgcggggcagcctgcgggcgatggccaacctgcgcgacacgatcgaccagatgctcatggcggcgatgccagcggccccgggcgagcagtag

SEQ ID NO: 5851 - DNA, 291 bp, Methylobacterium sp.
atggccgattactacccgcttctggcccgcgcgctcgacgcgctgccggaccgaacgcccgccctgcgcaaggcggtctacgaccgcgcgcgcaacgccctgatcagccagctgcgctccctcgatccgccgctgtcggaggccgacatcgatctcgagcgccgggcgctcgacgcggcgatcgagcggctcgaggtcgatcacggcggcctcccggcccccgccaacgatgccgcgcaggcgcccgagacgcccgctccggccccggtttcgccgccggcaccggcaccg

SEQ ID NO: 5852 - DNA, 1155 bp, Methylobacterium sp.
atggcggccaaggatgaagcgacgtggcgggtcggcgtcctgttctcccgcagcggggtgagcggcatcaccgagaccgagcacttcctcggcaccgccctggcgatcgaggagatcaaccgggccggcggcgtgctcgggcgcccgatcgagcccgtctgctacgaccccgccggcgacaccgacgcctaccgcaccctggcccggcggatgctcgccgaggacggggtcgaggtggtgttcggctgctcgctctcggcgagccggaaatcggtgctctccaccgtcgagcggcacaacggcctgctctggtacccgtcgatctacgagggcttcgagtactcggagaacatcatctacaccggggcgaccctcaaccagaacgtcttcgccctggccgactacctgctgcaggagcacggcgaccggatcttcctgatcggctccgactacatctacccgcgggaatcgaaccgggtcatgcgcgacctgatcgaggcgaagggcgggaccatcgcgggcgagctgtacgcggccctcgacgcggacgacgcggcccacgccgccatgatcgcggcgatccgcgacgctgccccggacgcggtcttctccacggtggtggggcgcggcgccgagcggctctaccgcgcctacgccgaatccggcatcgaccgcgcccgctgcccgatcgcgagcctgaccctggcggagggccagatccgcgcgatcggccccgcgcactgcaccggccacgtcctcgcggcgccgtatttcggcgcgctgcccggcgaggagaaccggcgcttcgtcgccgccttccagggccggttcggggccgagcgccccaccagcatgtggtcggagaccgcctacgcgcaggtccacctcttcgcccgggcgctcgcggaggccggcaccctcgacgccgagcgcctcggcgcggcggccctgcggcagcgcctcgcggcgccggagggcgagctcgccttcgacggcgagacgcgccacatctggctcacccccggcatcggcgtcgcccgcgcggacgggcagttcgacgtggtctggcgggcgcggcggccggtgcggcccgacccgtacctcgcgtggtcccggttcgagacgaactggctggaggaggggctcgccgcgtga

SEQ ID NO: 5853 - DNA, 627 bp, Methylobacterium sp.
gtgaccgcccccgcccgcaagatcctggacgacctgcggcgcgcccgcgccctcgtcatccatccccgggacgaggaggccgccgcgctgctcgagcagctccgccgcctcggctgcgcggtctccctggcgtggccgccgcccgccgccctgccggccgacatcgacacgctgttcatccagctcgacgacgcccaggtgatgcacctgctcccgtcgatcgaggcgatcgagccggcggtcatcgccatcgtggcctacgagagcccgacctccctgaaggcgatcgccgacgtcaacgcccacggcgtgctcaacaagccgctccacccgcggggcgtgctcacccagttcgccctggcccgctaccggcgcggctacgagggccggctcaccagcaagatcaaccggctggaggagaccatgaagggccgccgcaccgtcgagaaggcggtccggctgctcgtggacctgaaccggatcgacgaggacgccgcctacaagatgctccgggaccgggccaccgccgcccgcgtgccgatggcgagcgtggccgagagcgtggtctccgcccacgaggcgatgagcggtctcggcctgcgcatcgcgttggcggaaaagacttga

SEQ ID NO: 5854 - DNA, 1155 bp, Methylobacterium sp.
atggtgaaatggtccctcgccggcgccgcggcgctcgccctcgccgccacggccgcgcaggcggccgatcccaagccgatcgtcatcggcatcccgatcggcctgtcgggcgccaacagcgtcgtcgccccctcggtggtgcagtcggccgagctcgccgtggaggagatcaacgccaagggcggcgtgctcggccgcaagctcgtcctggaggtggccgacgacgcctcgggggcggccggcgcccagaaggccttcgacagcctgatctaccagaagaaggtcgacgtcctgatctcgatggagacgagcgcggcccgcaacgccggcctgcccgccgtcaccaagggcaaggtgccgtacatctacacctcgttctacgagggccattcctgcaacaagaacatgttcgtggacgcctgggtgccggagcagcaggtgccgccggtggtggacgccttcaaggcgaagggcgccaggacctacttcctgatcggcagcgactacgccttcggccgcggcatgctgggcttcgccaagagctacgtcgagaagaccggcggcaaggtggtcggcgaggaatacctgccgatggacggcagcgactggacggcgatcatctccaagctgaaggaggccaagcccgacgcgctgatcacctcgacggcgggcggcgcgcccaacgtcacgctgaccaagcagctgcgcggcgcgggcgtgtcgctgcccttcgccaacctcgcgttggacgagggcaccgccaagagcatgggcgcggacgccgagggcgtctacctctcggcctcctacgtcaccgggatcgacagcccggagaacaaggcgttcctggcggcgatgcagaagaagttcggtgcggagctgcgcacgccgaacgacctctcggtgccggaatacgaggcgatctacctctataaggccgccgtcgagaaggcgggcgggaccgagaccgccaaggtgctggaggcgctcccgaccgtgagcttcaccgggccgcggggcacgatcaccatgagcaagcagcatcacgcgccgctgaccatgtatctcggccagatccagaaggacggcaccgtgaaggtcgccggcaccttcaaggacgtcgatcccggcgagcagtgcccgaagctgcagtga

SEQ ID NO: 5855 - DNA, 834 bp, Methylobacterium sp.
atgctgctcaccctcgacatcctgaccacggcggcgatcctgttcatcgtctcgatcggcctcctggcgatcttcggcgtgctcaagatcatcaacttcgcccacggggcgtggctgacggtcggcgcctactgcgcggtggtgaccgcccggctcggcctcaatccgtggctggccctgccgctcgccttcgtcgtcggcgcggcgctcggcgggctggccgagcacttcatcatccgtccgctctaccggcggccgctggacgcgatcctcgccacctgggggctcggcatcgtggtcggacagctcatcaccctggccttcggccgggacgtccagctcaccccgaacctctacgccggcaccgtcgagttcctcggcgtcgactactcggcctaccgcctcgtggcgctcggcatcgcgctcgcgatcggcacgctgttcgcgctcaccatcgagcggacccggctcggcctctcggcccgcgcggtgatcatgaacgagaccctggcgcgcagcctcggcatcgacacgggccgggtgcgcctcgtcgtgttcatgctcggcgccggcttcgcgggcctcgccggcgtcctgctcacgccgctcaccagcgtcgacccgaacatgggggtctcctggctgatcggcgccttcatgctggtgatggtcgccgacgcctcgtacctcgcgctcgcggcggcctgcctggtcttcggggccgcgcaggtcctgatcagcaccttcgtgagcccgatcctgggcagcatcgccgtcgcgttgctcgccgccctcgtgctgcggatcagcccgaaaggtttctcccgtgcttga

SEQ ID NO: 5856 - DNA, 1815 bp, Methylobacterium sp.
gtgcttgagaccctgcccgtcgccgagcgcgccgccgcggcgccccccggacgccgcctgtcccgcgccgcgcccttcgtggtcgcggccctggcggcgctggccctctggatcgcgccgctcgtcctcgacaccttcgcggtcaacgtcctgacccgctcgatgatctacgcggtgctggccgtcacggtggacctgctctggggcttcgcggggatcctgaccttcggccaggcggcgttcttcggcatcggcgcctacgccaccgcgatgatcctcgccgcctacggggcgacgccgctggggatcgccgcggccatcgcggcggcgctcgtcgcgccggccctgctcggcctcgcggtcggctggctgtccttctaccaccgctcgaccccgctctacgcctcggtgatctcgctcgtcgtcccgatcgtcgtcgtgcagctcatctacgcgggcggggaatggaccggctccagcagcggcctcgtcggcttcgacgtgctgcccttcgagaccgagggctatttccgcctcgcggccctgttcctgatcgccgtcacgctggcggcctggatcctggtccgggccgatgccggccgcgccctcgtggcgctgcgggacaacgaggcgcgctgcgcctatctcggcctcaacccgcggcgcctgcagatccggctgaccgcgtcgctcgccgcggtggcggggctcgcgggcttcctgttcgccaacgcctcgggcgtggtcgcgcccgagaatgccggcttcctgttcggcaccgagctggtcatctgggtggcgctcggcggccgcggcacgctgctcggcccggtgctcggcaccgtcgcgatcgactacctcgcggcgaacctgtcgggcgacctgccgttcctctggcagctcctcctggggtcggccttcgtggtcatcatcatcctgctgccgggcggcctcgccgacctcgtcggccgcctctggcgggcgctgccggtgggccggcgggagccggcgccgccgcgcctcgtcgcgcgcgcggccggccccgaggcggccggcaccgaggcgaccgggaccccgatcctcaaggtcgagaacctcgccaaggcctacggcgccctgacggtgctggagggcatcgacctcgagatccgcgcgggcgagctcgtcagcctcgtcgggcccaacggcgccggcaagaccacgctgatgcgctgcctcagcgacggcaccgagccgttcaagggcgcgatcgccgtcggcggcacgccgatcaccgggctgacgccgaaccggatcgtcggcctcggcgtcgggcgcaagttccaggtggcgagcgtgttcgagagcctgtcggtggccgattgcctccgcctcgcccgggcgtcccacgacggcctgagcccggtcgggcgggccgagacgctgggcctgccgcagcccgccctcgacgtcctgcgcatgaccggcctcgaccgacagctgacgcagccgacgcgcctcctgtcccacggccagaagcaggcgctggaactcgccatggtggtggcgctggagccgcggctgatcctgctcgacgagcccaccgcgggcctgaccaaggccgagcgcaccaccatcgggaccgttctgaaggcgctcaccgccgagggccggatcgccgccgtgctggtcgagcacgacctcgacttcgtgcgcgagatctcgtcgcggatcgtggtgctgcaccagggccggctcgtcctcgacggcaccgtggaggcggtcgtcggctcggagctggtccggaccatctactcgggaggcggccatgggtga

SEQ ID NO: 5857 - DNA, 702 bp, Methylobacterium sp.
gtgggggccgctctcgccctcgacggggtgtcgagcggctacggcgccgtcgccatcgtgagggacgtgtccctctcggtcggagcgggggagatcgtggcgctgctgggcaagaacggcatgggcaagaccacgctgctcaagaccgtcctgggcatggtggccctgcgcggcggcgcgatcacggtcgggggccaagcgctggccggcctcacgccggccaagctcaacgcgctcggcgtcggctacgcgccgcaggagcagcccctgttccaggacctgtcgatccgcgacaacctgcgcctcgcggtgccctccgaccggatgctgcccgcggcgctggagcggctgttcggccatttcccgttcctgaaggacaggatggcccagcgggccggcaccctctcggggggcgagcagaagatgctgatcctcgggcgcgccctgatgctgcggccgcgcctcctgctgatcgacgagatctccgagggcgtgcagccctccatggtcgagcgcctgcgcggcgtgctccaggccgagcgggccgcgggcgtgtccatgctggtggtggagcagcacgtcgccttcgcgctggcgctcgccgaccgctacgccgtcctcaagctcggcgagatcgtcgacagcggtccggcgcaggcgccggacgcgcgggcacgcgtcatcgaccatctggcggtgtga

SEQ ID NO: 5858 - DNA, 810 bp, Methylobacterium sp.
atgaaccgccgccacgttctcgccctcgccgccctctgcgccagcctcggcgcagggctcctcgccgcccccgcgacccgcgcggccgagggcaagctggagctgatcgagcccggcaagctgatcgtggcgacggacagcaccttcgcgcccttcagcatgcgcacgccgaacggcgagctcgacgggctggaggtccgggtcatgcgcgaggtctgccgccggctcgggctcgagtacagcccggtcaacatcaagttcgacgccctgctggtgggcctgatggccgatcagtacgacatcaccagcgagtcgatggacatcacccccgcccggcagaagcaggtcgccttcgcggacgggtggctcgaatccggcgcgcggatcgtgacccgcaaggataccggcatcaaggggccggcggatctcaagggccgcaacgtcggcgccctctcggcctcgaccttcggcaagctcgccgaggagaacggcgccaccctgaagagctacaagacggccgcggacgccatgcaggacctcgtcggcggcaacatcgacgcggtgatcaacgacgcggtggccggcaactacgccatcaaggcgcgcaagctgcccctggtgatgatcgagacaccgctgagcacggtccagaagggcttcgccatcaagaagggcaagccgaacctgcacgccgccgtcaacaaggcgctcggcgagatggtcgcggacggtacttacgccaagctcgtcaccccgctgatcggctatgatccggccccgaaggagccgatccgcacgcccgccatgtga

SEQ ID NO: 5859 - DNA, 681 bp, Methylobacterium sp.
atgaagaccctcgacgccgcgtcgtacacgacggcgctcagtgcacggcgcgagcagagcctcggccagatggcctacgaccggctgctcgacatgctcgtccgccgcgaccttccggccggcaccgtgctgcacgagcgccgcctcgccgagatgctcgacatctcccggaccccgacccgcgaggcgatgtcgcggctggagaccgaggggttgatcgagcggcagcccggcgggatgctcgtggtcaaggaattctccctgcgcgagctgatcgagatcctgcatgtccgccgcctgctggagcgggagagcgtcgcgctggccaccggccggatcgccgacgcggtgctggcggacctgcagcgtcagatggaggcgctcttggcggcgggcgacccggacgcgccgggcaactgggaggtcgaccggcgcttccacgacctgatcgcggagcacagccacaacgcgaccctcgccaagacgatcaaggacctgcggctcaagacgcagatgttcaacctgagccggatgcccgagcggttcgaggcggtccatcgcgagcacctcgcggtggtcgccgccctgcgggccaaggacgcggcggcggcggcggacgcgatcgcggcccatctcgagaatttcaagcagggcatcatccggcgcctgagcgaagtctga

SEQ ID NO: 5860 - DNA, 1737 bp, Methylobacterium sp.
atgggcgaggatcaggtgcaggcgctcgaacgcgctcaggccggtccgcaggatctcgcggcgctcggcggctcgccggtcgaccggctgctgtatgaccggagcggcttcggtagcggccccaacgggttcaccggctcggcggacccttacgggtcacgcaacgtgccgatgccgccctcgcggccgtcggacgccgacctgctggctgccccgacagcgacgggctccctgtcgtccccgcgccggccgaccggcagctcgatcgtcgctccggcgccaggagtgacggcggccgacaccggcaaccctgcatcaagcaacctgcagccggtgaacagcttcgaccccctgacagggcaaccggtctcgggctcgccgaagctgatgcaggcgcccggcatgggcggccccgcgaatggcggcggacagatgccgtcagcgggcggcgcctcccagggtgggagcttcctcgagcggttcgcgcagggcctcaacaatccggccgtcggcaacctgctgctgaacgtgggtatcggcctcatgtcgaaccgcggcttcgggccgggcatcgcggcaggcttgcagggctaccagcagagccagacggggtcggtgaagtcgcttctcgagcagtacaagctgcaacaggagatccagggccagcaggccacgcgcgccttcctacggagcaagggcctatccccggctgccatcgaggccggtacgctcaacccgtcgctcctggcgcagatcaacaaggactcgcagcagttcacggtcggcggcaacgtgttcctcgggcgtccagatcaggacccgtcgacctggcagaagctcgggccgagcgccggcccgccgagcggctaccgcctcgcggctgatggccagagcctggagttcatccccggcggtgaggccgacccggccgtgaaggagcggaacgcgaaggctgtcgccaccgacaaggagcagaccccgctcctcgacatcgaggcccgccgcaaggtcggcatccccgacaacgacacgcgggcagcctgggcagacccgaacgggaaggtcacgttcaacgatggcccgccgctaatccaggggcgtccggggcagaccgtctacgagcgcggctccctccggccgctcctgaccgtgccgccggccaagcccgacggctacgacacggagacgaagctacggggcgagttctccaagcagctcggcagcttcgcggacgtgcacgacggctacggccggctgatcgcagccacgaagcagcggcaggagaaccccggctccgtctcgccggcctccgacatctcgctgatcttcgggtacatgaagatgctcgatcccggctcggtggtccgcgagggcgagtatgcgacggccaagaatgcggccggcgtccccgagcgggtggtgaacgcctacaacaaggccctgaccggcgaattcctgacggacacccagcggcgcgatttcctcaaccaggcgtccgagctgtacggtaccgcccgcaagaccgccgagggtgtggctgaccgctatcgcaacctcgccacgtcctacggcgtcgaccccggccgttcggtctacctgccggacgcgccgacccctccgaagatcgggcagctgagccagtccagcagcggtgccgcggctcgcttccaggcgctgatgaacagcggcatgtcgaaggccgacgccttcgcgcagatgcgcaaggagggcctgtaa

SEQ ID NO: 5861 - DNA, 1113 bp, Methylobacterium sp.
atgcgcctgagcctgtccgcgctgctgatgatcgcctgcggcacccaggccgccctcgggcaggcggcacccgcggagcgggccgtgccgcgcttcgcccagctggaggccgagatgggcgcggccaacgccgccccggggccgcggacggtgccggccaaggtcgtgcccgtccccgacacgacgagcccgcaattccgcagcgcggtggcggcgccctaccgggtgccggcctggaacgcgaacccgccggacgccgcggcctggaaggcgctggtcgacaagctcgctgccgccggagccgccaccctcccggcgctccgcgagaagctgggcgtcaccagcgaggccgcggtgatcggcggcgtgaaggccttcgtgatccagccccggcagatccccgaggccaaccgcgaccggctcctcctgcacatccacgggggcggctacgtctacaatcccggcgaggccggaacgctggaggcgatcctgatggccggcctcggcggctacaaggtcatctcggtggattaccgcatgccgccggacgcgccctacccggccgccatggacgacgcgaccgccgtgtggcgggccatgctgtccatgcagaagccgcagaacatggcggtgttcggcacctcaacgggtggcggcatgacgctggccctgatgctccgcgccaaagccgaggggctggcgctgcccgcggcgatcggcctcgggacgccctggtcggacatgaccgagaccggcgacagctaccggaccaacgagtggctcgacaatgtcctcgtcagctactcgggctacctgacgccggccgccaagctctacgccgccggccgcgacctgaaagacccgcagctctcgccgatctacggcgatttcgccggcctcccgcccgcgatcctggtcaccggcacccgcgacctcttcctgtcgaacacggtgcgcacccaccggaagctgcgcgccgccgggatcgaggcgtcgctgcaggtgttcgagggcatgtcccacgctcagtacctgttcacgccggactcgcccgagaccagggaggtcttcggagagatggcgcacttcttcgacgatcatctgggtcgctga

SEQ ID NO: 5862 - DNA, 159 bp, Methylobacterium sp.
ttgcgcaagattgccgagatccggttcctggcggggatcctgcgcgagtcggtgcgtccgttcccgatcgcgcccctgcggacggtgctgcgcgtgcgcgaacggatcgacgcgcgccgcgcggtctcccccgaggccgcggatctcgatgccgtgtga

SEQ ID NO: 5863 - DNA, 306 bp, Methylobacterium sp.
gtgattctgtccgcgggtttggagcctgaggaggatgggacggccgctctcgtgccgctgcggccagactttgatgccgcggccctgcgaacgctggccaagagctcgcgcgatccggatcagacccgccgccttctggctctgtcggcgatctacgcgggcagtctgcgctccgaggcggccgctctcggcgggtttgggcttcagaccgtgcgggactgggtgctcgccttcaacgctgagcgacgtccccccatcgctttggtccggcgtgagtgcgagttttccggtttcgtgagcccctga

SEQ ID NO: 5864 - DNA, 636 bp, Methylobacterium sp.
atgcaccgcaggaccctgctcgccctgatccccgccgtcgcgcttgcgcccgccctgccgccgctgatgccccatgccggggaggcttttgcccaaggcatcgacccgaacgccatcctcaacgacccggaggcgccggtctcgggcaacccgaagggcgacctgaccatcgtcgccttcctcgattacaactgccccttctgcaagaaggccgagcccgacctgctccggctggtgaagtcggacggacgcatccgcctcgtccacaaggactggccgatcctcggcgacgcctccgtctacggcgcccagctcgccctcgcggcgaagtaccaggggcgctacgacgacgtgcatcgcgcgctgatgggcatccccggccgcaagatcccgaaggagcggatgctggaggcggtgtccgactcgggcgtcgacatggcccgcctggaagcggaccggacgacccatcagggcgagatcgccgccctgctccagcgcaacctcgaccaggcggacgccctgggactgcagggcacgccggtcttcctcatcggcccgctgaaggtcgcggccgtcctcgactatgacggcttcaagcaggcggtcgcccaggcgcgcgccaagggtcgctcgtga

SEQ ID NO: 5865 - DNA, 714 bp, Methylobacterium sp.
atgagccccgcagacgctcttccggggaactttccggcgcaccttccggcgaaggacgcctacgcgaccgaggcgatctgcacgcggatcctggcgcggcaccgggaccggatcagcgtccggaaggaccacgtcgccgtcgccaacctcgcgcggatcatcgaggcggtgctgaagctgtcgagccggcagggcttccacgagacgagcctgcgcgatctcgcccgggcctcggggctcagcatgggcgggctctactcgtacttcgacaacaagaacacgctgctggtgatgatcctcaccgaggtggccgagacggccgaggcggtcctgcggcaggccccggcgaggctcgcggcggatccggccgcgcatctgcgctggctgatcgagacccatatccgcctgaccgaggcgatgcagccctggttcgtcttcgccttcatggaggcgaagggcttcccggcccccgcccggacgatggcgacggagagcgaggccgccacggagcgcatcttcgccgaagtcctcgcccgcggcgcggcggcgggcgtcttcgcggtcgccgacgtcgacctcaccgccgcgctgatcaagccgctcctgcaggactggtacgtgaagcgggccaagcaccggaagcgcgggatcccgatccagcgctacatcgccggcgtgaccgccttcgtcgagaaggccatcgcggcgggctga

SEQ ID NO: 5866 - DNA, 1140 bp, Methylobacterium sp.
gtgcagcacgacctcatcctgaagggcgcgcgggtcgtcgacccgtcgcagaaccacgacgggatctgcgacgtcgccttcgcggacggccgggtctcgggcttcggccgcgaccttcaggccggcccgggcacgcaggtgcgcgacatggaaggcgcgatcgtcacgccgggcctgatcgacctgcacacccatgtctactggggcggcacctcgctcggcatcgacgccgacgcattctgccggacctcgggggtgacaacctcggtcgataccggcagcgccgggcccggcaatttcgcgggcttccgcagccacgtgatcgagcggtcgcaggcgcggatcctcgcgtacctgcacgtctccttcgcggggatcttcggcttctcgaagaccatcatggtcggcgagagcgaggacccgcggctcatggcgccccgggaggcggtcgaggtcgccgacgccaaccgggacgtgatcgtcggcatcaaggtccgggtcgggcgccacgcctcgggcgaccagggcaccgcgccgctcgacatcgcgctgcaggtcgcggaggagaccggcctgccgctgatggcccatatcgacgagccgccgccgagctacgagcaggtgctggccatgctgcggcccggcgacgtgctgacccacgcgttccggccgttcccgaactctcccatcacggcccagggtgccgtgaagccggcgctccgcgaggcgcgggcgcggggcgtgctgttcgacatcggccacggcaagggctcgttcgccttcaagacggcgcgggccatgctggccggcggcttcctgccggacacgatctcgtccgacgtgcaccagctctgcatcgaggggccggccttcgatcaggtcaccaccatgtcgaagatgctctgcctcggcatgagcctcaccgaggtcgtcgccgcctccacggtgaacgccgccgtggcgctgaagcggatggagtacgggaccctgaaggtcggggcgctcggcgacgccaccgtgctggcggtgcgggacggcgcgttcgactacgtcgacacccgcggcgagcacatgacgggcgaccggcggatcaccgccgagggcgtggtgctgaagggccggtggtggcacccggcctga

SEQ ID NO: 5867 - DNA, 252 bp, Methylobacterium sp.
atgcgcacgatcctcatcctcgcgtcggccgcgctcacctcggcggccttcacgggtctcgccgccgccgacgaccgcctgcacctgacgccgccgctctatcgcgaccaggcccgggccgcccagcagatccgcgcgatccacgatctgaccaccacgccccagcccgtcgccgcgccggcgaccgtcaatcggacgatctcgtccctcggccggccgatcgtccaggccgccgtcgaggcgagccgctga

SEQ ID NO: 5868 - DNA, 2049 bp, Methylobacterium sp.
gtggtgacgagtcccggcggggcgaactcagccaaggccgcggactggaggccgctcagcggtcggcaggtgatgatctggccggacaacgatgtccccggcctcacctacgccaccgatgtcgagcgcgagttggccggcgtcggtgccggcactgtcaccatggtcgacgccatgcgggtcgctgcggttcggttcaacggcgaagaccgcaagccgatcgagggctgggacgccgctgatgccctcgatgaggggtggcaaccagaagccatcgctactctggtcctccagcacgttgaccgcgtcgagccgtcgccggcctacgtctccttcgaccgcttcactatgaactcggatgggctgacggcggaagtcaccaagggccgtggcgagagcgtcactacagaggacgtgtggatctcggccccgttcgaggtgattggccgcgcccgtgatccgaatggtttcggctgggctcgttggcttcgctggcgtgatccggacggccgccgtcatgaacatgccgtcaccgatgccgcccttcacggagatcttggcgcactcgctgccgatcttgccacacgggggctcgttgtggcccgcagcggccgcagccagctctgcgactacctcaatcgcgtgatggtaagagcgcgggtcaccaccgtgagccggactggatggcacctcatcggcgagcagcgggtgttcgtcctgccggacgcggtgatcggtcaacccgatggcgagacggtagtcctgaccggcgcaaccgcggcaccctattcgcggaagggcacgctacaggattggcgtgacggtgtcggccggctgagcaccgggcatgggcgcctcgtccttgcgataagcaccgccttcgctggtccgcttgtcgatctcgtcggcggtgagggcggcggggtgaacctctacggccagtccagtcgcgggaagaccacggcgttgaaggccgcagccagcgtttggggtcgtggtgcttccgatcccggatttgttcggtcctggcgggcgacagccaatgcccaagaagcgacggccgcgatcgtcactgacacgctgctctgcctcgatgagatcggagtcgcggaaggccgggatgcggcggcggccgtctaccagttggcttccggtgtcggaaaggggcgctccgcccgggacggctcgatccgtgcgccgatgacttggcgggttctgacactctcgaccggcgagttgccgatggcggctaagatcgcggaggacaagcagcgcaaggcctatgctggccaggcggtgcgtctgctcgacgtgccggcagatgctggccgcggctatggcctgttcgacaacgccggccccgacggcgaccctgctcgcttggctgaagcactacagaagtctgcactgctggcttacggcgaggctggccctgcttttgtccgcgccttgatggatatgggtcaggaagaagcccgggcgctcgtcgtcgacctcgtggaaagcttcgtcacggagtacgcgcctgccgatgcggacgggcagatccggcgtgccgccgcgcggttcgggttgatcgctgcggcgggtgagttggcccggaccttcaacatcgtcccatgggaggaaggtgaggcagaggctgccgcggctcgcggtctggcagactggatcggttcgcgtggcggcaccgagccggccgaggttcgggaagccattacgcaggttcgccggttctttgaggcccacggtgacagccgcttcgagaatgcagacgaccccgatgcccgtccggtcccgaaccgcgccggctggcgccgtggccatggcgacagccgtgtctggctcgtcctgccggagatgtggaagtcggaggtctgcgtcggcctcgatccagtagcgacagccaagatcctggccgagcgcgggatgctgaagcgcgatccgaatggcagactgcagcggtcggagcggaccccgggcggcgcgacgctacgggtctacgtgctgacctcggcggtgttcgacggaggctccgatgcgccctga

SEQ ID NO: 5869 - DNA, 1821 bp, Methylobacterium sp.
atgtgcgtcgcgtgtgactgggcaccccatttccaggccttcgggggcgggcgcgccgtcaatcggcgcgcggtgctgcggtcgggcgcggccatcaccgcgacggcgctcgcgctggacctcgtcccgacgggcgcccgcgccgaaccggggagcggccgcgctgccgccacggggcccgccgacgtcgtgttccacaacggccccgtctacacggtggcggggccggccccctgggccgaggcggtcgcggtgcgcggcaacaccatcgtccatgtcggtgacgcggccggcgcgatggcgctggccggcccggtcacgcaggtggtggatctccagggccggctgctgatgcccggcttcgtcgagggtcacacccaccccttcctcggcgcgttcctgacgtccggggtcgacctgcagcgcgagaacctcgcccagatcctcgcggccatcgaggcctacgcgaaggcgcatccgaccggaccgatccgcggcttcgggtggcgcgtcgacatgtttcccccggagggccccaaccgggccgaactcgacgccatcctgccggaccggccggccttcttcttcgccatcgacgggcacagcctgtgggccaattccaaggcgctcgccatggccggcgtcgaccgggacacgcccgacccgatcccgcgcttcagctactacgcgcgcgaccagaagggcgaccccaccggctacgtgctcgaggtcaacgcggttctcgggctggtcaacgccgtggaacccatcagcgtcgccgccatgggcagcctgctggaaggctggctgcccaaggccgcggccgccggcatcaccacggtcttcgacgcgggcgtcccgcccgtcggcagcgatcaggccgccatcatcgcgctctacgtggaggccgagaagcgcggcacgctgccgttccgcgtctccgcctcctactctgtgaagtcgctgccgatcgacgacacggtcgagcagttcaacgccgtgcgtcggcaggtctccggcgaactcgtgcacgtcgacatcgtgaagatcgtcggcgacggctcgcagggcggctacacggcgtggctgatcgagccctacgccgacctgcccgactcgaccggagggtcgcccttcaccgaggcgcagtggcacgacctcgtcggcgcggtcgacgcggcgggcttcgacgtccacgtccacgcctgcggcgagcggaccgcccgcgtcgccctcgacgccatcgagaaggccgtggcgcacaacccggcccgcgaccggcggcacgccatcgcccacctggtctatgtcgaggacagcgacgcgccccgcttcgcccagctcggcgtgaccgcgcagttctcggccaactggtcgtcggccgaccccgacacgctgcagaacatgatggcgcgctacggcgcgcaccgcgccagccggatgtaccggaccaggacgatcctgaagcagggcgggcgtgtctccttcggcacggactggccggcggccggctacgtctcgacctacgagcccctcacgtcgatccaggtcggcgtgacgcggcagctggtcggccggccggacgcgcccgtgctgagccccgccgacgagcgcctgacggtcgcggaggcgatccaagccaacacgatgggcgccgcctaccagctccgcatggacgacaggatcgggtcggtggaggtgggcaagcgcgccgacctggtcgtcctcgaccgcaacatcctgacgatcgacccgcacgagatccaccggaccaaggtcgttctgaccatgatggacggcgtcgtgcggcaccggacctga

SEQ ID NO: 5870 - DNA, 273 bp, Methylobacterium sp.
atgatccgcggattcctcggtaccgcgacgctcggtgcgctgagcctcgccctcatcagcccgctcgcggcgcagacgcgggcgcccgaccagaccggcacgggcggcggcccggcctcgaccatcacggcgctgaacaccaacagcctcggcgtcaccaagccgcccggcacgtccctcggccccggcgaggtgccgacccccgagcagcggcggcgcgagcgcgctctgaccgacaagatcgaaggcagcatctgcgacggctgcaactga

SEQ ID NO: 5871 - DNA, 543 bp, Methylobacterium sp.
atgacgaccctggcgcgggcgcgcttcagccagctcgttctcccgcgcctggacgagggctaccggctcgcgcactggctcaccggcaacgccaccgacgccgaggacgtgatgcaggaggcgtgtctgcgcgcctaccgggcgatcgaggggttcgccgagggcaatgcccgggcgtggttcctgaccatcgtccgcaacaccggctattcctggctgcagcggcaccggccgcgggcggtggtcttcgccgacgacctcgcccccgaggctcgcgccgagctggagatcgggggcgccctgaccgaggccccggagacgcccgaggcgaccctcatcgcccgcgacgacgcggggcagctcgcccgggcggtcgaggccctgccggtggccttccgcgaggcgctggtcctgcgcgagtaccacggcctcagctaccgggagatcgccacggtgacgggggtcccgatcgggaccgtgatgtcgcgcctcggccgcgcgcggcagcacctgcttgcacggctcgcgaaggacgggcgatga

SEQ ID NO: 5872 - DNA, 819 bp, Methylobacterium sp.
atgaccgacgacgagaccctcctgctcctcagcgcctacgcggacggcgagttgtcgcccggcgaagtcctggccatggagcgccgtctcgcggcggatcccgaggcgcgagccctggcggagcgcctccgcgacctctcggccaccctgcgcgggaccctcgcggggccgcccgccccggaatccctccgggcgcgcgtgatcgagcagatcggcttcaccgacccgcccccgtcccgcagccgcctcggaggcccgctcgggtcctgggtcgaggcctggctcgaatcctggcgcggatcccggcaggcgatggccgcgacgctgctcgccggcctcgtcggcggggccgcgctcggcggtgcggtcgtctatctcgatcgccccgacggcgccccggataccggtgcggccgtgctcgccggccatctccgcggcctcgcggcgccccagcccttcgacgtcgcctcctcggaccggcacgtggtgaagccctggttcaacggccggaccaccctcgcgcccgaggcccccgacctgtccgacaagggcttcccgctggtcggcggccgggtggacatcgtcggcggaacccccgtgccgaccctggtctatcgccgcgaccggcacgtcatcagcgtcacggtggtccccgccgccgacggccccggcgctggcgaggagcggcgcgacgggtccacgatcaagcgctggcgcctcggcgacctcacctactgggcggtctcggacctcaaccggcgcgacctgcgcgccttcgccgacctgtttcagtcccggaccgggggcccgccgggatga

SEQ ID NO: 5873 - DNA, 399 bp, Methylobacterium sp.
atgaacgtcctgatcctcgtcgtcgatgacgaacccgacgtgacagacctgttccggcagcagtttcgccgcgagctgcgcgccggacgcttcgcgatggccttcgcgcactcggccgcggaggccctggagcggatcaacggctcgaacgagccgagcctgatcctgatgctgtcggacatcaacatgcccggcatgaccggcctggaattgctgccgctggtgcgcgcggcccggcccgacgtgccggtgatcatgatcacggcctacggcgacgccgacacgcgcgagaaggtccgcgccgccggcgccgtgggcctgatcaccaagccgatcgacttcgccgttctgaaggccgagatcgatcgccgtctgtccgccttcgcggggaccgaatga

SEQ ID NO: 5874 - DNA, 240 bp, Methylobacterium sp.
atggttgcagggctggcgaatacggacgacgtcttcgagacgctgctccgacggacgatcacggacttcgtgatcggcggtatggaccacgggatcccggacgaggacggcctgatcgtccgcctgagacagtacgagcagcgggcgcgccaggagcagctgagctcccagacgctccaggtcatctcgtcggcgcggcgccttctgggcgactggacggaggccggccgggcgtcctga

SEQ ID NO: 5875 - DNA, 642 bp, Methylobacterium sp.
atgcccgcacccgcaccggtcgtcgccgacgcccgcgcccgctacctgccgctcatcgcccgcgaggccgccggcaccggcctgcccctcgcggtggccgacgccgtcgcgcggatcgagagcggctacgaccccacagtggtcggcagcgtcggtgaggtcggcctgatgcaggtccgcccgaccaccgcggcgatgctcggcttccgcggcaccgtcgccgagctggcgtcgccggagatcaacgtccgctacggcgtccgctacctcgccgaggcgtggcgccgggccgacggcgacctctgccgggccctgatgaagtaccgggccggccacggttcggaggcgatgtcgccgctgtcgcagctctactgcgcccgcgcccaggcgattctcggcaacccggaggcgcgcgtcgtccgggcgagcgcccgcgcggccgcgccggaccgcctcgccgcgcgttcggcgggccccgtccaccggacgcgcgtcgccgccgtcccggcgaagccgatgtcgttctgggaggcgcaccgggcgcgcatcgcccggctcaacgccgccgtggtgtcgcgctggcgggcgcgcggctggtcggccgcgcccgacgggtcctccggcgagccggccggcggctag

SEQ ID NO: 5876 - DNA, 1272 bp, Methylobacterium sp.
atgccgatcgtgctcaggcccgacggcgtcccggcgctcctcccctggctctggctggatctggaactgcgcgaccgaggcctgcaggctggaacgctcagagcctacgcgggagtctcctgcctactggaggactggttcgccctcagaggggtcgattgcacggctaggttgaggaaccagcagtcgttcgaggactgggaagtccgcgacctacggaaccacctctacagactcacgccggctggagcgcgcgtgcgtcggcacgccatcgcgaagcgcgaccgtctcgtcgaagaaggacggcgcgaagtcggagaggagcccatccgactcctcgaaggcgtggtgtcccaaccggtcctgaaacaacgcatctccgtcgccgcgatctatctacgctggctcgacgaaaccctgtcacgcatgatcttccccgatcctcgacagagggcggaggccgagcatgtgttgacgcacctcgccgacggcctctgcgagctcaaggtccgtgccctggaagttcgacgcgaaggcttggccctccaccaacagaaactactcctgtcggccattcttcccccgcccgccgaccagccccaaacccgtccgctcttccacgaaagcgtccgccatcgaaacttcgccttcatcctcctgctcgcgtcgaccggactgcgtatcggcgaggctctcggcctcaagatgcaggatgtcgtgcttcagaacgactggctgagcgtaacagtccggcgtcgacccgacgacccggaggatccccggccgcgacgcccgcaggcgaagacgctggagcgcaccatcaccctccctcacgtcgccgcggtcgccctactcgactggtgcgacttccaccggaagatcgagcggctttacggcccagagcacggatcgccgttcgtgtttctggcctgcaatatacacgaggccgctaacttccccgctactccgctcagtctggccggcgcggataagatcttccgggatctgcgggaaagattgccacctgaagcaggaaacgtcaccgcccaccggctgcggcacagctggatggaccacctctggacgagtctgcgcgcggccggcccccaggatccgttcgtgatcgacgtgatcaactatgccgcgggctggcgcccgggttccggtcaggcccaggcgtactcgcagcgagcccagcgcgaagctgccgacggtttcgcggcgatcttccagaagcaactcgtgtccctgctcgagcctgatcgcaaatga

SEQ ID NO: 5877 - DNA, 1329 bp, Methylobacterium sp.
gtggcgtcctggatcgaacaggcagtctggtggcaggtctttcccctcggcttcgtcggagcccccgacgaagccgacccggccgcaccggtcacgcaccgcctcgcccacctgcacggctggctcgactacgcggtcgagctcggcgcgtccgggctggcgctcgggccgatcttcgcggcctccacgcacggctacgacacggtcgaccatttccgcatcgatccgcgcctcggcgacgaggccgatttcgacgccctggtcgcggcggcccgggcccgcggcctccgcgtcctgctcgacggcgtgttcaaccatgtcgggcgggcgcacccggccttccaggacgtcctccggcacgggcccgaatccgagcgggccggctggttccggctgacctggccgcggggctccgggccgggcatcgagccggactacgcctgcttcgaggggcaccggcagctcgtcacgctcaaccacgacgacccgcgcgtcgccgaccacgtcgccgccgtcatgggccactggctcgcccggggcgccgacggctggcggctggacgcggcctacgcggtgccgccgcgcttctgggcgcgcgtgctgcggcaggtccgcctcgcgcatccggaggcctacatcgtcggcgaggtgatccacggcgactacgcccgcatcgtgcaggacaccggcatggattcggtgacccagtacgagctctggaaggcgatctggagcgccctcaacgatcgcaacctgttcgagctggcccacgccctggaacggcacaacggccttctcgacaggttcgcgcccctgaccttcgtgggcaaccacgacgtgacgcgcatcgcgagccggctcaccgacgagcggcacctgccgcacgcgctggcgatcctgctgacctgcggcgggacgccctcgatctacgccggcgacgagcaggccttccgcggcgtgaaggaggagcgggtcggcggcgacgacgccatccggccggccttcccgccgacgcccgcggatctcgctccctacggctggccggtctaccggctgcaccgggacctgatcgccctccggcggcgccacgccgggctccaccgtgcgcgggcgcgggcgctgcacctcgccaacgcgcagatcgtgctcgcgctgggcgacgggagcgcgcgggtgctgacggccctgaacctcgccgacacggacgcgacgctgccggcgccggaggcccgggcgatcgaagccggcaccggcgatctcgccgaggccggcagccccgacgcccgcgtgacccttccggcccacggctgggccgtcctggccgtgtga

SEQ ID NO: 5878 - DNA, 510 bp, Methylobacterium sp.
atgtggggcaccgacctgaccaccacctggacggccgagggacaggtcgcggtgttcgtggccatcgatcaccgctcggccgagtgcgtgggcatccatgcggcgcgccgggccacgcgcttcgaggcgctggagccgatccgccaaggggtgcggcagcgcttcggtggcttttcggccgagatcgcctccggcctgagcgtccggcacgatcacggcagccagtacatggcggacgccttccaggcggagctcgcgttcctaggcatcgcgagttcgcccgccttcgtgcgcgccccggaggggattggctgcgccgagcgcttcatccgcaccctcaaggagaacctgttgtgggtcgagcacttcgagacggtcgaggatctgcgccacgcgctgctggcgttccgggatctctacaatgagacgtggctgatcgagcgacacgggttccggccaccggccgatatttgcgccgcgcagctaccacccgcggccatcgccgcgtag

SEQ ID NO: 5879 - DNA, 246 bp, Methylobacterium sp.
gtgaggaaactgaccttcgccttcgccgtgctggcctcgctcggcggcgccgccctcgtccagccggcctcggctgcccccgcgatgcccggcgccgtgtcggcgcccgacgcggtgacgcacgtgcggatgacgcccatggagcggcgcatgatgcatcgccgcatggagcgccgcatgatgcaccgccgcatggagcgccggatgatgcatcaccgcatgcaccgccgcatgcaccgcatgtga

SEQ ID NO: 5880 - DNA, 2838 bp, Methylobacterium sp.
atgtcggccgagaccatcaaggcgctctcgcggcgccacttcctgaaggccggcgcggcggcgggcgtcgccgtgaaggtctccttcctggcgcccccggcccgggcgcagctcgccgagaccggcctgtccgccggctccccgtgggccgcgccgggccggccccgctaccgcctcgacgccgtcgccaaggtcacgggcgccaagaccttctcccgcgactaccgggcccgcgacctcgccggctggcccgacggccaagcccacgccttcctcgtcgcggcgacccgcgccgaccgccgcttcaccggcctcgacctgtcgcggctcccggccgccctgcggccggaccggatcgtccggcacgaggacctagtggcggacggggtctcggtcccgcacgccgacttcttcggcgactggttcctcgtgccgcagggcgagacgccgcgcctgctcgggcagccggtggcgatcctgatctacgccgacttcccgcgcttcgccgcggccaagcgcgccctgcgcttcgccgacgacgtcgtgcagtacggcgccgagaccggtcccaggccgccggcccattacggcgcctcgcgctgggtgcggatcgagggcgacgcgccggacgcgcccgaccggttctcgccgttcgcgcagtccccgatcttcgccggcttctccggcgacgagcccgcctggccgaaggccggcgacgacggccccttcgcccggggcatggcggcggcggccgccatcgccgccgagatcgacggcaccggcgcggacgccctggtgatgcggcggacctaccggtcgcagtcgacggacgcctcggccatggaggccgacaacggcaacgtctggtacgatccggacaccggcacgctgcgcctgatgatggcgacgcagtcgccctacgacgtggccgaggccgccgccgcgctggtctcgaaatcccggttcccgctcagggaggtcgatctcaaggtcggctacacggtcgggtacgggacgaaggaccaccacatcttcccgttcctgtgcgtcgtggccgcgctctacgcgggcggccggccggtgcgcctcgccaacgaccggttcgagcagttccagaacgggctgaagcgccacgccttccgcatggacaacgtcctgctggtggaccgggccagcggccggttccgggccatgaccgggcgcttcgcctgcgacggcggcgggcgccccaactactccgtcgcggtctccttcgtcggcgccaccgcggcgcagtcgatctactacctgccgaagagcgacttccaggcgatcgccctggcctcgcgggccgtggaggccggatcgacccggggcttcggcacgctccagaccatgtcggccaccgagatgatggtcgacgaggcggcggcactcctggacatcgacgcgatcgacctgcgcctgcgcaacgtgctccgctcgggccagcgcaacagccagggcgcggtcccggccggggcgctgcgcaacgcggagatcctgacgaaggccgccgcgcacccgctctggcgcgaccgggcggcgcgcaaggccgcctacgaggccgcccatcccggccgccgctacggcgtcggcttcgcgcaggtgcacaaggattacggcacgggcgccgaggcggcggtcgcgtcgctggagctcgacccgcggggccgcctgagcctgcgccacgtcgcccacgagatgggcccgggcgtcaccacctcgcaggcggtcatggtggccgagatcctcggccgggtccccgccgagaccgcgttcggcgtggtgcgctggcccgagatgccgctggagacctccgaccagccctacacgacgccccaggaagaggaggaccgccgggcgcagaacccccgctggaccccgcgcttcacctcgccgatgagcgcgaccaactccgcctactacctcggccacgccacccggacggccgcgcggttcctcgtcgaccacgccgtctggcccgccgcccgcgcgctctgggcgcggggcggcggcggcggggcgctggcctcctaccacgtggtcgcccgcgatgagctgcggctggtggacgggcaagtgctgggcggcggcctgccgccgctgtccctggaggcggtggccgccgaggcgcaccggctcgggctgccggtgggcgtgaccctccacaccttcaaccgctggcaatgggccgaggccgagttcgacctgcccggaacggggcggacacgcctgccgatcgacgccctgtcggtgcgctacggcgccggggccccgcccgagcgccgcgccctgatggcggatgcgggctggcacttcgtgccccgggcagcggtcttctacccgccgacccagcgcaacaatgtcggcacgacctactacgcgccgatggccaccctggcggaggtcgcggtcgacaccgccagcggcgacgtgacgatcctctcccaccactcgatcctcgagtgcggccgccagatcgtgcccgagctggtctccggccaggtgcagggcggcctcgccatggggatcggccacgccctcaaggaggtgctgcccctctacgaggacggccccggcgacggcacgtggaactggaaccgctacgagctcccgcgcgcccgcgacgtggccccgtggaaccagacggtggagatcctgccgccgctctccgagaccgacccgcccaagggcatcgccgaggtcgtgatgatcgccgtcgtcccggcgctggccaacgccgtcgcgcacgcgatcggccaccgcttccacgaactccccatccggcccgagcgcatccgcgaggcactggcatga

SEQ ID NO: 5881 - DNA, 357 bp, Methylobacterium sp.
atgcaaggtgggacgatcggaaacggacacgccatcccgcccggcccggcggccgcgcgcctgcccgacctggagcgcgccctggtcaacccggccgcggtgttcgacaccccggccacgttgcgcgatcatccccggctgctgccgagctgcaagcgcgagatcctgcggcgctgggcctgggacgagtacctgaaggaggtcgccgccgccgagggcatggccgagggcgagccgtcgcggctcgacgccgtgaaggccgccctcctggcgctcggcgaagcgcggcgtcccgaccccgccgcgccggccgccgcgttcccggcgccccgggccctcgatcgcgcggcggcctga

SEQ ID NO: 5882 - DNA, 504 bp, Methylobacterium sp.
gtgcatcagcccgaccgcatgaccgacccgatcaccctcgccagcctggaaggcaccgcccacgtcgtccaggtggcgctcagccccgtcttcctgctgtcgggcatcgcgacgctcctcaacgtcttcggcgcccgcctcgcgcgcgtggcggaccaggccgaccacgtctccggattgctggcgggggccggcgacgccgagcgcgtccgcctcgggcagcgcctggaccgccttcaccggcgctccctcgcgctcgacgccgcggtgttcctggccgcgctcggcggcgtggcgacctgcggctcggtgctgactctgttcgtgggcgcactgcgcgacagcacggtcgcgaccctgctgttcggcctgttcggcgcggcgatcctgtgcacgctgtgcgccctcgtggccttcggcttcgagatgctgctggcgaaccgctcggtccgcgaccggatcaaccagcggcgggcgagcgccggcgtgccgcccgaccgctga

SEQ ID NO: 5883 - DNA, 714 bp, Methylobacterium sp.
atgaacctcgtgctgctgcccggcttcatgaccgatgccgacctctggtcggacgtggtcgcgcgcctcgccgaggtgggcccgatcacgcacggcgacctcgcgcgggacgccgccatcgccgacatggcgcgccgcgtcgtcgcggaggcgccgccgcgcttcgggctcgtcggcttctccatgggcggctacgtcgcccgcgcggtcgcccggctcgtgccggaccgggtggaggcgctggtcctcgtcgccacctcgtcgcgggccgacacgccggcccaggcgcgccggaaggccgccgcggtcgcccatatccgccagcagggctaccggggcctcagccggtcggcgatcctccagtcggtgcacccggaccgcgccggtgacggcgccctcctggcccgaatccggcagatgggcgaccggctcggcggggaggttttcctgcgccaggccgggcaggcgcgcgaatccgatagcgaccgcctcggcgcgatcggctgcccgaccctggtcgtggcggcggcccaggacgccctgcgcagcctcgacgaggcgcgggagctccgcgacggcatcccgggcgcgaccctgacggtgatcgacgggtcgggccacatgctgccgttcgaagccccggacgccctcgccgacgcgatcgtgccctggctgcgggctcaggcctccggagcctcgacgatcgggtcgtag

SEQ ID NO: 5884 - DNA, 195 bp, Methylobacterium sp.
gtggcccctgcggagtttcgtctcagggaggccgagacgatcgccggtgcctatcaccgggccgcgaagggcgacgggtggaccgctctcgtcgcggccatcgcggacgctctggtcgatctcgacgcgccggagcggcgcctcgcccggcagggcgggctgatctcgctgggctacgcccgcggccgcaccggg

SEQ ID NO: 5885 - DNA, 3390 bp, Methylobacterium sp.
ctcgctgcgctcggcgatgccgaggccgcgcgcctcgccggaatgccgccggaccgggacggcctcgccgcttggctggacgcggtcgtcgacgccgcggaggcgcgccgacaggggaatccgtcccgggccgccaccggcgacgccgtcctgcggcgggcgctggcgtcggtcctgcgctacgccgtggccgagggcgggacggagaccgtcgcccggctggccgaccggcgccgcccgaacccgaagacgccgcgcgcctaccagcgcctgtcctgggccgagccgctccacctcgccctgcgggccgccctcgtgcacgccccggaggccgattacgacgcggccgtcgcgttcctgaacgcgcggatcgccgaggaccacgactggccggcggcctgcgccttcgcgttcatcctggccgacgaccgggccgccccgcacccgctccagcccgtcgcggtggtcgaggccgccgctgcggcggggatcgacgtggcggccgacacggcctacctgccgctcctcgccgacgcgccgccggaggccgtcgcgggctggcgcgccaagcgcagctaccacgtctacttcgtctactgcgccctcgacgcggccgaggcggccgcgaccctgctggcggtcgcccgcgccgccgggcagccggccctgccggccctcgactggctgctgcactacgccctcgacgaggagcgccgctcggtcgccctggcgatcctgtcgacgggcgaggccggcgcgcttccggccctgctgtcccatctccacgagaagcccgtcgcggccgccctcgacgcggcgctggaggcggaccccgccgcgatcctgccccgctgcctcgcggccctcgcgggcggtcggtccgagcccgccctgcgcgcccgggtgaaccgggcgctcgacgcccacgggatcgaccgggtccgcggctggctcgcggcgtcgggcgggcgcggggccggcatcctcgacgccctggcggaggcccgcgcggtgcccctcgcggagcccgccgcctggccgcgggtgctgcgcgacccgccctggcggaccaaggcccggacccgggacgacctcgtcctcgccctcgcgccgctgccgacgccgttcgcgcacgcggtgccggaggtcgccccgagctactggcgggcgcggaacgccgtgaccctcgacggtccggaggcgctgtcggccttcgtggcggccaccgagctgtcccatccgacgcagggctggagccggatcccgcccccgctctccgagccgccgcgcgacgatccgccggccctggtcgcctgggtcgccgcgcgcgtcgcccagatcgacgaggcctgccattactgggcgaactcgccctatcgccagttggtcggcagcctggagcggcagcccgagcccctggcgctcgccctctgggcccagtcgcgcgtcgttgcgggatgcttccacgtctcgcagtggccggagatcgtgtgggcgatgctgtcgcggttcggcgagcgggcgatgccgggcctcgtcgggctggtcgaggccgatccggtcgggctcctgccggcggtcctggcggtggacgatggccgcctcgccccgcccgccgcccgcgccctcaccaagctcaagaaggcccgcgagccggccctggcctggctgcgccgccatcccgagaccgccctcacccgcctcttgcccgacgccgtgggccggcccggggcgctgcgcgacgccggcgagcacgccctgcgcgtgctggcgcaggaccgggcggacggccgcgccatcatcgcttccgtggccgcgcgctacgcggaccaggcaccggacgtgaccgaggcggtcgcgcaggtgctcgaccgcgatcccctcgcccgcgtccccgccaaggtcggcaagccgcccgcctgggtcgtgccgtccatgctgacccggccgcgactgcgggacgggactgccctgccggacgcggcgatcctgaccgtctgcgagatgctgtccttcaccaacccggacgccgtctacgccggcgtgccgatggtccgcgaagcctgcaccgaagcgagcctcgcggccttcgcgtgggacctgttctccgcctggatcgccgccgggacgccctcgaaggacggctgggccctgcgcgcgctgggctggttcggcaccgacgccacggcccgcgacctgacccgcctgatccgccgctggcccggcgaggccgcccacgcccgcgcggtcaccggactcgacgttctggtcgatatcggcaccgacgtcgcgctgatgaacctcaacggcatcgccgagaagctgaagttcaaggggctccaggagaaggcccggcagaagatcgcccagctcgccgaggcccgcggcctcacccccgaggagttggccgaccgcctcgcccccgacctcgacctcgacgagcgcggcggcctcgacctcgatttcggcccccgcgggttccgggtcgggttcgacgagaccctcaagccctgggtccgggacgccgccggccagaggctcaaggatctgcccaagcccgccaaggccgacgaggccggcaaggccgcggcggcggtggcccgctggggggccctgaagaaggacgcgcgggctgtggcgagcctgcaggtggcccgcctggaggcgatgctcgccggcgcccgccgggtccagccgacggtgttcggcccctgcttcgccgcacacccgctcgtgcgccacctcgcccagcgcctcgtctgggccaccttcgcggatgccgacccgcggaccggcccgggcctgaccttccgggttgccgaggacctgacctacacggatgccgacgacgcgccgctcgacctcgacctgaccggggcggccccgggcctgatcggcctcgtccatcccctgcaactcgaggccggggcgctggcggcctggggggcgctgttcggcgactacgagatcgtccagcccttcccgcagctcgcccgcgagacctacgccttcacggaggccgaggctgccgcatcgaccacgagccgcttcgccgggaccgtcgtggaggccaaccgcctgcgcggcatggccgcccggggctggcccctcggggcaccccaggatgccggggtggtgtggtggatcgagcgcgccgtgaccttcccggggggcgccgccggccaggcgtcgctgaccttctcggagggcctgttcaccggcgcggtggagttcgaggaccgggagcagaccctcggcgacctcaccctcggttcgccctggagcagccggtcggatccgggccagcggaccttcggcgagctcgcgccggtgacggcgagcgagctcctgcgcgggccgagcctcctcgccgggacgcggctgcggtga

SEQ ID NO: 5886 - DNA, 2406 bp, Methylobacterium sp.
cgcggcgcggggcgcctggaccggctgctcgccgccggcagcgcgccgcaggcggcccccgaggccctgccgtccgtgctccgggatccaccctggcggcggcgcggggccgcgctcgcccggtcggaacgggcggtggcgccgatcccgacgcccttcgcgcacggcttcgaccccgacgaggccctcgaccgcagcaccttctacttcgaggccgggacgctggtggagtccatgacggacctcgcggcgcggatccgcgccaccgaggcggaggccctctacgacatgccgatcccgccgccggccgagcccgtgcccgccgccgacgcggatccggccatcgccctggcctggctcgaccgccggctcgacctggaccgcgacgcgttcaccggcttcttctacttcaactacgggccctggttccggatggtcgggtggcagcccgagcccctggcgctgatgctgtgggagaagaccgggccgcagcgcgcccactacgtcgcgtggcggcgcaccatcgcggtgatgctgtcgcgcttcggcgcgcgggccgtgcccggcctcgtccgcctcgtcgcggcggatccggcgcagctcctgccggaggtcgagtcggtggacgccgccgacctcgccccggtcgccgcccgggccttccaccgcacccgcaagctgcggccggccgcggccgcgtggctgcgcgcccatccccgcaccgccgcgctgcggctcctgcccgagaccctcgggcccgccggcccggaccgcgacgcggccgacgcggccctgcgcttcctcgccgccgaacccgcggggcgcgccgccctcgacgccgccgtcgcggcctacgcggagcgggatcccggcgtgcccgaagcggtggccgccggcgtcgacagcgacccgctggagcaggtgccgtccaagccgccgaagctccccgactgggtggtccccgccgccctgccccgcccggtcctgcggagcggcggcgccctgcacgacgccgccgtcaccgccctgtgcgagatgctcgccttctccgacccgctcgcgccctacgcgggcgtcgcgcaggtccgcgccgcctgcacgccggagagcctcgacgccttcgcggtcgcgctgttccagtcctggatcgccgccggcgccaagtcgacgggagagtgggcgatgcaggcgctcgccctgatcgggggcgaccacgccgcccgcgacctcacccggcagatccgcgcctgggggcaggccggcctcaagccgcgcggcaaggccggcatcgccgtgctcgccgggatcggcaccgacgtggcgctgatgaacctcagcgccatcgccgagaagagcccgctgctgcagctgcgcgaggccgcccgcgccgccatcgtcgacgccgccgaggcccgcggcctcgacgaggtcgacctcgccgaccggctctcccccgatctcggcctcgacgcgcgcggcgggctcgacctgtccttcggggagcgccggttccgggtcggcttcgacgagactctgaagcccgtcctgcgcgacgccgagggccggcggctcgccgccctgccccgcccgaccaaggcggacgatcccgaatccgccaaggcggcgtcccggcactgggcggccgtgcgcaaggacgccgaggcggcggccggcctgcagatcacccggctcgaggccatgctggcgtcccagcgccgcgtcgccccgggggtgttctggccgttcttcgccgcccacccgctgatccgccacctcgccgggcggctcgtctggggcctctacccggacgccgcgcccgcgacgccgccggggcgcgtcttccgcctcgcggaggatctctcgccgaccgacgccgcggacgacgccctcgccctcgacgtcgcggcggccgagggcgtggtcggcctcgtccaccccctccacctcgacccggaggaacggaccgcctggagcggcctgttcgccgattacgagatcgcccagccgttcccgcagatcgcccgcgagaccttcgcgttcaccgaggccgagcgggccgccgccgagacccaccgcttcgacggggtccgggtgggcggccgccgcctgcgggggctgcggccccagggctggtcgaccgacacggggagcgagcacgtccatgcggtgcagcgtccggtcgcgctgcccgacggcacccgcctcgtcgcggtcctccgattcgaggacgggttctggcaccggcccggcccggagggcgacgggatccagaccctgcggaccctgaccctgtcggagaccggctggcgcgccgcggcgacccaccggttcggcgacctcgacccggtgaccgcgagcgaggtcctgcggacgccgagcctgctcgccgccgccggcgacgcgtga

SEQ ID NO: 5887 - DNA, 225 bp, Methylobacterium sp.
gtggacaacgacgatccgccctgggacacggacccgctctggtacgaccggaccgagtccggaacgccgccgggacccatcctcgaggcgctggcctggctgttcctgctggcgatcgccgggtgtgcggcgctcgtctggctctacgggatgccggaccgcctgtggcgcgcggcggcgcggcggctgatgcgccgcgatccggcggatgccgggcgcttctga

SEQ ID NO: 5888 - DNA, 3312 bp, Methylobacterium sp.
atgcacccggacgatcagatgacggccggatattactcgatcagcggtacgtcgatggccgcaccgcacgtagcgggtgccgccgctgtcctgcgtcaggccttcccgttcctgacggcgccgcagatcgcccagaccatgttcaccaccgccacccatctcggcgacgggcccgctaacgccccgaacgccaccttcggctggggcttgctcaacctcggcaaggccatcgacggcccgggccagttcacctccgactggacggtcaacaccacctacaacggacaggcctattacggccgcttcgccaacgacatctcgggcgtcggcggcctgatcaaggtcgggctcggcaccctcgaactcgccggcacaaacacctatgccggaccgacgaccgtcgccggcggcaccctgttcctgtccgccagcggtagcctgacctcgtcggtctccgtccagagtgcgggcacctatctcaatgccggctggacccagggcagcgtcagcaatgccggcctcctgatcaacaccggcaccatctccggaggtgcgaccaatgccggcacggcgctcagcagcggcgtgattgccggcggcgtggccaacagcggcacgctctccaccagcggcaccgtcacgggcgggctgaccaatgccggtctggcccttaacaccggcgtgatcgccggcggcgttgccaacagcggcacgctgtctaccagcggcaccgtcacgggcggcctcgccaatgccggtctggccctcaacaccggcacgatcggcggcggcacagccaacagcggcagcctggtcaatgccggcaccctcgcgggcggcctggccaacaccggcacggccctcaacaccggcgccatcggcggcggcgcgaccaacaacggcatcctgagcaacgccggcgctatcggcagcggcgtggccaacaccggcacgctcgccaccagcggcaccatcagcggcggcctgaccaatgccggcaccgtgctcgccagcgccggccgcatcgacggcgccgtcgccaacaatgccggcctgctcgccgtcgccggatccgtcgccggcaccggccccttcgccaacgccgccggcgcgacgctcgccgtcacgggcggcggcagctacagcctcgccggccccctcgccaatgccggcctcgtcgccgtcgcccagaacgccagcctcaccgcctccggcggcctcagcaatgccggcctggtggccagcgacggcaccctcaccgccgacctgaccaacaccggcgtcgcccgcctctccggtcagttcaacggcacgctcaccaatgccggcctcgtgcagatcaccggcccgctcgccggactgaccggcctgaccaacaccggcgccctcgacctcggcggaaccgccctcacgctcaccgacctcgccggcccggcctccgccgtcctgggcaacggcgccctcacggtctccggctcggccgcctccacctacgccggcgccatcctggagaccgcgagcccgaccagcctgaccaaggccggccccggcacgctcacgctcaccggccccggccgcttctccggcccgaccaccgtccaggccggcacgctctccctcaacgggctctggacctcgccggtcacggtcgcggccgccggcaccctgcgcggcatcggcaccgtcgcggccccggtcacggtcgccggcgccctgcggccgggcaactcccccggcacgctcaccgtgctcggcccggtggcgttcgcccccggcagcagcctcggcctcgacatcgacggcccgggcaccggcaccggcgcgggcagctacgcccgcctcctggcgctcggcccgaccggcacggtggccgccaacggcaccctggtgccggtcctgcgcggcatcaccggcaacgcgggcaacagcttcacccccgcgctcggccagcgcttcggcgtgctcaccgcgcaggccgggctgtcgggctcgttcagcgggctcgtccagccggcggcgggcctgccggcgggcacgcgcctcgacgcgctctacgccgccaccggcctcgacctcgtggtcacgcccgccgcctacggcaacctcgcaggcctcggcctcgcccagaccggcaacgcccgggccgtgggcgcggcgctcgacctcgcccgcccggccgccggcacgcggccggacgcggcgcgggcgcgggtgttcgacccgctctacgcggccggcccggcgacgctgccgggcggcctggcgagcctgtcgggccagagctacggcgacgcggtgatgaccgacctcgccgcgcgccgtctgctgtccgacacgatcgaccggcaccagcgcgggctgggcgggggcgcgggcgcgttcggcgcgggcgatcccggcccgggcccgaaccgcacggcgctgcaggtgcgcggcggcgccggggcggcggcggcgccgctggcggtgggcgagggccgggtctgggccgacgcgctgtacgggttcggggcgcgggccggcgaccgggcggccgcgggcgccgggttcgacgcgggcgggctgctgatgggcgtcgaccgtcaggtcggggcggacacgcaggtcggcgcggcgttcagctacctgcgtgagggcggcacgtcgcggggcgcggggctggggcggttcaccaccgacagctacggcgggacgctgtacgcgagcacgcggctcggcgcggtggtgctgcggggcacggcgggtgtgtcgtacgcggacgggcgggtggaccggacggtggcgctgggcacggcggtgtcgcaggcctccgggctgtcgtcgggctggaacggcggggtgtcgggctttgccggctacgcgctggcgaccggcctgccggtcgaggtcgttccggaggtgggcttcagctacgaccggctgacgcggggccgtgtgtccgagcggggcggtctggtgggtcagggcttcggcgggcagggcttcgcggtggccgacctcgacgcggcgcgcagcctggtcggcgggcgcgtgacgagctgggcgctggcgggcattccggatctgcggctggagggtcgggcgtactgggcgcacgagctggccgacacggcggcggtgatccgctcgagcctgttcggggcggggttctcgagccggacgagcgcgctggggcgggacggcgcggttctgggagtgagcctgacgggggcggtcgccgagggcgtgcggctgtcggtgggctataccggcgacgtccgcccgggcgccaccgcccaggtcttctccgcaggcctccaggccgcgtggtga

SEQ ID NO: 5889 - DNA, 441 bp, Methylobacterium sp.
atgtgcaatctgtactcggggatgccgtccgccgactacgagggcgagacccgctccatccggctcggcggacactcgacctcgatcaggatcgaggtgatgttctggaacgtgctcgaggacatcgccgccgctcagggcatgacccttccgcgcctcgtgacgcttctctacgacgaagtgctcgctctccacggtgaggcacgcaatttcgcctcgctcctgcggtgcgcgtgcctgaggcacctcgagatgaaggcggcgcgcctcgcctcggcgcatcggcgcgccgtggaacagcgcggcagggtcgcgggggacgtcgacggcgccctggaccggatcgacgaccgtgacgtcggcgtcggacacgtcgcgcggaccgcgcgcgccctgcgcggcgacgcggtccggccgcgcgatgcccgcggcgagggctga

SEQ ID NO: 5890 - DNA, 1527 bp, Methylobacterium sp.
atggatatgcctgtcgacgtcgtcgtggccggagccgggccggtggggctcctcaccgccatcgagctgaccctcgggggcgcgcgtgtccgaatgctggagcgcctcaccgagccgagcaccaccatcaaggcgctggggctcggccccctgggcgtcgaggcgctgcagcggcgggggatgggcgcggcgatcgaggccgtcgaggcgcggagcctcgcggcgatggatcgcctgccgggtcagatcggcggtggtccgcgcggggcagaggtcagcggccatttcggcttcctgttcattcgccgcgacccccaggcggagccggaccggcgcatgcgcgcggtcgatcagcagagcctcgaagccatgctgctcgaccgcgccgcggcgctcgggatcgacctgcgccgcggctgcacgctcacgggcttcacggaggcggccgacggggtcgaggtggcctggaccgcgccgacgggcgacgcgcgcgtccgctgcgcctatctcgtcggctgcgacggcggccgcagcgcggtccgcaagatggccggcttcgcgttccccggcacgccgccgacgatgaccatgtaccaggcgatcgccgatctcgacgatcccgccggcacgctgccggtcggctggcaccgagggccggggggcgtcttcggccacgggccgttcccgcgccgcctgttcatgctggatttcagcggcccgccggccgaccggcaggcgccggtcacgcgcgacgagatcgagaccgcgctgcgccgggtcagcggcacggacgtccgcgtcgcccggatcgcggtcgcgaaccggtgggccgacaacacgcgcctcgtcgacacctaccgccggggccgcgtgctgctcgccggcgacgcggcgcatgtccacgcgcccttcggcggccagggcctgagcctcggcctgggcgacgccgccaatctcggctggaagctcgccgccgtgctgcgcggggagatgcccgagagcctgctcgacacctacacggccgagcggcgcccggtggccgaggccgtcacggccaacacccgcgcccaggcggcgatcctgcggcccgatccgcaatcgggcgcgctgcgcgacctgatggcgcggctcctggagagcgacgaggtcagccggatcctcggcggcctgatgcgcggcctgagcgcccggtacgatctcggctcggccgaggacgcggtcggccggatggccggcgacgggccgctcggcgccagcggcgcgacgctctacggcgcgatgcaggacggccggggcctcctcgtcgacggcagcgccgacggcgcggcctcccggatggtcgccgcggcgacgggccgggtgacctgcgtggcggtcccggacgggccctcgacgctggtccgccccgacgggtgcgtcgcctggacgggcgcggcgaccgccctcgacggcctgcgggaggcggtcggccgctggttcggcccgtcaccggccgggccgctcggcgcgccggctccgatgtgctaa

SEQ ID NO: 5891 - DNA, 879 bp, Methylobacterium sp.
gtgtcgctctcgatcggaaaacgcatcctcctcggcttcttcgccatcacggtggtggtggtggcgctcgggctctacgccctggagcagatcggcgcggtgcgcgacacgaccgacgcgatcgtccggcgggacatgacgatcctgcgccagctcgacgatctcgggaacgacgcgcgcgacctcggtctcctgcgccgcaccgccgtgatcgcgatgctgatgcaggcccaggggcgcgcgacccaggccggcgacaccctggcggcctggcgccagaccgcggcccaggtcgagaaccggctcgccacgacgatccagctcgccacccagtaccggacgcaggtcgtgtccgccgagcgcgtcgcggcctgggaccgcatcgccgcggcggcgaccgcggtccagggctcgttccgagaggtcaaggcgcagggcgaggcgcagttcgccgccatcgcccagcaggacgtcgcggcggtcgaggcccgcaacgcggagatcagccgcctccaggcgcccttcctcgaggggatcaagaacctccgcgcgcagctcgacggtggcatggcgctgggccagcgcgccgcgcaggaggtctacgagcgctcgcgcctctcgatctacctgaccctggcggccgcggtgctgctggcggtcctgatcacgtggctgatcagccgcgcggtggtgcggcccctcgagacggtcatgaccttcgtcgcccgcgtcggcgagggcgacctgtccggccagctggcggcgggcgggcgcgacgagatcggccgtctgagcatgacgctgaacacgatggtctcgggtctgtcggacctggcgcggacgaaccgggcggcgacggcggacctgaacgcggccgcg

SEQ ID NO: 5892 - DNA, 1272 bp, Methylobacterium sp.
atgtgggtgagagacacgagtccggcggagcgccgggtcctgggcgcggccttcgcgggctacggcgtcgatgcgttcgactacatgatctacacgttcctgatcccgaccctggtcgtagtctggggcctgaccaaggtcgaggccggcaacatcgccaccgccgcgctggtgacctcggcgatcggcggctgggcggccgggatcctcgccgaccgctacggccgggtcgtcgtcctgcagggcaccgtcgcgtggttcaccctgttcacggtgctcagcggcttcacccattcctacgagcagctgctcgcgacccgcgcgctgcagggcttcggcttcggcggcgaatggtcggtgggctcggtgctgatcgccgagacgatccaggcccgctaccgcggcaaggccgtggggctcgtccagtcgagctgggcggtcggctgggcctgcgcggcgatcgccttctgggccgtgttcggcctggcggagccggcggtggcgtggcggatcctgttctggctcggcgccctgccctcggtgctgatcttctggatccgccgcaacatcgaggatcccgaggtctaccggcagacccgcgccgccatgcgggacgtcggcgacaccggcagcttcctcgacatcttctcccggccgctgatcggccggaccgtgctggcgagcctcctcgcgaccggcatgcagggcggctactacgccgtgaccacgtggctcccgacctacctgaagaccgagcgcaacctctcggtcctgaacaccagcggctacctgctgatgctgatcttcgggtcgttcgtcgggtacctgaccagcgcctggctctccgaccggatcgggcgccgactgggcttcgtcctgttcggcctctgcgccggtatcctcgtcctggcctacacgctgatcccgatcaccgacccggtgatgctggtcctcggcttccccctcggcttcttcctctccggcgtcttctccgggatgggcgccttcctgagcgagttgttcccgagccggatccgcggctccgcacagggcttctgctacaatttcggccgcgccaccggcgcgatctgcccagccttggtgggccatctcagcggctcgctgacactcggcatcgccatcggcgtcgtggcggcgggcgcctattgcctcgtgatcgtcgcggcgcttctcttgccggagacggcgggccgcgcgctcgattctcgcagcgcggatccggccgagccggaacccgttgcggccctatga

SEQ ID NO: 5893 - DNA, 1050 bp, Methylobacterium sp.
gtgctggacctgccggaggagatcctcgagccgtcgacgcgcagcccggtggcccgggacgtcgcccgccgcgccggcgtctcgaccgcgacggtgtcccgggtgctgaacggctccgccggggtccgggccgacaagcgcgcggcggtgatgcgggccgcgcaggatctcggcttcgtcgccaacggggcggcccgggcgctctcgacgcgccggttcatggcggtcggcgcggtcgtgcccaacatcgagaacgaggccttcgtgcgcgtgctgtcgagcttccaggaccggctgcggcaggcgggctacaccctggtggcggccaatgccggctacgacctggaggacgaactccgcgaggcgaccttcctcttggagcgcggcgtcgacgggctgatgctggtcggcgacatccatcacccggacctccacgcccggatcgcccgcgccggcatcccgatggtgcagaccttcagtctgtcccgcgagcgcccctgcgtgggcttcgacaacgccgcctcggcggcccgggcgaccaactacctgatggatctcggccatcgccggatcggggtgatctcgggcctgcgcaaagacaacgaccgcggcggcgcccgggtgacgggcattgcggcggcgctcgcggcccgcggcctgcggctcgccccggagcatgacatcgagatctcctacgggatcggcggcggccgcgacgggttccgccagatgctggccggcggcccgccgccgaccgcgatcatctgcggcaccgaccagatcgccttcggggcgatgatcgaggcgcgggcaagggggctctccattcccggcgacctgtcggtcatcggccacaacgactcggacttcgcgcccttcctcgacccggcgctgacgacgatccgcatccactccgccgagatcggccacgccgccggcgaccaccttatcgcccggatccaggggcggccgatggtccgcctcaccgagatcgacgccgagctgatcctgcgcgccagcacggctccgccgaggcgtgtcggcgcctga

SEQ ID NO: 5894 - DNA, 936 bp, Methylobacterium sp.
gtgcgcgcagcggccgagtcgctcggctacctaccgggcggaccggcccaagctctcgcatccggaaggacgcatacgatcggagcgattatcccgacgctcgaccactcgatcttcgcgcgcgcgatccaggcgctgcagacgaccctggcacgcaacggctatcagcttctgatcgcagcgcacgaatactcggccgtcgaggaagccgcgcttgtccgatccatgctcggtcgcggcgtcgacgccctgatgctggtcggcgcggaccatctgcccgagacctgggccctcgtcaccgaggcgccgatcccggtggtgctgacgtggtcgttcgatgaccggctcgactcgatcggcttcgacaacgcgcaggccggctatctcgcggcccggcacctgctcgccaagggccaccgtcgggtcggcatggtctcaggcttcacccaggccaacgaccgcgcgcgcctgcgcatcgacggcgtgaggcaggcactcgcggcggagggcctcgagttctcgaacgcccgcgtatcgcagcagcccttctcgctcgccggcggccgggccggtctcctgcaactcctggccctcgccgaacccccgacggcggttgtgtgcgggaacgatcttctcgccgtcggcgtgcttctcgaggccgaacaacgcggcctgaccgttccccgcgacctgtcggtcgtcgggatcgacgatctcgagatcgccagccatatcgcgccgtccctcacgacgattcatcttccgaccgaggaactcggccgagaagtcgccgagcatctcctggcccgcctgcgcggggaactccgcgcgagccgaacggagatgccgatcgagctgatcgagcgtcgttcgtctggaccgctgctgatgcccgctgaccagccggtcgcggggcatcggcgcggcgtcaagtaa

SEQ ID NO: 5895 - DNA, 1056 bp, Methylobacterium sp.
atgaccgaccccgccctccgcggcctcgccttcgtgggctgcttcaccaccgagcggcgccgggcgcgcggccggggcatcgacatctaccggaccagtcgcgacctcggcgactggacgcatctcggccgggtcgagaacctgacgaacccgtccttcctggtgaccgacccggcgcgcgcgatcctctacacggtccagggcgacggcgaggcggcgagcgccttcgcgctcgagcccgacggcaccctgcgcggcctcggaagcgccgcaaccggcggcaccaacagcgtgcaccaggccctcgaccccggcggtcggttcctgatcgtggccaactacgccagcggatcggtcgccctcatgccggtgcgcgccgatggcggcctggagcccgcgtgccaagtgctgccgctcccgggcgagccgggcccgcaccggaccgagcaggcctgcgcccacccgcaccacgtggtcctgtcgcccgacggtcgccacgtcatcgttcccgacaagggcctcgaccgcgtcttcgtcctgaagctcgcgggtgagcggctcgccatcgtctcgcagaccgcgatgcgtcccggcgccggcccgcgccacatcgcgttccacccgcaccggcccctcgccttcctggtcaacgagctcgactcgagcgtcgccacctgccggtgggacgcggacgccggagcgctgacgcccctgcacctcgtctcgaccctgccgccggacttcttcggcgcgagcaccgccgccgccatcgcggtcacgcccgacggacggttcgtctacgcgtcgaaccgcgggcaggacgggatcgcgcggttccgggcggacccggccgggcgccttgaacccgcgggctggacgccctccggcggccgagacccgcgcttcatggtcctggcaccggacggaggccacctgctcgtcgccaacgagcagggcgactgcctcgtcgccttcgccgtcgatcccgagaccggagacctgagccggacgggcgaacgcccgagcctcagtccctgcacgatcgcgttcctgtag

SEQ ID NO: 5896 - DNA, 636 bp, Methylobacterium sp.
atgaccatcctcgaccggttcgaggcggccttcgcggcctgtccgctcgtcgccatcctgcgggggctcacgccggacgaggcaccggccgttggggaggccctggtcggggccggattcaccctcgtcgaggtgcccctcaactcgccggacccgttccggagcatcgcggcgctcgccgagcggctcgccggacgggcgctggtcggggccggcacggtcctgacgccgactcaggtcggcgaggtcgccactgctggcggaaccctcgtggtgtcgccgaacgccgatccggccgtcatcggtgcgaccgtcgcggcgggcctcgtctcccttccgggctatcagacgcccacggaggctttcgccgccctggcggcgggtgccaccgcgctgaagctgttcccggcggatgtcgcgacgcccctggcgctccgggcgcatcgtgcggtcctgccgccggacacgcgggttctggccgtcggcggggtcttgcccgagtctatcgcgggctggcggcaggcgggcgccgacggattcggcctcgggtccaatctctaccggcccgggaaggccgcggccgacgtcgcccgcgacgccgcggcctacgtggcggcgttcgagcgctccgcctga

SEQ ID NO: 5897 - DNA, 336 bp, Methylobacterium sp.
atgcggcggatcggcgcgaggcgggcggacggcgcggtcgcgctgatcggcccgcgcgtccgagccctccccgccgccctcccgtccgcacttccggcgctccgcgactgggtcgtcgccggtctcgcccgcgaggccgagcagcgccggctgttcccgtggctggcggtggccttcggcggcgggatcctggtctatttcgcggcggccgacggggcgccgagtccggccgcgcccctgatcgcggccgccctcgcgctggcgccggtccccgcactcggcgcgcggccggcggccctggcggcggcgctcgcggtggcgtccgcgttcctcggc

SEQ ID NO: 5898 - DNA, 903 bp, Methylobacterium sp.
atgacgctgcgcgacgggctcgccgcaatcctggtggtcacgatcctcgggctggccttcgtggccatcaaggtcggcctggagacggtgccgccgctgatgctgtgcgccctgcgcttcggcttcgcggcgctgccggcggcgctggtgatccggccgccccgggctcccgtcgtcctggtggcggggttcggcctcgccctcggggtcggccagttcgggctgctcatgacggcgatccgcctcggcatgccggccgggctgtcgtcgctcctcatccaggtccaggtcccgttcaccgtggcgctcgcctgggcgctgcagggggagcgcccgcgccgacgacagatcctgggcggcagcatcgcgctcctcggcgtcgccgcggtggcgctcgggcggggcggaggcgccccgctcggcccgctgatcctcgtcgtcggcgcggccctgtcctgggccagcgcgaacgtcgtcgcgaagcggatcggccgggtcgaccggctggcgctgatggtctggagcagcctcgccaccacgccgcccctgctgatcctgtcgctgatcgtcgagggacccggggcgctcacggcgctggcgcatccgagttggggggcgatcggatcggtcgcgttccaggcctatccgacgacgctcctcgccttcggcctctggaacgggctcctgacccgctacccggcggctgccgtgacccccttcgccctgctggtgccggtggccggcatcctgagcacgcatctcgtcctgggcgaaccgctgagcgccgacatcctggccgggggaggcctgatcctgacgggaatcgccctcagccttcgcgggacgcggccgggcgcggtcgctccgccgggtcccgcccccgaatcgtcgaaggtggcctga

SEQ ID NO: 5899 - DNA, 294 bp, Methylobacterium sp.
gtggacctaacccggcgcggtcccggcacgcagacgacgacgatgcagcttcgcccgatcctcgccctcgcccttctcctggtcgcccgacccgcgagcgccgaggagggcttcctcgacaagctgttcggcggctccgggcggggggcgccgcccaaccccttcgcgtcgaactacccctcggcgccgccgacggcggaggaggcgcgcgccgcgcgcgagcggcgctcggtccgcggcgagcgcggttcgccggccggtcccctgcccccggggcgcatcccggaggagtga

SEQ ID NO: 5900 - DNA, 459 bp, Methylobacterium sp.
atgtccgtgtcacgccgtgcggcgctcgccgccgccatcgccgcacccgtcctgatccgttcgggctccggctccgcggccggaaccgatcccgccgcccgtggcgccgcggtcgagcaggcggtcgacgccctcaccaaggctctcctcgccgccgacggtccggccctcgacgccctgaccctcgacgggctgagctacggccattccagcggtcaggtgcaggacaaggcggccttcatcgagacgctgaccagcaagcgctcgaccttcccgagcatcaccctgtcggaccgctccgtctcggtggtcggcgacgacgccatcgcgcgccacgtcttcaccggcgaggtggtctcgggcggcaagacgtcgccggtccatatcggcgtgatgcaggtctggcacagcgacggcggccgctggcggctgctcgcccggcaggccttcaagatctga

SEQ ID NO: 5901 - DNA, 1524 bp, Methylobacterium sp.
atgtccacgtatcccgtgatcaccctccgcccccccgacggcgtggccgtggcccgcggcgccatcgagccgggaacgccggtcgccgacggtgtcgcggcggcggagcggatcccggccggccacaaggtcgcggtccgggcccatcggagcggcgagccggtgaccaagtacgggcagatcatcggattcgccaaggcggacatcgcggccggccgccacgtccacgtccacaatctcgggatgggcgagttcgcccgggactacgcgttcggggtcgatgcgaggccgacccagctggtgacaccgcccgcgaccttccagggcatccgccgccccgacgggcgcgtggcgacgcgcaactacgtcggcatcctcacctcggtgaattgcagcgcgcacgtcgccgacctgatcgccgacgcgttccggcggcacccgatcctcggcctcgacccgctcgctccctatcccaacgtcgacggtgtcgtggcgctgacccacaagaccggctgcggcatggcgatgggcgagccgctccggctcctgcggcggacgctcgcgggctacgcgcggcacgtcaacttctcccacatcgtcatgatcgggctcggctgcgaggtgaaccagatcggcgccttcctggaggagcaggggctcggcgaccggatccgcagcatgaacatccagagcctcggcggcacccggaagaccgtcgaggccgggatcgcgttcgtgaccggcatcctggccgaggcgaacgtggtccaccgggagccggtgccggcgagcgagctgatcgtcgccctgcaatgcggcggctcggacgggtattcgggcgtgtcggccaacccggcgctcgggatcgccagcgacctcgtggtgcggaacggcggcacggtgatcctgtcggagaccaccgagacctacggcgccgagcacctgttcacccgccgcgccgtcagcccggaggtcggccagaagctcgtcgacctgatgcactggtgggaagagtatacccgcaaggagggctcggagatcgacgcgaatccgtcgccgggcaacaaggccggcggcctgaccacgatcctggagaagtccctcggcgccatggcgaaggccggcagcaccaacctggtcgacgtgctgcgctacgccgatcccgtcaccgccaagggcttcgtcttcatggacacgcccggctacgacccggtctcggcgaccgggcaggtcgcgggcggggcgaacctcgtctgcttcaccaccggccgcggctccgtgttcggctgcaagccgtcgccctcgatcaagatcgccaccaactcggccatgtaccggcggctcgaggaggacatggacgtcaattgcggcacgatcctcgacggcgcggagagcgtggagcaggccggccaccggatcttcgacctgatcctgcgggtcgccggcggcgagcggacgaagagcgagcagttcgatttcgggtcgtcggaattcgccccctggcagatcggcgcgaccgtgtga

SEQ ID NO: 5902 - DNA, 930 bp, Methylobacterium sp.
atgctgaaggacgtcgtcaggagcgcgggccgtcgcgcgggggtggatatcttccgggcgagccgggaagcgttccgctggagccacacggtccacgattactatcccgtcgtgccgtccgcgcgctggtcgccgggccgggcgccgcacggccagctcaaggcggtgctcgcccggtcgcacgcggcctacgacagtttcctcacggaactcgaggcgcgggcggacctgctgcacagcgttccgcacgacgcgcccgtgaccggtggggcgacgccccactggaacaacacgtggttcaccgccctcgacggcgccgcgctgatgacgatgctggcctggaagcgcccgtctcggttcttcgagatcggctcgggctgctcgacctgcttcgcgcggcacgcgatcgacaccctgaaccttccgacgcggatcacctcgatcgatccgatgccccgtcgcgagatcgacgcgctctgcgactggaccgtgcgcagcccgctcgaatcctgcgatctgaagatcttcgaggaactgaaggcgggcgacatcctcttcttcgacggttcccaccgttccttcgcgaactcggatgtgacggtcttcttcttcgaggtgatgccgcgcctcgcgccgggcgtgatcgtgcagatccacgacatcttcattccggacgactacccgtccgcctggaactgccgattgtacaacgagcagtacctgctggcggcgatgctgctgtgcggcgcgccgccgttccgggtgaccgtgccggtgatgtatatctgccaggacccggcgatgagcgcccgggtcaagacggtcttcgccgcccgcggcaccggccccgacatcccgttcctctacgcgaacgattcccgcacgccgggcgcgtcgttctggttcgagatgaccgggacgcccggctga

SEQ ID NO: 5903 - DNA, 3204 bp, Methylobacterium sp.
atgtccgacctgtcgatcctgctgctcgacaccgagccgcagactcacaaccgctacctcgtgctcgccatcgcggacgcgctgcgccggcatcccgcggtcggccgggtccatgtcggcgaccacggcgatgccctggccaccttcgtcgagcagggtctcgacacgctgatcgctttcggcggcgctcgggcgcacgcgcccctggtcggtcgactcgccgggctcgcccggaccagcgtgctctggaccacggaagatccgtacgagcgcgaggcgaacgtgcgcgggtcgggggccttcgatctggtcttcacgaacgaccgggccacggtcccggcctacggaggccgggcgcaccacctcgccctcggcgcctcctcgctcttccacgatctcccggttctcgaggacgacgcgcgctaccgctacgatctcctcttcatcggaacggcgtggccgaacagggtcgcgaccctgaacgcgctctcggccaagctgccgcgggacgtgaagttcaagctggcgctgccgtggaacgcgcatatcggcccgccggagctggaggacgaggccctcgtcacggactggcgctgcggaaaccgcgatttcgccctcctggcgaaccgcagtcgcgtcgtgctcaccctgccccggatcttctcggcggcgcgcgccgatcaggcgaccggttcgacgccgccgccgcggctgttcgagaccgcgctctcgggcggctaccaggtcgtcgtgtcgcccgagccggagacggccgcctactacacgccggacgccgagatcgccctctgcggcgacgaggccggtgcggtcgaggcgatcctgacggccctgaccgaaccggaggcccgcatcgcgcgcgcgcgcgccgcgcaggcgcggacccgcgccgaacacctctacgaccatcgcgtggcgacgatcctggatgcggtgatcgaccggcgccggacgcagacgcgccggccgcacctcgccccgtcagcgacccgcacggtcctgatgctcacccacaaccggatggggcatcgtcccggcggcggtgtcgaggtctatcaggaactgctgaccgagctcggcgagccgtaccgcgtcctgttcctcttccccgtcttcggcgacgggcgctggtcgctccggctcgagggccccgggatcgcggagagcttcgcctgcggtcccgtgacgccgccgctctcgacggacccgttcgtggaggggatcttccagaggctgctgttcgagcatcaggtcgacctcgtccacatccatcacctgatgcacgtcccgctgtcgctgccgctgatcgcgcgggcctgcggcatacccaccgtctaccacctgcacgaccatttcctgatctgcgagcgctggctgctgctcgatcacaccggccggttctgcgacgtcgtcaatcgcggggcggaccagtgcgacgcctgcctggtctcgggaagccagtatccgcccggttccaaggcgcgccgcgacggcatgatgaccctggtgaccgacgcgatcgacgccttcgtcacgagcacgcccgcgacggcggggtacctccggcgctacttccccggcatccccgccgaccggatcgtcgagatcccgatggtggcgccgaacaccgcgccggccggggcgcggccggtgtccaagcgcaggcgcgacgccgatcggctgaccgtggcgatcctgggcaatctcgcggcccacaagggcggccagcaggcgatcaacctgatccggagctgcgaagcctatcccatccatttcaaggtgatcggccgcatcgacgacctgtaccgcgaggcggtcgcgggcttcggaccggatcaggtcaccgtcacgggcgcctacgagcagcacgcgatcggcggcctgctggccggctgcgatgtctcgctgcacctctcgacctggcccgagacgttcgtcatcgccctgacggaggcgtggcagtcgggcctggtcccggtcgtcgccgatatcggggccctggccgagcgcgtcgaggacgggatcgacgggttcaaggtcccgccggacgatgccggcgctgtccgcgcgcgcctgatcgagctgcactacgatcgcgcgcgcctcgcccggatgcaggcctccatcggccggaaatccttccccgacaccgacggccacctcgggtcggtccgcgccctctacgagcgcctgatcgaggcgcggcccctgcgccacggacgggttcccagccacctgcggcacggtttcgacctccggctcgagaccctgggataccggacgaacgccgcctcctggaccagcgcggcgatcgcttgggatgaggcggcccgtgcgccggaggtgtcgcccgccgtgacggcggcggcgcgcgcgcgcccggtcccggagctgcccgacgcgttccggcgtctgacgctgaggccggtccggcgcagcgagtgcggctggagcctcgacgtgctgcgcacggacgagcgcctgaaccggagcctggatctctcgtcggtcgtcgcgcgggcctccgtgttcctgcgcggctggctgcacgtctcggggccggcgccgaaggcgatctacctgcggctgacgggtcgcaccgggacatcgtgggtcgccctgcagagcgatctccgtccggacgtggccaagtggtacggtgaacccgccgccgcgacgtccggcttcaccggccagatcgacgtcgcgggaatgtccttcggacgctacgcgctcgcgatcgtccagatcgccgaaggtagcctgcgcatcctcgaagacgtcgcctcgatcttcatcgcccccgacaccgagccgccggcgcgcttcgttccggagccgcgccacctcgtcagcggcccgccgcacgtcccggatctgcaccacagcctgccggatgccggcgacgcgctccgcgtgtcgccggggcagctctgggccgcggaggtcgcgttccccggtaccgtgccccggctcggcaaggacacgctggcggtgttccgcggcaccaacggtcagacgtggcgggcgcccgtcctcaagatcgacgagcggacggtgcgcatcaccgcctccgtccccaacatcgatccgggcgcctacacggtgtccctcgccgagccgcacaacaggacgttgcggaccctcgcgacgctgttccgcacgcaggtggcgcgttcggagtga

SEQ ID NO: 5904 - DNA, 996 bp, Methylobacterium sp.
atgaatttcgtcagcgcgatctcgttggccgggccgcacgtcctggtcacgagcaccttccccgatgcgctcaacaggaatcccgggatccggagcgatctcgccgagggcttcgccgaactgctcggcgccgagcgcgtcaggcacacccctctggaactggcggtcgcggcggtccgggcgtcccggccggatgtcgtgatcgcggtcggaagcctcgtcccagacctggcggatctgcgcgcgcttcggcgggccgcggacgccgtcggtgccgtcctgatcttctggctgacggacgacccgtacgagttcgactacgccttcaaggcggaactctacgccgacatcgtcgtgagcaacgattcctgggcggcgcagcactaccggcaccccgacgtccaccacctgccgctggccgcggcacccgagcggcatttccggccgatcgccccggtggcggagcgggagacagtcctgttcttctgcggtgtcgcctacccgaaccgcgtcgccctgatgcgccggatcgacgatcttctgtgccggcacgtcgtggaggtcctgggcgccgagtggccggacacgctccgatgcgcggtgaaccgccgcctcacgccggcgcagatggccgactacgccgcggcggcccggctgacgctcaacatcggccgcgacctcgacgtggccaatcgccggctgtcgctcccgcaggcgacaccgggaccgcgcaccttcgaggtcgccctgtcgggctcggcgcagctgttcttcgtcaccggcctggaaatctgcgcgcatttcgagccggactcggagatcctgctggtggacggcgcggccgatatcgcgcgtgccatcgagcggtcgctcgacgagcccgccgcgatcgaggcgatcgcgcgccgggcgcaggcgcgggcgctccgcgagcacacctaccggcatcgcgcggcgcgcctgctcgatctgagccgcctgacggtcccggcctga

SEQ ID NO: 5905 - DNA, 615 bp, Methylobacterium sp.
atgctgtacgaactcgcgaccctctcgtgcccgctgctcgcggtgggtcaggtctcggccggcgtcgaggcctggctggacgatcccgacgccaagggcgagttggtcggctgctggcgcaccgagatcgggacgctggggcgcctgatcgtgctgcgcggcttcgcggcgcccgaggacatgaccgccgagcgccggcgcgccctcctcagcgccaacccgttcaacgccgggcacgtgatcaccgcgctggagatggacagctacgccccgttccccttcctgccgccgatcaggacgggcgaccgcggcggggtgtacgagatccggacctatcgccagaagccggggggcctgccgccgaccctcgcggcctgggaggccgcgatcgagccggcacgcgcctacacccagcacctcgtcgtcaacatgtacgccctcgacggcgcgccgcgcatcacgcacatctggggtttccgcagcctggaggagcgggccgcgctgcgagcccgcgcctacgaggcggggatctggccgccgaagggcggcccggaccagatcgcggaagcgaccgcgacgatcgcgctcccccaggggcgctcgcccctgcgctga

SEQ ID NO: 5906 - DNA, 261 bp, Methylobacterium sp.
atgaccggcctgatcgtcgccgcgtccgtcgccctgttcgccggcggagcccaggcgatgcccgtggcaccgctgaccggcggcgacgccgccgtcaccctcgtccgcggcggctgcgggttcggcgcccatcgcggggcctacggcggctgccgcctgaatcgcggcccgcgcggcgcgatccgccgcgccatcaccggcgccccccgcggctgcccgcccggcctctatcgcggcccgcggggcgtctgccgccgctga

SEQ ID NO: 5907 - DNA, 477 bp, Methylobacterium sp.
atggcgagtgtcgtgcaccgcgggcccggcccgaacgctgtgatcggcggcatgcgggtctcctatctcgcgcgcagcgacgagaccggcgacggcctcggcatctaccgggtcgcgatggatccccggacgccgggcgcgggactgcaccgccacgcccggctgaccgagacgttctcggtcgaggcgggccggctcgcgctccacgtcgacggtgtggaccacgacctcggaccgggcgatttcgcgctcatcccgcccggcgtcgcgcacgccttcgccaatcgcggcgaccgcccggtgcgcttcacgctgagcttcgcgccggcgctcggccgcgagggcttcttcgagggtctggcccgcctcgccgcggagggccggctcggcgacgccgccgcgatgaccgacctgatggcccgctacgatcaggaaccgctggccgggttcgccggctggagttcggtcagcggctga

SEQ ID NO: 5908 - DNA, 243 bp, Methylobacterium sp.
atgccatccgaaccgaaagccccgatccgcggtcgccacctcgaagccctgcgcgctgtcgccgagaaccctggaggcctccgacacgaggcctacccgaccgtcatgccgatcctggaagaactcggctacgtcgaggagcggacgacccgcggcagcaccggccggcgcgtatggcacctgacctcgggcgggcgcgagctgctgatcgcgctcgggatccgtgagagcgccgagccgtga

SEQ ID NO: 5909 - DNA, 720 bp, Methylobacterium sp.
atgtccgggttgtcccctgagacgcgcgccaagctgaagaccgtcagcacggccacgctgatgaccgccctctacaagcgcggcttccgcaaccagatgatccagggcgtgctgcccctgaaggccggcggcccgacgatggtcggcgaggcctacaccctgcgctacattccggcccgggaggacctgaacccgatcacggtgttccgcgaccgcgcgcacccgcagcgcaaggccgtggaggagtgcccgcccggcgccgtgatggtgatcgacagccggaaggacgcccgggccgcctccgccggctcgatcctggcgacccggctgatggtgcgcggctgcgccgggctcgtcaccgacggcggcttccgcgatgccgacgagatcgcccggctggagatgccgagctaccacgcgcgcccgtcggcgccgacgaacctcacggtgcaccaggcgatcgacatcaacgtgccgatcggctgcggcgacgcgcccgttttccccggcgacgtgatcgtcggcgacggcgacggggtggcggtgatcccggcccacctcgcggacgcggtcgccgacgaggccgtcgagatgaccgcctacgaggatttcgtcaccgaggaggtacgcaagggccgcacaatcctcggcctctaccctgccaccgacgagcagagcctcgccgatttcgccgcctggcggacgcggaccggccgctga

SEQ ID NO: 5910 - DNA, 294 bp, Methylobacterium sp.
ccggccccggagcatcacccagagcccgagccgcagccggagcccgcgccggaagcggccgcgcacgccgcgccggccgccgagacgcccgccccgcaatccggcagcggcgatggcctgcatggggatgcccgcatcgacgacgtcatcgagagcctgtcgcaggccctcggcgcggcgatccaccagcagcccgatcccgccgccgagaacaaggacgggaagagcgaggatcccgcctcgatgttcgagcgctggactgtccgcccccgccggacccagcagcagacctga

SEQ ID NO: 5911 - DNA, 162 bp, Methylobacterium sp.
gtggtcgtcaatggcgcggccgtgcctgcccgaccacgcgagcggatcttcggcggtcccgcaccggacgggccgctcccgggccatctcctcgtcctgctgagccgccttcaccgggccgaggccgagcccaaggaccggccggaggccaagctcggctga

SEQ ID NO: 5912 - DNA, 240 bp, Methylobacterium sp.
atggccgccgccctgaccctggcctccgtcaccgcctgggccgacccggtgagccagacgggcaccggcggcgggcccgccaccaccgccaaggcgccccataccgccgcgaccggccagacggtgcccaatcccggcgccctcggcccgaacgagaccggcagcatcgagcgccgcgacgccgtcgaggagcgcaacgacgcgatcacccgcggcatctgcatcggctgcaaccgctga

SEQ ID NO: 5913 - DNA, 405 bp, Methylobacterium sp.
atggatgacaggcagatggcccgcgggctggcttggttcgggatcgggctcggcctcgccgagaccttcgcgccccggcgcgtcgcggccgcgaccggcctcgacggccacgagggcctgatccagctctacggcctgcgcgagatcgcctcgggcgcggcgatcctggctgccgccgagccggagcggcttctcggcctgcgggtgggcggggatctcctcgatgccggcctgctggcggcccgcgccacgccctcgaacccgcggcgcaaccgcaccctggcggcggccctggcggtggcgcccgtcgtcatgctggatgccgccatctggctgagagcgcgcgacaggcgcagcccatctccgggcgatcccggccggaagcccggcgcgatcgcgcgatga

SEQ ID NO: 5914 - DNA, 1176 bp, Methylobacterium sp.
gtggaggacgaggcgatgtcagagggattagcggcgcgtaccgtcgcggcggccaacggcgtggcccaggacgcggccttcggcgcggtgatcgcgccggtccacctgtcgacgaccttcaagttcccggccttcgagcagcccggcccctacgattactcgcgtctgggcaacccgacccgggacgcgctggccgacacgatcgccaagctcgagggcggcgcccgcgccgtcctggtggcgagcggcatggcggccctcgacctcgccctgtcgagcctgcggcccggcgatctcctggtcgcaccgcacgattgctacggcggcacgcaccgcctgctcagcttccgcgcggaccggggccattaccgcgtcgccttcgtcgaccagaccgatccggacgcgctggcggcggccctggcccaggggccgaaggtcgtgctgatcgagacgccgagcaacccgctgatgcgcgtggtcgatgtccggcggatcaccgctgacgcgaaggcggccggcgcgctggcggtggtggacaacaccttcctgtcgcccgccctgcagcagccgatcgccctcggggcggatctcgtcgtccactccaccaccaagttcctgaacggccattccgacgtgatcggcggggccgtgatcgctgccgacaaggcgatgggggaggacctcgccgcctgggcgaacacgatcggcgtcaccggctcgcccctcgacgcctacctgacgctccggggcctgcgcaccctgttcgtccgggtggagcagcagcagcgcaacgccgcggccctggcggccttcctcgacgcccatccggccgtggcccgggtccactatccgggcctgcccacgcatccggggcacgccctggccaaagcccagcaggcgggcttcggggcgatgctgagcttcgagctggccggcggccgcgacgcggtgaggaccttcgtggaggccctgcgggtgttcacgctggccgagtcgctcggcggcgtcgagagcctgatcgcccatccgccgaccatgacgcacgcggcgatggacccggaggcccgcgccatcgcgggcatcaccgacgggctgctgcgcctgtcggtcggcctggaggcggaggccgacctgctggccgacctgtcgcgggccttccgggccctggacggctga

SEQ ID NO: 5915 - DNA, 1023 bp, Methylobacterium sp.
gtggtcacggatcccaagctcgcagtcatcattacctgttacaactacgaaaattttgtcggtcgagcgattcagagcgttgtcgaccaacgcaatgactcttgtgagatcgtcgtgatagacgatggatcgacggatgactcgtggtcgattatccagcggtccggcgtcgcggcattccggattccgaatggcggccagagggcggcctgcctgtacggattggccaagacccgggccccgtttctgctctttctcgacgcggacgacgagcttctgccgggtgctctcgaccgtattctcgcggagctagatccgaccgtcgccaaacttcagttctgtctgagatgcgtcgattcgacaggggcgatcctggccgacccttaccccgctctcggcgcgttccgcgggcaggacaggactgtcgaggacatcctgcgctcgggcgtctaccagacgccaccgacgtccgggaatgtcttccgccgcgatgtctgcgatctgctccatcaatgcacgtacgaccaagcagtcgatggcgtgatcctgttggctgccccgttcatgggtgagatcgtcagcctttccgaaagtctcgggctctaccgtgttcatggccgcaacgattcgggtctgggccgcgtcctgcgcgctgccaccgtcgagcgagatcttcagcgtttccagttacgtctggggcatctgcgcagtcttcttcgcgattggcgtcccgggatctcgctcgtcgagccagagaagacatactattttcagttcctcgagttctgcatggcgatcctccggggtgtccggtacggtggcaggccgttcctgggcctgatcagatctgtcctgatcgagccgcgttcactgaagtggagaatagtgaatgcgctcttcgtagtcgcgacgtttctcgcgcccgttcgctgtgcgcaggcgttgctcgccttccgcttctcgctcaggcgccggccggtccgacagatcctgcgcgccaagatcggtgcggggcattgttga

SEQ ID NO: 5916 - DNA, 765 bp, Methylobacterium sp.
atgcacctacccgagacggcagcccgtatcgtatcctgcgacgtcttcgacacgctgctcctgcgcgatcaccggtccgagcgctgccgcttccacgagatcgcggccgtcgcgtcgcagctgctcgcggcggaacacggcgtggcgcgccgtccgggcgcgatctacgccgcgcgcctggaggtgcagcgagcggcctaccgggcgctcgacttggccaatccctcgggcgacgtgcgcttcgccgacatgctcgcggccatgacgcgcgtcctcggcctcgatgatcgggccgcggacatcctgtatcgggccgagatcacggtcgagctcgcccagctgcgcgcgaacacccggctgatgacgtggctgaggggccgcgcgcgggccgggggcaggatcatcgcggtgagcgatacgtaccaccgcggcgagaccatcgcgcatctgctgaacacgctggctcccgaccatcccatcgcgcgcgtctacaccagtgccgatcacgacgcgaccaagcggacacgggcgctcttcgatgtcgttctccagagcgagaaagtgccccccgccgagattctccacctcggcgatgacacgctggcggacgtgacgatggccgccgccgcgggcctgaggacggcacaactgctccggccgcgccacgtggtgctgcgtcgccgcctcgatgccgtccgcgctcgcgtgttgcaccggcactggatcggtgccgcccggagcggggccaggaggatcgggccgtga

SEQ ID NO: 5917 - DNA, 1308 bp, Methylobacterium sp.
gtgagcgcgaccgacgccgcacgcggccccgcgggcgacgacgcggtcgcgttcggccagcgcgtgctgggcccgatcctcgccgagttctgcctacgcctctggctcgcggaacgcttcctcgcgccggacaggaccgtcctcctgttctgcgcccggggtggcctgcgcctgcaactcgtctacgagcgcttcctccagcgaaccggcctgccgcagaacctcccgcgcgcggccctgatggtctcgcgcctcgtggccgcccgcaccgccttcgatccgccgagccccggcatgctctccgaactcggtcgggagttcagcggccggtcgatggcggagatcgcggcggcgctggcgcaacgcgacgatctggcccttccggagtcctggaatgagcccttcgaggagggggcattcaccgcgctgctttccggcaaccagcccggcgtggcccgccttcacgccgcgatcgcccagcaggatgcccggttccgcgcgcatctcgaggcctgcgcgggcccggcgcgccactgcgtgctggtcgataccgggctctacggcagcacggtccgcatgatgcaggagggcctgccggagcggacgtggtcaggtctccaactcgctcgctgcaactacaagcgcctcgccacaccgcatttccgccgcacgttcggcctgagtgtcgagagcgactggtacaagccttgggacgcgcgcacgtcggtgctgcgcttctggcacctgatcgaggcctgcctggaaccggacctgccgagcgtccgcaccttcgcccaggccgtcccgggatcgccgccgcgggctaatcttcaggacgacggctgggaggcgcggatcgcatcgacgcggccggacctcttcaccggcgtcctggcccacatcgacgagcttcgctccgagagcgtcgcggcgatcccggacgacgcggcgcgggcgtgggcggccctgaagaaggcaatcatctggccggatgaccggaccgtctcgaccttgagtctcggcggcagatcccgcgatttcggacgcgtcgagttgagcgcgcagtacgccacgccgcggccggcccgacccgcgcagcagatccgcgacagtctctggcgcgaaggtgcgcttctccgcttcttcccgcgggccggccggttcctgcttcccgtgatcgaggccgtctacgcgggccgcgcccttcaaagggaagccacgtcccgtctcgtccgccgccgcgagcccgcgcccgaggcgcgcgcggagccgcccctttggcgccggcaggcctccggcgcgaactga

SEQ ID NO: 5918 - DNA, 1107 bp, Methylobacterium sp.
atgcccgaatgcctggtcttccgcgtgcccgcgcagcatcccgccgacgtctccgaggtgatgggcctcgtcgcctccggagcggtggacgcgaccgagatcgtcgcgatcttcggcaagaccgagggcaacggctgcgtgaatgacttcacgcggcagctcgcggtgatggccctggagacggcactcgccaccgccctcaactgtacggcggcggaggtcggagcgcggatcgccctcgtcatgtccggcggcaccgaaggcgggctgtcgccgcacttcctcgtcctcgcccggcgtgaaggccccgcggtgccggagagcaaggcgctcgccatcggcacggccttcacccgggagttccgggcggaggagatcggccggatggcgcaggtcgaggccaccgcggcggcggtcggccgggccatggcagaggcggggctcaccgagcccgcggacgtgcatttcgtgcaggtgaagtgcccgctcctgacgagcgctcggatcgccgaggcggccgcccggggccacggcgtcgccacacacgatacctacgcctcgatgggcttatcccgcggcgcctcggcgctcggcatcgcgctggctctaggagaggtcgaccgcgaacatctcgcggattccgccatcggcacccgacgcgatctcttctccggccgcgccagttgctcggcggggatcgagctgatgcgcaacgagatcatcgtgctcggcaacgcccagggctggaccggcccgctcgccatcgcccaccgggtcatggacgacggcatcgacctgcccgcgattcggcgggtgctcaccgacctcggcctcctggaggcggggcagttgccgcctcatgagtcggagcgcgtgatcgccctgctcgccaaagccgagccctcccatgacggccggatccggggacggcgccacatcatgaacgacgacagcgatatcaacgccacccggcacgcccgcgccctggtcggcggcgtggccgccgcggcgatcggtcggacggacctcttcgtctccggcggcgctgagcatcaggggccggatggcggcggcccggtagcggtcatcgcccgcgtgaggggctga

SEQ ID NO: 5919 - DNA, 1329 bp, Methylobacterium sp.
gtgcggatcccgtccctcaccacccccgcccggcgcgtcggcgccgggctcgcggccgccctcgcggtggccgtctcaacggccggcctcgtcgcctccggcgccctggagcgcagcgtcgtcgcgcgcgacgtcgagaccccgctgagcgcggaggccgtgcgcgctctcgccccccgcggcgccaaggtcgccgccgcggccgactgcttcgcctgccacacggcccggggcggcgccccctgggcggggggactgcccctggagacgcccttcggcacgatccacgccaccaacatctcgccgagcccgcagggcatcggcggctggagccgcgccgacttccaccgggccctgcgcgacgggatcgcgccgggcggccgccacctctacccggcgatgccctacacgtcgtatcgcggcctgacgccggaggatgtcgacgccctctacgcctacctgatgacccgcgcgccggtcgcggtggagaacagggccaataccctcgccttcccgttcgaccagcgctggaccctggcagcctggaacctcctgagtctgccggcgaccgtcgccgcgcccgatccgggccgctcccccctgtggaaccggggccgctacgtcgccgacgccctcggccattgcggcgagtgccacacgccgcgcaccgtgttccaggccatgcgcccggacgccgtctatcgcggcgccacaatcgagggcgtcgaggcgcccgacatcacgccgacgggcctcgcgcggatgggcttcaccccgcacgggctcgtcgggttcatgcgcacgggcctctcggcccagggcggcgcgacgcaccagatgttcgacgtcgtgcatttctcgacgcagcacatggacgcggccgacctcacggcgctctccgcctacctgttcgaccgcgacgccctgccggccgagcccgagacgccggtcgccgccacccccgcggcgatccccgcggcggtcgcggcccggggtcgggccagctacgccggcctctgcgccggctgccacggcggggcgggggaggggatcccccacgtctccgtgccgctgcggacgaacaccgcgatgcgggtcgcgggcgcgggcggcctcctgcgggcgatcctcgtcgggctcccggcgcagcgcttcccgggcaacgagcggatggaggccatgccgcccttcgccgccctgatcgacgacgcggcgctcgccgacctcgcgacctggatgcgggccgagtggggcgggcagggtcaggcggtcacgccggacgaggtcgcgcgccagcgcgcgggtttgcgggccgacgcttcgcactga

SEQ ID NO: 5920 - DNA, 939 bp, Methylobacterium sp.
atgcgcttcatctccgaggaggactccgccgccctggtcgatcacgccatggcgttcgacgcggcccgcgaggcgctgatcgccgcggtggcgccggggaccaccctgttcccggcggtgctcggccacggctcggagccgaccaaccggttctcgatcaagtcgggctccacggcggactatgccggcctgaaggtcggctcgttctggcccggcaatcccgatcggggcctgccgcggcacaattcggtgatcctgctgttcgaccaggccgtcggccgggtcgacacggtgatcgaggccgggctggtgaacgcctaccggaccgccgccgccgacgcggtggcggcgagcgtcctggcgcggccggactcggcggtgctcgccgtgttcggggccggcaaccaggccgagttcgagtgcgcggcgctcgcccggatcctgccgatccggacggtgctggtcgtcgcccgggacgccgccaaggtcgcgggctttgccgagcgcctggcggggcagggggcgtccgggctcgacgtgcgggcggccgcgccccgggaggcctgcgcggcggccgacgtgatcgtcacggcgacgccggcccgcgcgccgctgttcgaggccgactgggtccgccccggcacgcacgtcgccgccatgggggcggacgccaagggcaagcaggagctgccccccgccctgctggagcgcgcggccctgttctgcgacctgccggagcagtcgcgcaccatcggcgagttccagcacgcctccgcggacgcccaggccggaatgcgggcgctcggcgacgtgctccggagcggggaggggggccggacggatccggaggcgatcaccgtgttcgattcctccggcatcgccctgcaggacctgaccatcgcccgggcgatcctcgccaaagccgacgcgcgcctgtag

SEQ ID NO: 5921 - DNA, 906 bp, Methylobacterium sp.
atggccaccctcgcacgctcggaggtcctggcgctcgatcgcgcagcgcgggcccggccgcgcatcccctcgggggtcggcggcgtcctgccgggcacgctgctggtcgtcctggcgcttctcgggccgctcgccctgatgctccgctacagcttcaaccggttcgtccccggtgagctgatggtcgaggggctcaccctcgccaactacgccaagtttctgcacgacagcttctatcgggacgtcttgctgacgaccctctgggtggcggccctctcaacgctgatctgcctcgtgctcggcttcccggtcgcctatgccctggtgcggcaggtcgggccacgctggaagtcgaagctcctgatcctcatcatcctgccgctcctcatgggcaacgcggtccgcaccgccgcctggatggtcattctcggcgacaagggccttctcgccgccctgctctccgggatggggctcacgccgccccggttgatgtacacccccagcgccgtggtgatcggcctcgtctcggtgacgctgcccttcatgatcgtgacgctgcagagcgtgctcgagcggatcgatccggtcctggaagaggcggccgagagtctgggcgccgggcacctcacgatcctgcggcgggtcgtgctgcccctcgcgctgcccgggctgctcgctggcacgatgctgtgcttcatcctgtcgatgaacgcctacgccacgccggtgctgatcggcggaccgcaattccacatgatggcgcccgaggtctaccagcaggtcgccaaggcgatgaactggccgttcggtgcggccctcgccttcgtgctgatgacggtcaccctcgtgctgaccaccaccgccaacgtcctcgtacagcgccgctaccggcgctggtcggagtag

SEQ ID NO: 5922 - DNA, 1128 bp, Methylobacterium sp.
atgcagatcgggatcgtcggctgcggttacgtcgccgacttctacatgacaaccctcgtgaaccaccccgaactgcgcctcgccggcgtctacgaccgggacccggagcggcgcgccgtcttctgccgtcactacaacgcccgcgccttcgacagcctcgaggccctgctggccgagccggagatcggcctcatcctgaatctgaccaatccgcacagtcactacgtcgtgaccaaggccgccctggaggccggcaagcacgtctactcagagaagccgctcgccatggagtacgcccaggccgaggcgctggtggaactcgccgaggcgaagggcctctcgctgagcggcgcgcccgcgagcatcctgggcgaggcgggcgcgaccgtgcgggaggccgtcgcgtccggccaggtcgggtcggtccggctggtctacgccgagctggaggacgggccggtgttccgcgagccggtgcatgaatggcggagcgtgaccggcgccccctggccggccgaggacgagtaccgggtcggctgcaccctggagcacgccggctactacctgacctggatgagcctgatgttcggcccggtcgagcgcatgactgccttcgcgtcgcgcctctacccggacaagggcaccggccagcccccggacacggtcgccaacgacttctcgacggcgtgcctggaattccgatccggcgtcgtcgcgcggatcacctgcggcctggtcgcgccgcaggaccgatccctgcacatcatcggcgaccggggcgtcctgaccgtgaccgattcgtgggccagccagggcccggtctatctccgttcgccgagcggcgaggcgcccgggcggctcggccggctgctgcaccggatccagcgctacctgcccggccgcatcttcctcggtcggaagctgccgactccccgcttcgggggcaagctgcccagctacccgtcgcagatggatttcgcccgcggccccgcggcccaggccgcggcgatccgggcgggcgttccggcgccgctcccggcgcggttcgtgctgcacatcaccgagatcgcgctcgccatgcagaatgccggcggcggcgccgtgatccagctgagatccaggttctag

SEQ ID NO: 5923 - DNA, 291 bp, Methylobacterium sp.
atgcgccgggcctggcccatcgggactcccatgagaaagttgctcgcgttcgccgtggccgtcgtcgtgtgcgcgggtcccgcgctcgccctggccgatcagccggctcgggattgtgaccgggaccccgagacgacgggcgcgttgcccggtgatccccgcagtctgtacctgcctggcgagcgaccggtgaaggccgaccgagacccgccagaggccagctggcaggacgaggcccgagagacgtccgagcagcgcaggcgcgatctcctcgcctgcggcgtggactga

SEQ ID NO: 5924 - DNA, 231 bp, Methylobacterium sp.
atgaagcacatcatcgttctggcgatcgcggccacggccctgacggcctgcaacgcggcgaaccggcccggccgcggcgagctcttcatgagcgaggccgacgtcgccgcgaaggacgacgcgatctgccggggctacggcgcggagccgggaacgccggaatacgtgcagtgtcggggaacccaggaccagcggcgcgacgccgcccaggcgccccgccgcagcggctga

SEQ ID NO: 5925 - DNA, 819 bp, Methylobacterium sp.
ttggcggcgatttggctgacggccctgatccgggcgctgacctccgggaccgtggtggtgctcgcctccgtcctggccgagtggctgggaccggtctggggcgcgctcgtcgtcagcctgccggtctctgccgggccggcctacgtgttcatggcgatggagcacgacgccgccttcgtggccggggcggccctgaacggcttcgcggcgaacgccgcgacgggcctgttcctgatcgtctacgcccaccgggcggccggccgggacatgaccgccaccctcgggccggcgatcctggcgtggctcgcggcggccctgccggtctcggctttcacgtggacgccgacgacggcgttcctgctcaacgccctggtgtacggggccggcgcgctctcgacccggcatgttgtgcgcgcgaccctcgtcaggagcgccgtcgtcgtgaggccgcgcccgctggatctgctgatccgcgcgagtgccgtcgcgctgttcgtcgccgccctcctggcgctgagtacggccctcggccccgccaggaccggggtcatcgccgccttcccggtcacgatgacgagcgccttcgtcatcctccatcgccgcatcggcggggcggcgatggcgcggctggcgagcgtcgcgatccgcggggtgttcggcttcggcctgaccctgctgacgctccacctgacgatccagccctacggtgccgcgctcgcgctgacggtcgcgctcctcgtctcgctggtctactcggcgggactcctcgtggtgcagccccgtcccggtcggcaggagcccggcatcgtcacgcgctga

SEQ ID NO: 5926 - DNA, 867 bp, Methylobacterium sp.
atgagcggtctgccccgcgccgcgccggactcggtcccggactcgatcccggactcggctccggcgacgaccccgctggcgcgcaccggaatccgccgccgcgggatcctggtgccggcagtcagcgccgccacggtgctggcagccctcggcctctggctggtcgccacccgtgtaggctgggtgaagccgctgttcctgccgccgccggaggcggtcctggcggccttcggtcaggcttggcgcggggagatcgacggcgccccgctcgggctccacatcggcgacagcctcctgcgcgtcctcggcgccttcgcgctcgccgccctggtgggcatcccggtcgggctcgccatgggcacgagccggatcgcccggggcatcctcgacccgccgatcgagttctaccggccgctgccgccgctcgcctacctgcccctgatgatcatctggttcgggatcggcgagctgtcgaaggtgctgctgatcttcctcgcctgcctcgccccggtggcgctcgccgcgcgggcgggggtgcgctccgcctcggtcgaccagatcaacgccgcgcgcgccctcggggcgagccgctggcaggtcctgcgccacgtggtcttcccggcggcgctgccggagatcctgatcggcctgcggatcggcatgggcgtgggctggaccaccctggtggccgccgagatggtggcggcccaggccggcctcggccagctcgtcctcaacgcctccaatttcctgcggaccgacgtggtggtgatgggcatcctgctgatcggcctgttcgcgggcctgttcgagctcgggatgcggggcctggagcgcgtgctggtgccctggaagggccgacactag

SEQ ID NO: 5927 - DNA, 195 bp, Methylobacterium sp.
gtgaagtggttcaacgagaccaagggctacggtttcatccagcccgacgatggcggcaaggacgtgttcgttcacatctcggccgtcgagcgtgccggccttcgctccctcaacgagggtcagaagatctcctatgacgtcgaggcggaccgccgcagcggcaaggagagcgccgccaacctgaaggcggactga

SEQ ID NO: 5928 - DNA, 1497 bp, Methylobacterium sp.
atgcagcgtccggacgatgcgcagtgggacgtggtcgtggtcgggtcgggcaacgccgccatgagcgccggtctcgccgccctggagcgcggcgcctcggtgctgatgatcgagaaggccgagcgggacctggccggcggcaacacagcctacacggccggggccatgcgcttcgtctacgcgggcaacgacgacctgatcccgctgctggtcgatcccgaggacccgcgcctgccgcggaccgatttcggtgcctacacggcgcagaaattcgaggcggacctgctcggcttcaacgacgggcggccgctctcgcgcgagcagcgcatcctgatcgacgagagcggcgcggccctgcgctggctggcgacacagggggtgaagttcgagccgatctattcccggcaatcgttcgagaaggacgggcgcttcgtgttctggggcggcctgacgctcgccacccacgacgaggggttcggcctcgcccgggccgagctgcaggcctttacccgggccggcggcgagatccgctacggctgcccggcccggggcctgatcgtggaggacgggcgcgtcgtcggcgtggagacgctgcagggtccggtccgggcgacgtccgtggttctggcctgcggcggcttcgagtcgaacgccgccctccggacacgcttcatcggcgagggttgggacaaggcccgggtgcgcggcacaccccacaaccagggcgacgggctgcagatggcgctcgacctcggcgcgaaggcccatggtttctacggtggctgccacgccacgccgatggacctgcacacccccgattacggtaacctcgacctgccacacggcgagcgcaagcactaccggaagatctgctacttcctggggctgatgctgaacgccaacggcgagcggttcgtcgacgagggcaagaatttccgcaactacacctacgcccagttcggccgctcgatcatggagcagcccgggcacgtggcgtggcagatcttcgacgccaaggtcgatcacctgctctacagcgagtaccggttccacgacgcgcacttcgtcgaggccgacaccctggacgggctcctcgacaagctcgagggcatcgaccgcgcggcggcgcgccggaccatcgcggcgttcaacgccgccgtggacgagagcgtgccgttcgacccgaccgtgaaggacgggcgcggcacgaaggggctcgccctgccgaagtcgaactgggcgcagaggatcgagaccgggccgttcaaggcctacccggtcacgggcggcatcaccttcacctacggcggcgtcgaggtcggcgacgacggcggcgtgaagcgcgcggacggcgacacgatcccgggcctctacgcctgcggcgagatggtcggcggcgtgttcttcaacggctatcccggcggctcggggctgacctccggcgtcgtgttcggccgccgcgccggctacggcgccgccgcgagagcgaagggctga

SEQ ID NO: 5929 - DNA, 333 bp, Methylobacterium sp.
atgcgctccatgcctcatacacatccgccctacgccgccgagttccgccgccagatggtcgaattggtccgtgccggacgcgacccggccgatctcgcccacgagttcgagccctccgcccaggccatccgcaactggttcgctcaagccgaccgcggtgagagccgtggcgcctccaagagtgacgtcctgacgctcgccgagcgggaggaactggcccgtctacgccgcgaggtgcggcagcttcggttggagcgcgacgtcctctcaaaggccgcggcctggttcgcacgggagagcggcgcggtgccgtcgggctcttccagttcatga

SEQ ID NO: 5930 - DNA, 153 bp, Methylobacterium sp.
atgtcggacgggggcgcccgcctgaaggtcgtcagcgtgatcggcgtgcccgacgcgttcgtgctggcctacggggtcggcggtcggcgccggccggcgcgcgtcacgtggcgccaggagaccgagctcggggtctcgttcggcgacgcctga

SEQ ID NO: 5931 - DNA, 312 bp, Methylobacterium sp.
atgatgcgcgccaaggtgctcggcctcgtcgcggtggccgccgcggctctcgcgaccgccacgacggccaacgcggcgcccttcggctacgggccgcccgacgccggatcggtgatcgagcgcgtggccggaggctgcggtccgggcttccatcccaatccttggggccattgccggcccaacgatcgcggctggggctggggcggcccgcggggaccctacggcggccggcccggctacggcggctacgaccgcggctacggcggctatggcggctacgagggcccgcgccggtcctacggcggctggtga

SEQ ID NO: 5932 - DNA, 441 bp, Methylobacterium sp.
atgatcgccggcctcgtggccggcgcctcgccggccgccgcgctctccgcgaaggattgctcggtcaagtatcaggccgccaagcaggccggcacgctcaacggccagaagtggaacgacttccgcaaggccgagtgcggtgcggcggccgacaacgccccgacgaccgcgccgaaccccgtctcgccgaccgcgacgacggctccggccgcgccgccggccgccccgcgcgccgggacgacgtccgccgccgcggcctcggccacgttcccccgcgccgtcgatccgaaatacgccaaggaatcggccggcaaggcccggatgcacacctgcctcgacagctacaacgccgcgaaggccgccggcacgctgggcggcatgaagtggatcgagaagggcggcggctactactcggcctgcaaccggcagctcaagggctga

SEQ ID NO: 5933 - DNA, 462 bp, Methylobacterium sp.
atgcgtcgcgccctcgccgccctggttctcgccctcccgcccgccgtcccgctcaccgccgcggcggacgatcttccgccgccggtcgcggcggcggccgcgcgggccgaggcgtcctgcgggtccgagccggccacgctcaagccgggtttcgtcacccgccaggacgtgaacggcgacgccgtaccggacttcatcctggatttcgcggccgtccaatgcggcgatgacgagtccgccgcgtgcggcaccgcgggctgcgagatgcaggtcttcgcctcgacgacggacgggttcgtggacgccttcgacgccgtcgcccacgacctccgcttccgcacggtgggaggccgcccggcggtcatcgtcgatatgaccggggcgacgtgcggacgatccgggcaggatccgtgcggcgcgatcgccgtctggaacggcaggacattcggccggacacggtag

SEQ ID NO: 5934 - DNA, 441 bp, Methylobacterium sp.
gtggagatccagcgcggcagccggatcggcccgcgctgcaagatctcctcgcacagcttcatctgcgcgggcgtctcgatcggggccgaggtgttcgtcggccacggcgtggtcttcaccaacgagctctacccggaagccactaacgcggacgggagcctgaagcgggacggcgagtgggagctcgtcgagaccgtggtcgaggcccgcgcctccatcggctccaacgccaccatcgtggcggggatcaccatcggcgagggcgccctggtcggcgccggtgccgtcgtcacccgggacgtcccggccttcgccatcgtcgccggatgccccgcgcgggtcgtcggcgacacgcgcaccaagcgcgccgagagcgccgcgcgcgcccgttccgtccagtcgccgcggcccgagccggccgagcctctgcaggttgcttga

SEQ ID NO: 5935 - DNA, 606 bp, Methylobacterium sp.
gtgagagggcggccgcggaaggagcccggcgatcgggcggccgatcgccaagctctgatcgcggccgcggtggcgatcctgaacgcgggcggcgcggcggcgctgaccgcccgcggcgtcgcggagcgggccggcacggcggtcggctcggtctacacgcagttcgacagcctggaattgctgcggctggaggcgaacgccgtcaccatgcgccggctccgggacaccctcgcgggggcgctggcggcctgtccgtcgcgggagacggaggcgcggctcctgtgcctggctgacgcgtatctcgccttcgcggccgagcaccacgccgcctgggcggcgatcttcgagcggcgcacggtggcggcgccggactcggtgcaggccgacatcgcggccctgttcgggatcctggagggggtgctgcgcgacggtggccgcctcggcgaggcggcgatccccgtgatggcgcgggcgctgtggtccagcgtccacggcatgacctacctcgccgatctcggcagcctgggtcccctcggggtcagcgacgtgcggccgatgatcgacgcgctggtgcgggccgcggtccggggcttctccgcgggctga

SEQ ID NO: 5936 - DNA, 693 bp, Methylobacterium sp.
gtgatcagtcaatcccacctgcacacccgcagagccgaaacgatatcggggatcggctccgcccaggaacggcgggttcaggccggcggcaccccggccttcccggacccgaccctcgtggaggcggcgctccatctcctggcggagcatctcgagcaggggctggcggtgaccgaccggtacgggcgggcccatttcctgaaccgcgcggcgcaggccttcgtcgcgcgcggcctcctgtgcctggagcacggcggcctgcgcggcgcgacgcccgaggacagcgcggcgctgcgccgggtcatcgcccgctgcgccgcgggccatcgcggcggctcggtgcgattggagggcgcgggcgggacgctcctggtcgccgcctcggtgattcccgggacgctcggcccgatcggcgagggcgcggttctcctgcgtctcaccgaccccgggtccccgcgcctgccggatcccggcattctccaggaccagttcggcttcacgcccgcggaggcggccctggccgtcgacatcctggccgggaacgacctcgcggcgagcgcgacgcaccgccggatcacccggaacaccgcgcgcgtgcacctgcgccacctgttcgagaagacggggacgcgccgccaggccgagctggtgcgcctgctcctgctctgcccgcagccgatcgcggacgcctag

SEQ ID NO: 5937 - DNA, 114 bp, Methylobacterium sp.
atgggcaacatctggatgcgcaaacttcccctcgtcctgctcgccgtcacggcgatgtcgggctgcacgtacctgcccgcggcgggtccgacggcgggcgcgatccaggccggg

SEQ ID NO: 5938 - DNA, 987 bp, Methylobacterium sp.
atgagacggcgcgacgtcatcgcgggcctcggcggcgcggccgcgtggccggccctcgccgccgcgccggcgaagggtcagcgtcgcctggggatcctgctggtctacggcgaggcgcatcccgacagtcccgtcatcgtggagacgctgaaggagagcctgaagcgggccggctggatctggggtgagaacctcacggtcgacctgcagtacggcaacggcgacgccgagcggatgcgcgttcaggcggaggagatcgtcgcgcgcgtgcccgacgtggtgctcgcgcagggcgtcgtcggcgcgaccgcgctccagcgggcgaccacgacggttccggtcgtcttcatgatgctccaggatccggtcggcggcggcttcgtgaccaacctgtcgcggcccggcgggaacctcaccggcttcaccaacttcgacttcgtcctcgtcggcaagtggctgcagctcctgaaggaactcagccccggcgtgacgcgggcgctcgccctcatcaaccccgattaccgggcgcgcttggcgggctacacggtcgagatggcccggatcggcccggcactcgggatcgatgcccggatcgccggcgtgcacgacgcggccgagatcgaggcggcgatcgccggctttgccgcccagccgaaaggcggcctcatcgcgctgccggacgcggtgaccggggtgtacggccagctgatcgtcgatctggcggccacctaccgcctgccggccgtgtacgcctacgcggcgccggtccgcctcggcggcctcgccgcctacacgaccagcgtcgagcaggacgtgcagcgtgccgctggctacatcgatcggatcctgcgcggcgcggtggtcggcgacctgccggtgcaggcgagcgagcgcttcatcaccctgctcaacctgacgacggccgcctccctgggattgaccatcgcgccctcgctgatggcgaaggtggacgagctggtcgagtag

SEQ ID NO: 5939 - DNA, 450 bp, Methylobacterium sp.
atgcacgcggtccatgaactcccgcccatcaccatcacgacccgcgacttcgaccggctcgtggtcttcgggctcgacgcctatctccgtggcgaccgccgagccgacttcctgctttcggagctgaagcgggcgaccctatgcccgccccgcgcgctgccgggcgaggtcgtctcggtccaccgctgggtgcactaccggctcaatgacgatccgaccgtgcgagggcaactcctcgtgcatccccacgatctcaccgacctgccgggcggactctcggtcgcgagcccgctcggcacggcgctgctcggcctgcgggtgggcgatcggatgcccttccgaatcgacgatgccggcatccagcacgtcgtggcagtcgtgggcatcggccggcgcttctcagatgagccggtccgcggccgtggggcgcccgcgccgcgcgaggcctag

SEQ ID NO: 5940 - DNA, 555 bp, Methylobacterium sp.
atgggctcacggctcgtcggcgtgctggcccgcctgtccgcggctctggatgccgccgaggccgggcggcaggttccgggtgccttcaaggacgatctgatcgccctggtgccgcgcctgcgccgctacgccctgtcgctgacgtacgacggcgtcgaggccgacgatctcgtgcagttcacgctgctcaaggcgtgggagcaccggcagcgcttccagcccggcacgagcctcgtggcttggctgttcacgatcttgcgcaacggcttcatcaacggacgacgcaagcgacgcctcgaggtccccgatcccgacggcgcgcacgccgtcaccctctccgaaccggccgcccaggagcacagcatgggcctgaaggaggtccgggccgcgatcgaccggctcgagccggcctatcgcgaggcgctgatcctcgtggccgtcgacggtctaccctacgaggccgcggcctccgtgatcgggtgcccggcgggcacggtgaagagccgggtcagccgcgcccgcgaccgcctgcttcacgaactgggcgagcgctga

SEQ ID NO: 5941 - DNA, 258 bp, Methylobacterium sp.
atggccgaaggcgcggaaggaatgcgcgactggcacgtactcatcgtcggcggtttgcccaccgacggccaaaagcgggcaacggtcatcggcgggatcgcagacggccttcgccgcggcggagcaggtgtgcggatcgtgaaggcagccgatcgctccgagttcgatacggaagccggacggctcaaggatgcccgcagccacctcaatctgattgagattgcctaccctgggctggtcgacgtgccggccggatga

SEQ ID NO: 5942 - DNA, 381 bp, Methylobacterium sp.
atgagcgccgccatcgagatcaaggacctctcgctccgcgtgaacggcgcggcggtcggtccgatccccgtccccgtcggcacgagcctgctcgacgtcctgcacgagtggctgggcctcaccggcagccgcatgggctgcgggcagggcatctgccacgcctgcacggtgatgctggaggaggcggccggcccgcgggagatccgcgcctgcatcaccggcgcgcactggttcgaggggcggagcatccgcaccgtcgagggccatgcccgcaccgcgccggacggcaccgtcgtgctctcgccggtccagcaggccttcatcgaggccttcgcgttccagtgcggctactgcacgccgggcttcgtcaccggggcgagc

SEQ ID NO: 5943 - DNA, 345 bp, Methylobacterium sp.
atggcaaccttcgacctgcggggtgggcacgggttcctgccccggtcgcggcgcggccggcgcggagggccggcgcggaccaccgacggcacggtgctcggccgctggctcctgtccacggccctgtgcctcgccctggcggcgccctgcccggcgcccgccctgccctgggtgctggcggccctgctgagcctgtcgggcttcgcgtggctcggccgggcgatcacgcgggccggaccgccggccaacgcccggcacctgaccgcctgggacgcggccctgctgtccttcgcggcgagcttcgccgtgcaatcggcggcgcgcctcggcctcttcggcggctga

SEQ ID NO: 5944 - DNA, 636 bp, Methylobacterium sp.
atgcggatcctgctcctcaaccccaacacctcggcggcgatgaccgcgcgcatggcgcgggccgccgaggcggcgctcgcccccgacgcgcacatcaccgcgctcaccgccgcgacgggcctaccctacatcgcgagccgggccgaggcgcagctcgccggcgcggccgtgctggagacgctcgccgcccaccattccggccacgacgccgcggtgatcgccgcctacggcgatcccgggctggtcgccgcgcgggagctgttcgacctgccggtcgtcggtatggccgaggccgcgatgctgaccgcctgccagctcggagcgcggttcgcggtcgtcaccttcgcgcccgccctgctgccctggtacgaggacgcggtggcgctggccgggctgtcggcgcgctgcgccggcctccacgcggtgcgccggccgttccaggcggtgacggacgtgcaggacgagctgcggcccgagatcctggccctggccgagcgggcggtgggggagggggccgacgtcgtgatcctagccggcgcgccgctcgccggcctcgccgcgaccctgcgggacgcggtgccggtgccgctggtcgacccgctggcggccgccctgggccaagcgcaggccctggtg

SEQ ID NO: 5945 - DNA, 1419 bp, Methylobacterium sp.
atgaacgcccccgttcccgccccgcggacccgcccggacgcggcgacgatcgcgggtctcgccgaggccctgcgggccgtgctcggggaccgggtgacggcgagcccggcggtgcgcgagcagcacgccaaccagctcacctgggcgccgtgcgagccgccggacctcgtggtcttcccgcacgccaccgcggaggtgcaggccgtcgtgcgcgcctgtgccgagcgcgacgtgccgatcgtgccctacggcgtcggcacctccctcgagggccacgtcaacgcgccgttcggcggcgtctcgatcgacacgggggcgatgaaccgcgtccgcgcggtccatgccgacgacctcgactgcacggtcgaggccggcgtcacccgcagggcgctgaacgcgtacctgcgcgataccggcctgttcttccccatcgatcccggggcggacgccacgatcggcgggatggcggcgacgcgggcgtcgggcaccaacgccgtacgctacgggacgatgaaggacgcggtgctcgcgctcaccgcggtgatgccgaacggcgacatcgtcacgaccgcccggcgggcgcgcaagtcgtcggccggctacgatctcacccggctcctcgtcggctcggagggcaccctcgggatcatcaccgaggtcacgctgcgcctgcacggcatccccgaggcgatctcggcgggcatctgcccgttcccctcgatcaaggcggcctgcgacgccacgatcctgacgatccagtccggcatcccggtcgcgcgcatcgagctgctcgacgaggtgcaggtggcggcctgcaaccgctactcgaagctcagcctgccggagaccccgctgctcctcgtcgagttccacggcacggacgcgggcgtgcgcgagcaggccgagcggttcggcgagatcgccgccgatctcggcggcggcccgttcgactgggcgaccggggccgaccagcgcgcgcgcctctggcaggcgcgccacgacgtgtattgggcctcggtcgcgctgcggccgggccccacgatcaagaacatgtcgaccgacgtctgcgtgccgatctcgcggctcgcggaatgcgtggaggcgacgaagcgcgacatcgccgcgaccgggctcacggcgccgatcgccggtcatgtcggcgacggcaacttccacaccctgccgctcgtcgatgccgacagccccgaggagatgtccgcggtggccggcttcctcgaccggctcgtcgcccgcgcgctggacctgggcggcacctgcacgggcgagcacgggatcggccagaagaagatgcgcttcatggaaagcgagcacgggccggaggcgctcggcctcatgcggaccctgaagcgcgcgatcgacccccggaacctcatgaatcccggcaagctgattccctga

SEQ ID NO: 5946 - DNA, 1575 bp, Methylobacterium sp.
atgcgcgtggccgtcggcgacctcagcgactacgccctaccttcggccagcgtcatcggtcggttggcaaccaacttcgagtccttgcgcagccgtcagctcgccttcctgctctcctccgccgagcgccggcccgcctcgctcggtcgcctgcgtgagaccatggccagcgtcgagacagacctcaaggattacgcccctcttgtcagccccggcgaagaagccctctggaaggcagtccaagacaccgtgccggcctattccaagatgggcgaggagttcttgcgtcggctcgccgagggtgacgagaagggtggctcggccttcctgctcgacagcatgctcccggccctcaacgccgcccgcactgcgctcaaggccgacgttcacttcaacgatgcgttcggccgcaaggccggcgaggccgccaacgcgctcggcgacagcgcccggaccgctatcgtcgtcgtgctgggcctgatcgtcgctgtgactttggccatctcttggatggccgtcgccaccgtttcccggcccgtgcgccggatggccggcgtgatgcacgaggtcgccaagggcgacctctctcccgcgatcccgagtgccggcgagcgcagcgagatcggcgagatggccgccgccctgcaggtgttcaaggacaacctcgcccgcacccgtcagctcgaggaggagaccgcgctggcccgcgcttcggccgaggagcagcgcaagcgcgccatgcgggagatggccgacggcttcgaggccgcagtcggcggtgtcatcggcatggtggcctctgccgccaccgaactgcaggcgaccgccagctcgatgagcggcatcgcagccgagacggccgcgcagtcgacagccgtggcagcggcggccgaggaagcggcctccaacgtcaacaccgtggctgcggcggcggaggaactcggctcctcggtcgctgagatcagccgtcaggttgaggactcagcgaacctcgcccaacgcgccgtcaccgaagccgatcagaccggcgccttggtgcaggagctgagcacggcggtctctcggatcgggacggtggtcagcctgatctcgacgatcgccgagcagaccaatctgctggctctgaacgccaccatcgaggcggcgcgggccggcgcctcgggcaagggctttgccgtggtggcggccgaggtcaaggcgctggccggacagacggcccgggcgacgcacgagatctccgagcagatcgtgcatatccaggcctctacgagccaagcagtggcctcgatcggcggcatcaccgggcgcatcggccagatcagcgccatggccaacgcgatcgcggcctcggtcgagcagcaaggagcggccacgcaggagatcgtgagcaatgtcgctcaggccgcggccggtgctggtgaagtgacgggcaacatcgcgggcgtggcgagcgcggccgacgagacgggggcggcggcgactgaggttcttggagccgcatccgagctgtcgcgccaatccgagagcctgacggctgaggtggcccgtttcctcgcaaccgtgcgcgccgcatag

SEQ ID NO: 5947 - DNA, 759 bp, Methylobacterium sp.
atgatgcgcgcgctcgaagggcaggtcgcctgggtgacgggggccggatccgggatcgggcaggcggccgccgtcgctctggcgcgggccggcatgcggctcgcgctcaccggacggggacaggaggccctcgcgcgcaccgcggagatggtccgcgctgcgggcggcgaggcgctggtcgccccggccgacatgggcgtggccgacgacgtgcagcgcgcctgggaggcggttcacgccgcgtggcggcgctgcgacctgctggtgaactcggcgggcctcaacgtgccgcagcgcggctggagcgagatcacgccggccggcatcgacgccgtggtcggcatcaatctcaacggccccttctacgcggcgcgggcggtgctgccgaccatgcgggcgcagcggagcggcctgatcatccacgtctcctcctgggccggccgctacgtctccaagctgacgggaccggcctattccgccgccaagcacgggctcgtggcgctctcggagagtctgaaccaagaggagtgcggccacggcatccggtcctgctgcatctgccccggcgaggtcgccacgcccctcctcgacaagcggccggtcccggtcaccgcggaggaccgcgggcgcatgctccagccggaggatctcgccgagacgatcctgttcgtcgcccgcctgccggtctccgtctgcgtcaacgagatcctgatcagcccgacctggaaccgcggctatctcgagggcgtgaagctctga

SEQ ID NO: 5948 - DNA, 1260 bp, Methylobacterium sp.
atgagccatgtcctatccgggccagtcccgtccgagatcctgctcgtcccccggggcgaggccgggcacttcctgccggcggccctcggctggctgggcaagcgggtcaccgtcaccgcccaacccggcccggcgaaccacgtcctctgcctgccggtcctcgatttcgtgcgtctcggcttcccggaggcgaacgggcgcctcgacctcctcgaaccgggagacgccgagaacctccgcgcggggcgcgccgcgctgctcctcgacctctcgaacgaggggccgggcctgcacgcgccgaccttcgaggcactgcaccggaacctcgaagaacttgggatcccgcgcgagcgggtgatcctggtcacgcagaaccggctgctgcggctcgactacgagcgcctctacggcgagggcctgcggttctggaccttcgagttcttcccgctccaggtcgccctctggctgaacgaggccgaggggccgcggctcttcccccagcatcccctcgaccgcgccggctacgcgcccttcgcccgggcaaccggcccggcccggttcctctgccagaacgcggccctgcgctggcaccgggtgctgctctaccgctggttccagctgagcgggctggaccgtgacgggctgatctccttccacggtatcggggaggacaacccgaaggcgggcggcatcgacgtcttccacgcgccgccggagatcgaggcggccttcgggccgctgctcgccgatgtcggcagctggatcccgcgccgggcgcggcggatcgatgccgatcagggcaccgacatggtcatgaccctcgacacccgcgcctacgcggagtgcgacctgaccgtcatctcggagaccgacttcttcgagccgggcgtcgagcggatcaccgagaagtcgatcaaagcggcggcgacgggcctgcccttcgtgacggtgggcgcgccgcgcgccgtcgagcggctgtccgagctcggcttcgagaccttcggcggcctgatcgaccaccattacgacctcgtgtccgacccggccgagcgcctgccgctcgtgttccggtcgatcgagcgggcctgggccgcgtgccgggacgaccgggcgcgctggcatcgcctcgcccgcgagcaggccgaggccaacgtggcccacgcgcggcgcggattgctgccgcagtacgagcgggtgatggtcgcgccgctgatcgagcggctgaaccggttcatggagacgggcgcaatcctccactga

SEQ ID NO: 5949 - DNA, 909 bp, Methylobacterium sp.
atggcggatttccgcagcttggaggtgttctactgggtcgcgaaactctcgagctttcgccgcgccagtgagaaggtgaacaccacgcagccggcggtctcccagcgcatcgcagccctggagcacgagtacgggacgctgttcgagcgccgcagccgggacgtcgcgctgacggagcggggacgcctgctcctcggcttcgcggagcggttcctggcgctccagaccgagatgagcgcggccctgcacgagaccggccggacgcggggcaccctgcggctcggcgtgtccgagaccatcgtccacctgtggctgtcgcgcttcatcgagcgcatgcgcgccacccatcccgggatcggcgtcgacatcacggtcgacatctcgccgaacatgcaggccgccctcgtcgccgacgagatcgacctcgccctcctcgtcggcccgatcaccctgccgagcttcgccaatcggcccctgttcagcacccccgtggcctggatcgccgcgcccggcctgctgccgggcgacgagcccctgagcctcggcgcgctgctgcaccacccgctcatcacctacccgcgcaacaccagcccgtacgtcgagctgcgcgacctcgtcctccaggagaacctcctgccgagccagatccacacgagcgcctccctggccacgatcgtgaagatgggtgtggagggcctcgggatctgcgtgatccccccggccgtggtcgaggccgagctccgtgccggcaccctgcgcgtcctgccggccgagccgcagctctcggacctgaccttcacggcgatgcacaccaagcggccggcccaccacttcgtggcggacgcggcccgtctggcccagcacgtcgccgagacctgggccgccgagacctgggccgccggccgataa

SEQ ID NO: 5950 - DNA, 816 bp, Methylobacterium sp.
gtgagccagcacccgggcgccgacggcgcgccacctgtcttcgccgacgcggcggacgcgcggcgcgcgatccgcgcgggtcggttccggggccacacctcgggtctcgtccccgcccacgcgcagggcaacctgatgatcctgccgcgggccatggcggaggatttccaccgcttctgccagcagaacccgaagccctgcccgatcctcggcgtctcgcagcccggcgcccgcgcactgccgacgctggggaccgatctcgacctcgccaccgacgtccccggctaccgcgtctacgagggcggcgcgctcgtggcggagctgcccgacctgaccggcgtgtggcgggacgacctcgtcaccttcgtcctcggctgctccttctcgttcgaggccggcctgatcgaggcgggcatcccgctccggcacgtcgccctcggccgcaacgtcgcgatgtaccggacctccatcgccacccagccgtcgggcccgttccacggtccgctcgtggtctcgatgcggcccatgaaggcggcggacgccatcaaggccgtgcaggtgacggcccggatgccggcggtccacggggcgccgatccatctcggcgacccgggcctgatcggcatccgcgacctcgcgcggccggatttcggcgaccccgtgccggtcgagcccgacgagatcccggtcttctgggcctgcggggtcaccccccaggcggtggcgatggcggcgcggctgccgctctgcatcacccacgcgcccggtcacatgctgatcaccgacctcctcaaccgcgacctgccgttcctgtga

SEQ ID NO: 5951 - DNA, 831 bp, Methylobacterium sp.
atgagcgccgacaccgtcccgcccaaacccgtcctcctgaccggagcctccggcgccctcgggcgcgtcctgacccgttcgctcggcgcgcagggctggacgctccggctcacggaccgcgtccccttccccgacccgctgcccgagggcgcgcgcttccaggtcgccgacctggaggacgggccggcgatcctgcggttggcggagggctgcggcacgatcctccatttcggggggatctccgtggagcacccgttcgagacggtgatcggcccgaacatccgcggcctctaccacgcctacgaggcggcccggcgcgagggcgcccggatgatcttcgcctcctcgaaccacgcgatcggcttccacccgcggtccgaggtgctggacgacgattgcggcctcgcgcccgacggctattacggcctgtccaaggcctacggcgagctgttgggcggcctctaccgcgacaagcacggggtcgagagcgtcttcctgcggatcggctcgtgcttcccggagccgaccgacgcgcggatgctcgccacgtggctgtcctacgccgacctgacccggctgatcacccgcgctaccctggccccggacctcggcccgacgggctcggtggtgatctggggcgcctcgaacaacagccgcatgacctggtggcggaaggacggccgtgctgtcatcggctggacgccgcaggacagcgccgattcccacgcggcggcgctgaaggggaagaccagcggcaacccggtggtggagcgctaccagggcggcggcttcacggcgatcgactattcccgcgccgcgccgccgcggtga

SEQ ID NO: 5952 - DNA, 879 bp, Methylobacterium sp.
atgggcgatcgcccggcctacatcgccgtcgactggggcacgacgaaccggcgggcctgcgccgtctcggaagcgggcgccgtcctcgacagcctgcacgacgagcgtggcgtcctcgccctgacgcccgacgcctatccggcggagatcgcggccctgcgcgcgcgactgggcgccctccccatcatcgccgtcggcatgatcggctccaaccggggctggcaggcggcgccctacgtagccgcaccggcaaccctcgccgccctggccgaggcctgcctcgagcccgcccccggcgtccggatcgtccccggcgtcgccctgcggagcggagaccgccccgacgtgatgcggggcgaggagatccaggtcttcggggcgatcggagcgggcgcggcgccggcaacggccctgttctgccagcccggcacgcacaacaagtggatcgagaccgtcgacggggccatcacggatttcaccaccgtgatgaccggagaattcttcgccctcctccgggcgcacgggatcctggccggaacgctcgacggcacggtcggggacggggcccccttccgcgccggtgtccggcgcggcctcgcgtcccgcaatctcgccgccactctgtttgaggtccgctccggcctcctgctcgaccggctcgcccccgaggacgcggcggcccgcgccagcgggatcctgatcggcgccgatatcggtacccgggacgacctgcggcggcgcccggtccatctcctcggcggcgggcgcctcggagcgctctacgccgccgccatcgccgaagcgggcggggatccggtgatcgtgcccgacggttcaaccacggccggtatccacgccatctggagtctgcgggcatga

SEQ ID NO: 5953 - DNA, 303 bp, Methylobacterium sp.
atgcgcgccgatctcgccgtcctcgctctggtcctcgccgccacgggcgcgcacgcccagcagcagcttccgaccgtcccggaattgctgacggccgaggcgaacgccgcacgagcctgcgagagcaccggcgatcccgccatcacgcgtgagcagtgtcggctgcgcgatcggctgagcggacgcttggcgcaggcgggctattgctggggccgcaaggggcaggcggacgagaagaaggaatggcacgcctgccagccggactcgatctacgaggatgatatcgaggccgtgcagcgctga

SEQ ID NO: 5954 - DNA, 561 bp, Methylobacterium sp.
gtgggtcagcgcctgcgcggcctgcgtcgcgcgcgcggactctcgctggaggcggttgcgtccaccacgggtctgtcgatcggcttcatcagccaggtcgagcggggcctgtcgtcgccgtccctgcgggtcctcgcgctgctcgccgacacgctgcagatcgggatcggcggcctgttcgaagcggggccggacgcgcccgacctggaccccatcgtcgtgttccgaaaggaccggcccgaacttcagctctggcgggccggcatcactaagcagctcctgaccccgccagggggcacgcaggggatgagcctgttccacatggtgctgaagcccggcgcgagcaccggcgacgagcccttcagccacgacggcgaggaagccggcctcgtcctcgcggggcgcctcaccctgatcgtcgaggcgcggacgctccagctcgcggagggcgacagcttccgcttcgagagccggcggccgcaccgcttcagcaatcccgatccgcgcagccagaccaccgtcctgtgggtcaacgtcctcggatcaccggcaaccccatga

SEQ ID NO: 5955 - DNA, 1620 bp, Methylobacterium sp.
atgtcgatcgtgggcgttcaggtctcgtccgtcggcgcggtgatgatggaggggcgcaaggccgccgtccgcgcccaggtcgagtcggcgcacggcatcgtggcggcgttcgcccggcaggcggaggccggcgccgtctcggccgacgaggcgcggcggcgcgcggcggaggcgctgcgggccatgcgctacaacggcggcgactacgtcttcgtctacagctcggagccgggcaacatcggccgcaacgtcgtgcatcccgatcccaggatcgagggcacgcggtcccgcgacgacgcggcgatgaagaagaccttcgtctggacgatgatccagcacgcccgggagggcggcggcttcaccgagtaccgctgggcccgcctcggcgagaccgagcccgccccgaaggtcgcctactcgctcgcctacgagccctggcaatgggtgatcagctcggccctgtacgtggacgacatccacgccctggaccgggcgcggatggtcaccaccctgctgtggctgatacccctcgggatcgcgatcgggctggtcgggttcctgctggcgcgcagcatcacccgccccctgagcgccttcacggccgccctgcgccgcctcgccggcggcgcgacggacgtcgccatcccgggtctcggccggcgcgacgagatcggccagatggccgaggccgccggcgtgttccgggacagcatgatcgaggcgcggaccctgtcgaccgagcagcgcgccgagcaggagcgtcggcaggagcgggcccagtggatggaggcggtgacccgcagcttcgacaccgaggcgagccagctcctggcccgggtcgacaccgccgcggccgacatgcgggaggcctgtcgggcgatggccgacaccgccgcgcaggcgtcgcggcaggccggctcggccgccggggcggcgcagcaggccgccgccaacgtgcagacggtggcggcggcgaccgaggagctgtccgcctcgatcggcgagatcggcgggcaggtcaccaagtcggccgcgatcgccggtcaggcggtgagcgaggcggagcggaccgaccggcagatccgcggcctcgccgcggcggcggagcggatcggggaggtcgtgcggatcatctcggcgatcgccgagcagaccaacctgctggcgctgaacgccacgatcgaggcggcgcgggcgggcgaatcgggacgcggcttcgcggtggtcgccgccgaggtgaagggcctggccgggcagaccgcgaaggccacggaggagatcaccgcgcagatcgcggcgatccagggcgagacgacggaggcggtcggcgcggtccactcgatcgggaggaccgtcgacacgatgaacgcgatcgccagcgcgatcgcggcggcggtcgagcagcagcggttcgccaccgggcacatctcgcagaacatcgacgaggccgcccgggggaccgacgcggtgagcgcgaacgtggtctcggcctcgtcggcggcggaggcgacgcaccgcgtggccggggaggtcggtgccgcggccggcgacgtctgccgcagcgccgaggccctgcgcgccgaggtgatgcgcttcctcgtcgagatgcgcgccgcctga

SEQ ID NO: 5956 - DNA, 717 bp, Methylobacterium sp.
atgcggcggcgcccgttcctgtccgggatgctcgccgccctatcgctggccggccgccccgcccgcgcggcggatacgggcgtcgacctcctcctcgtcctcgcggtggacgtgtcgctcagcatcagcgaggcccggttcgacctcgagcgccgcggctacgccgaggccttcggcgacccgcgggtgctgcgcgccatcggcgacggcccgaccgggcgcatcggcgtcgccctgttcgactgggccggacccggcgagcagcaggtggcggtcgactggatggtgatcgcctcggcgcaggacgcggccgccttcgccgcgcgcctccgcgccgtgccgcggccgttctacggccgcaccgccatcgggtcggcgatcggtttcgcctcagaactgctggcccgggcgccgttccgcgccgagcgccgagtgatcgacatctccggggacggcaccggcaatgccgggcggcccatcgccgaggcccgggacgccgcggtcgcggccggcatcacgatcaacggcatcgtcatcctcaccgaacccgaggggatgccggccttcctgaaagagcataccaatccaacgggcggcctggccgcgtattaccggagcgtcgtgatcggcggcgagggcgccttcgtgatgaccgccgagagcttcgcggccttcggccgctcgctcatcgccaagctggtgcgcgagatctcctga

SEQ ID NO: 5957 - DNA, 1071 bp, Methylobacterium sp.
atgcggattccggccgacaggctgaccgcctacgtgcgggacatcttcgtgcgcgagggctgcgccgagccggaggccgagcgcatcggccgcttcctggtcgcggcgaacctcaccggccacgacagccacggcgtcgtccgggtcacccgctacgtcgagtggctgcgcgccggcgaggtcgaggccggccgcacgcccgagatcgtcaccgacgcgccgaacttcgccctcgtggacgcccattacgggttcgggcagacggccggccccgtcgccgtcgatctcgggatcgccaaggcgcgggcgaacggcgtcgcgatcatcgccctccggcacgccgggcatatcggccggatcggcgagtgggccgagcgggcggcggcggcggggctcgtctcggtccatttcgtcaacgtggcgggcagcctcctcgtggcgccgttcggctccgtggagcgccgcttctcgacggcgcccttcgcggccggcttcccggtcccggggggcgacccgatcatcctcgacttcgccacgtcgctggtcgccgagggcaaggtgctcgtcgcctcgaggggcggcaagccgctgccagagggcgcgctgatcgagcccgacggccgcctcagcgccgacccggcgaccctgttcggcccgctggagggcgtcgagcgcgacaaccagcgcggggcgggtgcgatccgggccttcggcgagcacaagggctccggcctcgcgctgatgtgcgagcttctggccggcgcgctcaccggttccggcacggccgggcccgggcagcggcggatctgcaacggcatgctgtcgatctacgtcacgccctcggccctcggcaccgaggatgccctcgcggccgagacgcgggcctatctcgacttcttcaagagcgccaagccgatgccgggcgccgaggtcctgctgcccggcgagccggagcggcggatgcgcgccgagcggctcgccgagggcgtgccgctgcccgagcccgtctgggagaccctgctcgccgccggccggccgcacggcctcgatggcaacgcctaccgcacctga

SEQ ID NO: 5958 - DNA, 252 bp, Methylobacterium sp.
atgagcgtctggacggtcgccatcctggcgctgctgccgccactcgccgtggccgcggcgctcgcgtggcgcggccggcccggccagcgtttcgccgcctaccagctcgccggcagcgtcacggtcctgatcctgacgctcatggccttcgccaccgaccaggcgtcgatcactgatctcgccctcaccctggtcctgctcaacctgcccggcacgatgctgctcgcggtcttcctggagcgctggatatga

SEQ ID NO: 5959 - DNA, 252 bp, Methylobacterium sp.
atgacggacgcgggcggattcgatctcgacggcacggcgaaatccgctcacgagcgggaagtgctgcttcgccagatcgcccacgcgctgaacgtcccggtctcgatcttccgcgggccgccgggatccccggcggcccgcggcccgagcgccgcggaatgcgccgccctgctgaccgccttctcgcgcatcgcggatccggatctccgcaaggagtgcctcgcgctggcggagcgcctcggccgcaggtga

SEQ ID NO: 5960 - DNA, 468 bp, Methylobacterium sp.
atgagcctcgcctccgtgcgcgccttcttcgccgagaaggcgcccgacatcgcggtcatcgtgctggagaccagcaccgcgaccgtcgccgaggcggccgagggccacggcgtcgtcccggcgcagatcgccaagacgctctcgatccgggtcggcgagcaggtcgccctggtggtgacgcgcggcgacgcccggctcgacaaccggaaggccaaggccgccttcggcggcaaggtgcggatgctcgacctcggcgaggtggaggccctcaccggtcatccggtgggcggcgtctgccccttcggcctgctgacgccgctgccggtctactgcgacgtctcgctgcgggcgttcgacgaggtggtgccggccgccggtagcacccacagctcggtgcggatcgcgccggcgcggatggccgcgctgaccggcgccgcgtgggtcgatgtctgcgcgctgccgggctga

SEQ ID NO: 5961 - DNA, 483 bp, Methylobacterium sp.
atgagccgttatcgatgcgttccgatcccgacggagaccgccgatcgcttccgcaccaccggcctggacgaccggggcaaccccgtccgtcgggtcgtcgcgacggcggatggcggctttccgtgccgacattgcctggagctcggccggcccggcgagaccatgctgctcggatcctacgatctgcctgagccgcgcgggatctactggacacccagcccgatcttcctgcacgcggacgagtgtccgcgcgccgaggcggtcaacggcctcgtgccgatcgtccgcgcgaacgcgctcgtctcggtccgtgcctacgacgcggaccatctctgtctctacgatctcggacaggtctgtcccggaagcgaggccgaggttccgctccgccgcgccctcggcgatccgcgcacccgcttcgtcaacatccacacggcgcggcccgggtgcctgctgtcccgcgtggagcgcgtcgccgactga

SEQ ID NO: 5962 - DNA, 987 bp, Methylobacterium sp.
gtgaagatcctcaagcacgaagccggccgcgtgacgaagcccggcctctaccagatgccggcggcggtctaccacgcggaccccgctcccgagccgagcctgtcgtcctcgctggcgaaggtgctgctcgactacagcccggagcacgcccgcgcggcgcacccgcgcctcgcgccgccccggccggccgacgacgatgtcgaggacaagccgacgcggccgcgcgagatcggcaccgctgtgcatcggctggtcctcggcgcgggctgcgacctgaccgtgatccagtcgcccgactacaaggccaaggacgcccaggccgcgcgcaaggccgcctatgccgccgccggcgccccgatcctcgccccggacctcctgaaggctgagcgggtcgccgcgcgcgtcctgagccacgtcgcgtcggttcagggctgcgaaggtttcgcgaccgcgccggccgaggtcgtggccgtactccgcgaccgctccggcgcctggctgcggaccatgatggaccgcgtcgagatccacccgacgcacgcggtcatctgggacgtgaagtcctcgagccagtcctcggcaccgcagggcctcggccggcgcgtcgagcagatggcgatggaggtgcaggccgcgctctacgttcacgtgctggcgagcctgctgccgcacctgtccggccggatcgtgttccgctggatcttcgtcgaggccgacgagccgaacggcgtctgcatcgcccaggccgacggcgccggcatggagatcggcgcgcggaaggtcgccgccgcgatccacctctggaatcggtgccgggccgccgaccactggccgggctaccccgccgagatcgtgcgggtcgactacccggaatgggccgagcgccgctggactgagcgcgagtccctcgatctgcagctcgccggcgcctcctacgacgtcgcgcagagccccttccgtcccctcggcatgggagacgccgcgtga

SEQ ID NO: 5963 - DNA, 567 bp, Methylobacterium sp.
atggcctaccagattcccacagcggcgcgtctcgtgtccgcgcccatcgtgtgccgcatcctcaccatgagacagtatgaccccgaccccgcgatcgacgccaggatccggagggccgttcgttacgggcagacccggtgggccgagatctggctctcggtgatcatgtgggtggtcggcctcatatgcctcatgccgtggcccaccttcgtcggcccgcagtatcggatcatcaccgcgtacgtcagcgagcccaccgccggctggatcgccctggtggtgggcaccgcccgaatcgttgccctctacatcaacggcaggcgcggccgagagacgtcgttcgtccggacaatcggctgcctcggcggcttcctgttctggctcgccatggccctggggttcgccctggccttcccgccgctctcgctgagcgccggcatctattccgtcttcgcgatcgccgagctgcactcgtccggccgggcggccggcgacatggccgcagaagacaccttcggcttcaggaaacggagaagggccagtgccggcaacagcacagcagcttga

SEQ ID NO: 5964 - DNA, 1206 bp, Methylobacterium sp.
atgaccagcgaccgcaagctgaaagttgtggctgtcgcgggcagcggcacgctgttcttccacgcggcggtgctcggcaccttcctcgccgcgtccgccgctccgacaccgctgtaccggttctaccaggagacctacgcgctctcccccgtgatcacgaccgcggtgttcgcggtctacgcgctggcgctcctcaaggcgctcctcgtcgccgggtcgatctcggaccatctgggccgacggccggtgatcttcggcgcgctgctcctcgagctggtggcgatggccctgttcacgacggccaacggggcgtggggactgatcgcggcgcgcttcgtccagggcgtggcgactggcatcgcggcgagttcgctcggcgccgcgctcgtcgacgtcgaccgggcgcgggcccagctcgtgaacgcgatcatgccgctgatcgggatggcggcgggcgcgctcgggaccagcgccctcgtgcagtacggcccgcatcccctccacctcgtctacgcgatcctggccgcggtgttcgccgcgcaggccgcgctcctctggctcacgcccgagaccggggagcgccgcgcgggcgccctgcgggccctgaggccgcgcgtcgtgattccgccgcaggccagacggccgctggccgcgatcacgccgaccaacatcgcgacctggatgctcggaggcttctacctctccatcgtcccctcgctggtcgtcgcggcgacgggcagccggacaccgttgacgagcggcgtcatggtcgcggccctgatggtcgccggcgccttcgcggtcctccagcggcgcggacgcgacgccgcggccaacctcacgatcgggacgctcgccatgaccgccggcctcgtcatcgtgctcgccggcatgcacggcgggagcgtgccggttctgatcggcgggaccctggtcggcggggccggcttcgggacgagcttcctcggcgccctcgggacgatcgtcccgctggcgaagccgagcgagcgggccgagctcctcgcgagctactacgtcgagagctacctggcgttcagcctgccggtgatctgtgccgggtatctcgtgcgccggatcggctacgtgacgaccgccgacctgtacgcggccgcgatcctcgccatgagcgcggccgggttcctggcgcggcgggcgttgacgtcgcgacgcgtctcgcccggctga

SEQ ID NO: 5965 - DNA, 276 bp, Methylobacterium sp.
atgaccgagatgctgcgcgacaatgtcgagcgaggccgcttcgagctgcaggtcggcggtgacgtcgtcttcgcgacctatcggcgggaacccggccagctcgtcatcagccacgtgtacgcgccgccggtcctgcgcggcaccggggcggccgaccggctcatggaaggcgtcgcggcgcacgcgcgcgccgagggcgatcggatcgtgcccctgtgcggctacgcccgggcgtggctgcgcgggcatcggacgcatcgcgacctgctcgcgtga

SEQ ID NO: 5966 - DNA, 150 bp, Methylobacterium sp.
atgtcgtcgctgacaatcggcctgggcgccgcctgttgcgcggccggcgccgccgcccatttcctcgaccgcacccagcgcaaggaaggcctgttcggcctcgcgggcttcgccctgctcctgaccgggatgttcctgagccgctcctga

SEQ ID NO: 5967 - DNA, 1731 bp, Methylobacterium sp.
atgaccgcgcgcaagaagaccctggacgacctgcgcagccagcgctggttcggcgccaccgacctgcgcagcttcggccaccgctcccgcatgctgcagatgggctacgagcgggcggatttcaccggcaagccgatcgtcggcatcatcaacacctggagcgacatcaacccctgccaccagcatttccgcgagcgcgtggagcacgtgaagcgcggcgtctggcaggcgggcggcttcccgatcgagctgccggcgctctcgctgtcggagaacttcgtcaagccgaccacgatgctctaccgcaacctcctggccatggaggtggaggagctgctgcgccagcatcccgtcgacggcgcggtgctgatgggcggctgcgacaagaccacgcccggcaccgtcatgggcggcatctccatgaacctgccgatgatcttcctcccggccggcccgatgatgcgcgggcatttcggcggcacgatcctgggctccggctcggatgtctggaagtactgggccgagaaggaggccgggaacatcaccacgcaggaatggaacgacatggaggcggggatcgcccgctccgccggcacctgcatgaccatgggcacggcctcgaccatgacggcgatcaccgaggccctggggctgtccctgcccggttcggcctcgatcccggcggccgacgccgatcatccgcgcatggccggcgcctgcggccggcgcatcgtcgagatgatctgggaggacctgaagccgtccgacatcctcgaccgccgctctatcgacaacgcgctggtggtccacaacgcactcgccggctccaccaacgcgatgatccacctcgtagccatggccgggcgcgccggcatcccggtcaagctcaccgagttcgacgagttcgcccagaaagtgccggtcatcgccaatctccggccctcgggtcagtggctcatggaggatttccacatcgcgggtggcatccgcgccctgatggcgcgcctgtccccgctcctccacctcgacgcccgctcggtcaccggcggcacggtcggcgacgggctcgccggcatgaaggtgttcaacgacgacgtgatccgcccgctcgagcggccgatcgtcgccatgggcgggaccgcgatcctgtacggcaacctcgccccggacggctgcgtgatcaagccgccggccgccgacccgcgtttcctgaaccataccggccccgcgctggtcttcgacacctacgacgcgatgagcgcggcggtgaacgacctcgacctcgacgtcacgcccgaccacgtgatgatcctgcgcaatgccggcccgatcggcggccccggcatgcccgaatggggcatgctgccgatccccaaggtcctcctccggcagggcgtgcgcgacatggtccgcatctcggacgcccggatgagcgggaccagctacggcgcctgcatcctgcacgtggcgccggaatcggccgcgggcgggccactggccgccgtgcgcgacggcgacctcatcaccgtggacgtgcccgggcgccggatccacctgcacctcgacgaggccgagatcgcggcgcgcgtgaaggccttcgtgccgccggaccgggcctatccgcggggctacaaccggctgttcgcccagcacgtgcggcaggccaacgagggctgcgatttcgactttctggagggcgccggggggatcccggaacccgaaattcactga

SEQ ID NO: 5968 - DNA, 1542 bp, Methylobacterium sp.
atggccacatcgctgatccgcagccggcggatgatcacccgtaccctggaccacgatcgctgggaggagatcgccgacggcgcggtgctgcagacggacggggtgatcgcggcggtcggtacctacgcggacctgcacgcccgctaccccgacgcccccgtgatcggctccggccgcgagatcctgctgccgggcttcgtcaacggccaccaccatgtcggcctgacgccggtgcagctcggctcccccgacatgcccctggagctgtggttcgtcacccggatggtggcgcgcaacctgaacctctacctcgacaccctgtactcggccttcgagatggtcggctccgggatcaccacggtccagcacatccacggctggatgcccggcagcctggaggaggtcgaggcgcgctccaacgaggtgctgcgcgcctatcgcgacatcggcatgcgggtctcgtactgcttcgcggtccgcgaccagaaccgcctcgtctaccaggccgacatggacttcgtggcgagcctgccggcgccgctgcaggacccgatgaagcgctggttcgagcgcttccagatgtccctggaggacaatttcgccctcttccgcagcctgcatgccgggcaggagggcgcgtcgcgggcgaagatccagctcgcgccggccaacctccactggtgctccgacgcggccctcgaagggctcgccggtctgtccgaatcctacgacgtgccgatgcacatgcacctcgtcgagaccgcctaccagaaggcctacgcggagaagcgcggcggcgggaccgccctcgagtacctcgaccggttcggcatgttggggccccggctgacgctcggccacggcgtctggctgaacgaagccgacatcgagcgggtcgccgcgaccggcacctgcatctgccacaattgctcgtcgaacttccggctgcgctccggcgtggcggcgctcaaccgcttcgaggcgaaggggatcaacacggcgatcggcctcgacgaggccggcatcaacgacgaccgcgacatgctgcaggagatgcgcctcgtgctgcgcgcccaccgggtgcccggcatggacgaggccgacgtgccgagcatggcccaggtgctgcgcatggcgaccgtcggcggcgcccgcaccaccccctacggcgacagcctcggcacaatcgaagtcggcaagggcgccgacatggtcctgatcgactgggaccagatcgcctacccgtatctcgacccggagacgccgctcctcgacgcggtgatccagcgggccaagaccggcggcgtcaccgcggttctgtgcgagggcgaagtgctctacgcggacggccgcttcacccgggtcgaccgcgacgccgccctgaaggcgctccacgacgacctgtcgcgggcgctctcggacgacgaggtcgagcggcgccagctctcgaaggcgctgctcccccacgcgcggcgcttctacgccaactacatcgacccgtcgcggcacgagccgttctaccgcccgagctcgcgcgtctga

SEQ ID NO: 5969 - DNA, 807 bp, Methylobacterium sp.
ttggcctctgatctccgctccgacgacgccgtcgcgtgccgcggcgtcgccaaggtctgggcggccggtaccgcccgcgcccacgaggccctgcgcgacatcgacctcaccgtgcggcccggcgagttcgtggtgttcctcggcccctcgggctgcgggaagagcacgctgctctacctgatcgccgggctcgaatccgcctccggcggcgagcttctggctttcggcgaaccggtcaccgggccgtcgccggagcgcagcctgatcttccaggagacctcgctgctgccgtggctcagcgtctggcagaacgtcagcttcggcctgtcgctgaagggcgtgcctgaggccgagcgccggagcgtcgcccgggccgcgctccagcgcgtcggcctcgccgaggccttcgacaagcggccggacgagctgtccggcggcatgcgccagcgcgtggcggtggcccgggcgctggccatgcgcccgaaggtcctgctgatggacgagcccttcgcggcgctcgacgtccagacccgccagaagatgcaggacttcctgctcgacgtctggcgcgacagcggcgcctcggtgctgttcgtgacccatcacatcgacgaggcggtggcgctcgccgaccgggtggtggtgttcaccgcgcgaccggggcggatcaagacgatcgtccgcaacgacctcgcccgcccgcgtgacccgttctcgcccgaggccgaggctttgcggcgccacctcaccgagctcctgcgcgacgaggtcgaccgggccttcgccgagcaggaagcgctcgtctga

SEQ ID NO: 5970 - DNA, 930 bp, Methylobacterium sp.
atggccaccttcctcgcccgcgccgccgccgtcccgcaggaccggccgcgcctcccgctcggtcagcgcctcgcgctgcccgaagggctcgtccccctgctccgccggaccggctggatgctgatctcggtcggctgcttcgccggcctctgggagctgctctgggcgctcggcatcgccgacgccaagctcctcccgccgccgcacatcttcctcggcaacctcgccgagcaggcgcgcttcttcaacaccgcgcagcgctggcagatcggcaccgggatgaataccggcccgagccccgccatggcggtgctgatcaccgtgctcgcctcgaccggccgggtgctggcgggcctcgccctggcggcctccctgtcgatcctggtcggcgtggcgatccgctacttcaagctgttcgagcggctgaccctgccgaccatcacgctcctggcgccggtctcgccgatcgcgtggctgccggtggcgatcttcatgttcgggatcggcaacgccccggcgatcttcatggtgttcatcgctctgttcttcacgatggtgctctcgaccatccagcagatcgacggggtcaaccgcaactacatcaacgtcgcccggaccatgggggcgtcgaagcgccagatctacgcccgggtgatcgtgccggcgatcctgccggggctgctcgcggtgctgcgcctcaacctgttcggcgcctggatggtggtgctcgtcgccgaggcgaccggcgtgggctacgggctcggccaggtgatcatgctggcgcgcaacaccttcaacccgtcgctggtcttcttcaccatcacgctgatcggcctgctcggcttcgccttcgacctgctgttccggctggtccagcggcggctgctgtactggctgccgcgcgacgcggggtcctcccttggcctctga

SEQ ID NO: 5971 - DNA, 1053 bp, Methylobacterium sp.
atgtgcgaccgtcacggcgtttatcgcgtcccggatctcacgcggttcaagcccagccgcaggcgcttcctcggcgggaccgccgccgcgctgaccctggcggtgggcccgggcctgaccggcccggccgcggcggccaccggcatccgcgcgacccacggcaccgggttctgtaacctcaacttcttcctggccgaggcgatgcagctcgccaaggatgacgggctgacgatcgacttcgtcaacacgccgaccttctcggatcaggtcaccttcctcggcatgggccaggtcgatgccggcgtgatgccctacacgagcttcatggccctctacgacgcgggtgctcccgtgaagatcgtggccggcggcggcatcgagggctgcgtgctcgtggcccagcccggcctcgacagcccggagaagctcaagggcaagacgctcgggacattccagctcgatacgctggaggtgctgccctacgactggctgaagaagaacggcgtcgccttcaaggacatcacggtccgctacatgggctcgaccccggaggccgtggaggcgttccgcgccggggcgctggacatcatctcgaccatcgagccgtacggaacggccctgctcaccgacgtgaagggcgcggtgaagctctccgacggcacagacatctacggcaagggctacacggactgcgtgctggcggtccgcaacgagctgatcgccaagaacccggccgccgtgaaggccctgatcaagggcatgatgaaggcgcaaggcttggccgagagcgacccccaggccgccctgaacaagctcgtcggctcctactacaagacctcgatgagcaacgcccagctcgccatgggccggcagccctcggtggtggacgcccgcaaccagacgcagttcatcctcgaccggaccgattccgtcgccgagatgggctacatcaagaggaagcccggccgcgacgcgatcgactggaccctgctggaacaggtcatcgcagagaacccggacctctacggcaagctcaagctgaagtcggcctga

SEQ ID NO: 5972 - DNA, 1455 bp, Methylobacterium sp.
atgcgcgaacgacacgccgaccacgacgccctggcgtcgatcctcgcggaggcgctggccgccctggcgctgccgcccgaggccggggaccggctggcggtgaccggcaccgggagcctgccctcctgcttcccgggcaccgcgctggcgacggcgtcgatcggcgccgccggcctcgccgtctccgaactcctcggcctgtccggccccgcgcccgccgtcacggtcgaccggcacctggcctcggcgtggttcggcacctccgtgcggccgcagggctggacgctgccggccgcctgggacccgatcgccggggactaccgggcggcggatggctggatccggctgcacaccaacgcgccccgtcaccgcgccgccgccctggcggttctcgactgtccgggcgagcgggaggcggtggcggccgtcgtggcccgcgcggcggccgaggacctggaagttgcgatcctgcgcgccggcggctgcgccgcggcgatgcgcggtccggacgactgggagggcttggaccagggccgggcggtccgggccgagcccctcgtggcggtcgcggaacgtcccgtccagcaccggtcgccgtggcgccccgacccggcccgtcccctcgcggggatccgggtcctcgacctgacccgcatcctggcggggccggtggccacgcgcgtcctggccggcctcggggccgacgtcctgcggatcgacccgcccggctgggaggagccgtccctggcgctcgacgtcaccctgggcaaggtctgcacgcggctcgacctccggcaggccgccgaccgccggcacttcgagaccctgctcgccgaggccgacatcctcgtgcacgggtaccgcccggacgccctggagcggctcggctacggcgcggtgcggcgcggcacgctcaacccggacctgatcgacgtcgcgctctgcgcctatggctggaccggtccctgggccggacggcgcggcttcgacagcctcgtccagatggcgacgggcatcgcggcggccgggcagcggtggaaacaggccgaccggccggtgccgctgcccgtccaggcgctcgaccacgccaccggctacctgatggccgcggcgtccgtgcgcggcctgatcgcccggcagcgcgacgggcgcgccgtcaccgcgcggctctccctggcccgaaccgcgcgcctgctcacggaccatcccggcagcgcgccggggcccgccttcggcggatatcgggacgcggattacgccccggagatcgaggacacggcgtgggggcctgccctccggctgcacgcgcccgtgcggatcgagggcgcgccgctgcggtgggatcgcccggcccgcgatctcggcgcgacgaaggccgcacaagtcagacatttcgatagcgcgcgatcgtctggcccggacgcaaccccggggagcagaagagctataaattga

SEQ ID NO: 5973 - DNA, 303 bp, Methylobacterium sp.
atgttcggcgcggccaagctcacgggacggttctggttccgcaagacgtggacgggcaagctggtcctgctcgtcgaggaagagaggccgcggtggttcagccgcaccggcctcaccaagctccgctggcgcgacgcccgcctgctcgatctggccgaggcgccgatgcgcaccctgatgaccctcgagcgcagctaccgcgccgactacgcggccgggcccgcgcgggtcctgcaggccgtcatcccgcccgggacgcggggcgcgatcgccacgccgatcgggaccgcggccaacgcctga

SEQ ID NO: 5974 - DNA, 786 bp, Methylobacterium sp.
atgcgattcttctctgccagccgcgtcgcggcgctcgtcgtcgctacgctcctcgccgtgcccttcgccgcgcccgcgcgggccgacgatctggacgcgattcgcgccgcaaagaccctgcgcatcggcaccgagggcacctacgcgcccttcacgttccacgacgcgtccgggcagctcgtcggcttcgacgtcgagatcggccgaaaggtcgccgagcagctgggcgtcacgccgcaattcctcgagggcaagtgggacgggctgatcgccgggctcgacggcaagcgctacgacgtggtgatcaaccaggtcggcatcaccaaggagcggcaggcgaagttcgacttctccgagccctacatccgggcgcgggccgtgctgatcacgcgggcggaccggtccgacatcaagtccttcgcggatctcaagggcaggaaggccgcccagagcctctccagcaacttcgcgcgcctcgccgagcagtccggcgccgagctcgtcgggacggacggcttcgaccagtcgatccagctcgtcctcaccggccgcgccgacgccaccgtcaacgacagcctgtcgttcctggacttccacaagcagaagccgaacgcccccgtgaagatcgccgcggagcaggccgacgcggacgcctcggggatcatcatgcgcaagaacaacccggcgctgaaggccgcgatcgacaaggcgctggaggcgatcaaggccgacggcagctacgcggcgatcgcccagaagtacttcggggccgacgtctccaagtag

SEQ ID NO: 5975 - DNA, 927 bp, Methylobacterium sp.
atgacctcgtccgtccccgcctatcgcggcgtcttcccggtcgcccccacggtcttcgacgccgcgggcgccctcgacctcgacgggcagcgccgggccgtcgacttcatgatcgacgccggcagccagggcctgtgcatcctggccaatttctccgagcagttcgtcctcaccgacgacgagcgcgagcgggtgatgcacgccgtgctggagcacgtggcaggccgcgtgccggtgatcgtgacgacgacgcacttcgccacgcaggtctgcgccgagcgctcgcgccgcgcccaggaggccggcgccgcgatggtgatggtcatgccgccctatcacggcgccacgatccgggtgccggagctcggcatcgtcgacttcttccgcgcggtctcggacgcgatctcgatcccgatcatgatccaggacgcgccggtggccggcacgccgctctcggcaccgctcctggcgcgcatggcccgggagatcgcgaacgtcgcctacttcaagatcgagaccgcgggcgccgcgtccaagctccgcgagctgatcgcgctcggcggcgacgcggtcgtgggcccctgggacggcgaggaggcgatcaccctgatggccgacctcgatgccggcgcgacgggtgcgatgaccggcggcggctacccggacgggatccgccagatcaccgacgcctacgcggccggccgccgggacgaggcgatggacgcctacgcgcgctggctgccgctgatcaactacgagaaccggcagtgcggcctgctcgcctgcaaggcgctgatggccgagggcggggtgatcgcgagcgagaccgcgcggctgccgatccagcccctgcacccggcgacgcgggccggcctgatcgagctcgcccggcggaatgacgcgctggtcctgcgctgggcccgctga

SEQ ID NO: 5976 - DNA, 411 bp, Methylobacterium sp.
atgcccccgatctattcttccagcgcgaccgccctgctgccggtgaccggccgggtcctgatgagcgcgatcttcctcgtgagcggcgccggcaagctcgcggccccggccgcgacgctcgcaaccatcgaggccgcccacctgccgctgccgccgctcgcctacgcggcggcgacctccgtggaggtcgtcggcgggctgctgctcgtcgccggctaccgcacccggctggtcgccctggccctcgcgctcttcgcggtggccaccgcggtgaccttccacgcggccctcggcgaccagaaccagatgttccacttcctgaagaacctcgccatggccggcggcttgcttcaggtcgcggccttcggggccggcccgctcagcctcgacgcgcggcagggccgggcctga

SEQ ID NO: 5977 - DNA, 978 bp, Methylobacterium sp.
atgccgacctccgacgcaccgctcaccatcgggatcatcggcgcaggaatcatggccgagcgcctgctcggcgcgatccacggggcggcggactcgcccgtacgggtcgcggcgatctgggatccggccccggcggccctggaccggatcggcgcggccttcccggcggtgccgcgggtggccgattccgccgccgtcgtggcggcgagcgactgcgtctacgtcgcctcgccgcccgcctcgcatctcggctacgcccgcgccgccctggcggccggccggagcgtcttctgcgagaagccgctggccatcgatcgcgccgatgcccgcgccttcgtggcggaggcgaggggcgcgggcgcggtcaatttccccttcgcctcgtcgccgggcgtggcgacgatcgagcgctggatcgcggccggcgcggtcggcacgccccgtgcgctcaccgtcgcggtggaattcgcccgctggccccggccctggcaggccgacgccgcccgctggctcgacgcgcggggcgagggcggcttcacccgcgaggtggtctcgcacttcctgttcctggcccgccgccagcttggcccgctcgcgggactcgcaggacggatcgacttcccggagccgggccggtccgagcgcgcgatcgacgtgacgctcacggcgggcgggatccccgtcaccctgaccggccgggtcgggggcgtcgcggccgacgaccacaacacgtggacgctggagggcgaggcgggcgtcgtccggctgcgcgactgggccatcgccgagcggcggggcgccgacgggcgcttcgagccggagcccgacgcgatcccgaacgagaagttgcggccgatcacgctccggcgccagctggacggcgtcgtccgcatggcgcgcggcgagccccaccacctcgccaccttcgcggaggcgctcgacgtgcaggaggtcgtcgagtcgatcctgaccctgtga

SEQ ID NO: 5978 - DNA, 240 bp, Methylobacterium sp.
atgtccgacatgacgacgcgcggcccgcgcaacccgagccggatcatcttcgtgacggtggccctgttcggcatcgccgtcgggttcgcgaccgccagcctcgcttggttcacgctcgcgatcctcggctccgccgcgctgacctgcgcgggctacggcctgatccggcggcggctcggctggaagccgctgagcggcgagtacctgttcaacctcctccacgtgctgagcccgcactag

SEQ ID NO: 5979 - DNA, 1611 bp, Methylobacterium sp.
atggagttccagatgcgtcccttgaccgtcgtcccggttgtgccgcggactgcgatgatcgctgtcatccgtccgggcgccgcccgcgcgatcccgatcgcggccgggctcctgctctgcacggccctggcgacgcccgtccaggcacagctcctgcgcggcgccttggatacaaccgcgaatggcatcctcggcaccgggctcacggtcggcacgagcagccccggcagcggtgtgctcggaaccggcctcaatgtcgggacgaccaatggcggccttctcggcacgggcgtcacggtcggcaccaccaatcccgggaccggcgtcctcgggaccggcgtcaatgtcggaaccacgactggcggcagcgtgctcggcaccggcgtgacggtcggcaccaccgcgcccgggaccggcgtcctcggaacggggctcaacgtcgggaccaccggcgggggtgtgctcgggaccggcgtgctggtcggcacgaccggtccgggagacgggctgctcggcaccggcctgaccctgggaaccgcgggagggaccggaacgggcggctgcggcacatgcggcggcaccggcgggggtgggaccggcggaggcggaaccggtggtggcaccggtggcggatccaatcagggcatctacatcatcaccggcaacgtgacgcagtcccaggggcagaccgtcatcaacgaactgcggctctcgcagctcacaagcgtcatgggcgtcgccgccaacaacaccagcaaccaggccgcgccgatcgccgtcggtagcgacgcgctggcggtgggctacggttcgagcgcggccgggacggcctcgaccgcggtcggcacaggcgccagcgcggccaacaccggcagcgtcgccctcggctacgcggccagcgcgcagggcctcggcggaacggcgatcggcacggcctccgcggcgtccggagccggcagcaccgccctgggcttcgtcgccggcgcgaccgggaccggctcgaccgccatcggtgcggccgcctcggcggccggcaacaacagcgtcgcgctcggcaacggggcggccgccaaccaggccaacacgatcgcgatcggcgccaacgtgaagacgacccaggccaaccaagtggcgatcggcaattccgcgaatacctacaggctcgccggtatcgcctcgcaggcgagcgccgccgcccagagcggagccacggccttcgtgacgacggacgcgaacggcaacctcgcggcctcggcctacggaccgtcgacgatcgccggcctcggtaatcggatcgattcggtgcaggcgcaggtcaacaacctggaagccaagaccgactcggtccagcgctacgcgatccagacgcggaaggaggcccggcagggcgtcgccatggcgatcgcgatggccaccgcgccgatgccgtcggcgccgggcaagaccacctgggccaccaacggggcgacctaccggggcgagtgggccggcggcctcgccgtggcgcaccggttgccgacctgctgcgtcccgatcgcggtcaccgccggcgtggcctacggcggcgacaacgccgtcggtgtccgcgccggcctcgcgggcgagttctga

SEQ ID NO: 5980 - DNA, 1221 bp, Methylobacterium sp.
atgaccgacgtcacagtgagcaagtccgtgagccccggccacgacatcgtcccggccgcctcgggcgcggccggggcccggcgcggccgtctgccgatggtgccgctgcgcgcctacgggctcgtcgtcgcgctggcggtgatcacgctgttcttcgaggtcgcgacgggcggcgtcctgtttcagccgctgaacctgaccaacctgatcctccagaacagctacgtcgtcgtgatggcgctcgggatgctgctggtcatcgtggccgggcatatcgacctgtcggtcggctcggtggtcggtttcgtgggggcgctcgcggcgctgctgatggtgcgcttccacgtcgacccgtactcggccgccctcctgtgcctcgcggtgggggcggtcatcggcggtctgcagggctacttcgtggcctacctcgccatacccagcttcatcgtcaccctgtccggcatgatggtgttccgcggcctcacgcaggtgctgctgcagggcacctccatcggaccgttcccggaggtgttccagctcctcgccaagggcttcctcgtcaatgttgccggaccttggaccgccgtcctgatcgccctcgcgctggtcgcgacccagatcggactgagctggcggcggcgggcgcggctgcggaacgggagcccggccgagactccggcggcgttcatcgcccgcaacggcgtgaccgccctcctgatcctggccttcgcctggcagatgagcgcctaccggggcctgcccaacgtgctcctcgtgctgctggcgctggtggcgctctacggcttcgtgaccacgcggacgacgatcgggcgccggatctacgcgctgggcgggaacatcaaggccgcgcgcctctcgggcatcaagaccgagcggctgaccttcctgaccttcgccaacatgggcgcgctggcgggcctcgccggcatgatcttcgtcgcccggctcaacaccgcgaacccgaaagccggcgtcgggatggagctcgacgtgatcgcggcctgcttcatcggcggcgcctcggcggcaggcggcatcggcaaggtctcgggcgtcgtgatcggtgccttcatcatcggcatcatgaacaacggcatgtcgatcctggggatcggcgtcgactggcagcaggtgatcaagggcgtcgtcctgctcgccgccgtgtgcctcgacgtccacaacaagaacaaccggctctga

SEQ ID NO: 5981 - DNA, 1074 bp, Methylobacterium sp.
atgatcgccaggcagacggttctcaaatacatcctgggcctgtcgctcttcggcgcgtccgccgcgacaccggcgcaggcggccggcggggatccgatcggggtcgccatgccgaccaagtcgtcgcagcgctggatcgacgacggcaacaacatcgtcaggcttctgaaagccaagggctacaagccggatctgcaatacgcggacgacgacatcccgacgcagctcgcccagatcgagaacatgctcaccacaggcgtgaagatcctggtgatcgcctccatcgatggcacgaccctcagcgatgtgctgtcgaaggcaagcgagcgcggcgtcagggtcatcgcctacgaccggctcattcgggggacgcccaacgtcgattactacgccaccttcgacaactacaaggtcggcgttcagcaggcgacgtccatcgtcgacgccctcggcctgaaggacgggaagggacccttcaacatcgagctgttcggcggttcgcccgacgacaataacgcatactttttctacgacggcgccctgtcggtgctgaagccctacctcgacgcgaagaggctcgtcgtgcgctcgggccagttcggcatggacaaggtgtccaccctgcgctgggacgccgcgaccgcccaggcgcggatggataacctgctctcggcctattacggcaacgcccatctggatgccgtgctctcgccctacgacggcatctccacggcgatcctctcatcggtgaagagcgtgggctacgggtcgggcggcgtgaagctgccggtgatcagcggccaggacgccgagctgcaatcggtcaagtcgatcatcgccggtgagcagacggcgacgatcttcaaggacacccgggacctggccaaggtgacggtggcgatgatcgacgccatcgaggcgggccggcagcccgaggtcaacgacgtgaagacctacgacaacggcaagaagatcgtcccgtcctacctgctcacgccggtgatcgtcacccgggccaactggaagccggccctgatcgacacgggctactacacgctcgaccagctcaagtga

SEQ ID NO: 5982 - DNA, 783 bp, Methylobacterium sp.
atgagacgtctgctgctgctgttcctcgccctggtcggtctggccgccgcgccggccatggccgcggacaagatcaaggtcggcatcatgggcggggatgccgaagtcctctgggcgaaggccaaggagatcgcggcccgcgacgggctcgccatcaacctggtggtgttctccgactacctgctgccgaacgaggcgctccagtccggcgacctcgacgccaacgccttccagcacaagccgtttctcgccaaccagatcaaggcgcgcggctacaagatcgtccccgtcggcgagacgatcgtgacgccgatcggcctgtattcgaagcgggtcaaggccgtcggcgacctgaaggacggggcgcagatcggcatcccgaacgacccgtcgaacggcggtcgggcgctcctgctgctgcaggccgagaagctgatccgcctgaaggacggggtcggcctgctgccgacggtcttcgacgtcgtcgacaatcccaagcgcctgaagttccaggaggtcgacgccgcgcagctgccccgcagcctcgaggatctcgacgccgcggtgatcaacaccaactacgccgtcgatgccggcctgatcccgggcaaggactccatcgcgatcgagtccaaggtcgacaacccctacaacaacgtcatcgtggtccgcgaggcggacacgggcaagccctgggtgccgaagctggtccgcgccttccagaacgacgcgatccgccagatcctgaaggagcagttcccgggccagttcccggcgttctga

SEQ ID NO: 5983 - DNA, 255 bp, Methylobacterium sp.
atggacgactggaaggcggggctccgggcggaaatgcgggccatcgacatcgccacgggcgaggcggcctcggcgcagctgccggatctgctgcgacgcctgagccggcaccaggccggtctcggcggcaacccggtcctgtcgctgtaccggcgctggcgcatccggcgcctggcacgcgccgtcgcggacgcgcgctggcacgcggaacagggccgcctcgcacgccgcggcgggctcgatccgcgcccgtga

SEQ ID NO: 5984 - DNA, 1350 bp, Methylobacterium sp.
atggacgcgggcgacgtgggcaagcgcggggcggccggcgccccgtggcacgcgggtctgacccggcgccactggcggatcctgtggggcagctacctcggctggatcttcgacggctacgaggcggtggcgctggtctacgccctgcgcccggcgctggcctcgatcctcacccccgagcaggcccaggcgccggccttctacgtgggcctcgccatcggcatcaccctgctcggctgggggatcggcggcctgatgggcgggatcgcggccgactatatcggccgcaagcgcatgatgatggtgtcgatcctgggctacgcgctgttcacggggctcaccgccttcgcggagagcttcacgcagctcgccgtcttgcgcttcatcaccgggctcgccatcggctcggaatggtccaccggcatcgccctcgtggccgagacttggccgaaccgggcccgcccgaagggctgcggcttcctgcaatcgggcttcggcggcggcgcggtgctcgccgccatcgtgtgggccgtgctcgccgccaccgagcccctgggcgcggaatcctggcggatcctgttcgcgctgggcgcgctgccggccttcgtgtgcctgtacctgcgccgggcgctggaggaatccgagcagtggatgcgggcgctcaaggcgcagcgctgggcggccaccgccgaggatgcggaccgcgccccgcggagcgcgcggcgcccgttctccctgacggagatcttccgcgagccagagagccggcggcgggtcctgctcgccacgctcctgtccttcgccaccacggtgggctggtgggcggtctcgtcctggctgccggcctacacggaggggctcgccaaggccgcgggcgcgccggccaatgtctggggcccgcgcatgggcatcgtctacaatatcggggcgatcaccgcctacgtgatctcgggcttcgtggccgacgcgatcgggcgccgcgccttcctgctcgtgacctatgccggctgcatcgccacgtcgctcgcctgctacctctggaccggcgggctggtgccgttcatggcgctcgccttcctgaacgggttcttcaccctgggcttcgccttctcgtggatggcgatctacctcgcggagctgttcaccccggcggtccgggcgacggcgtcgagcgcggtcttcaacggcgcgcggctgatcgcctggatcttcccgatcctggccgggcagatcgtgaccgccttcgggggcgtcgccgcggcggcgctgaccctgtccagcgtctacgtgatcggcctcgtcgtgccgtggttcatgcccgagacccggggccggccgctgccggaatag

SEQ ID NO: 5985 - DNA, 1041 bp, Methylobacterium sp.
atggtgcgtacgtcgcggacgggctcgctgctgccgggccgccgccggctcctgcgggcgggatcggtcctcctgctggccgggctggcgctggccacccccgcccgggccgacgatgccaaggtccggatcagccggcagccgggcttcgtctacctgccggccgtgctcgccgagcagcacaagctgatcgagaagcacgccaaggccgcgggcctcggggacgtcacggtggagtgggtcaacctgacgagcggcgcggccggcaacgacgcgctgctctcgggcaacatcgacatcgtcgacagcggctcgaccaacatgctgctgctcaacgaccgcaccaagggcgacgtgaagggcttgtgcggggtcggcaccacgccgatgatgctgctcacccgcaatccggacgtgaaggaactcaaggacttctcgtccaaggacaagatcgccctgccctccgtgaaggtctcgtcccaggcggtgctgctccagatcgccgccaagaaggcgttcgggcccgagaacgccaccaagctcgacccgctcaccgtccagctcggccatcccgacgccgtggcggcgctggcgagcccgcacaacgaggtcaacagccacttctcgctgccgccgttccagcagcgcgagctgcaggacccggcgatccacaaggtgctcaattcctacgagatggtcggcgagccggtgagcaacgcgatcttctacgcccggaccggctggtacaaccgcaacccgaagctcgccgccgccatcgtggccgccatcgacgaggccaatgccgagatcgcccgggatccgctgaaggccgccaaggactacgtggcggccaccaacgagaagacgccccccgagaccctggtcgagatcatgaaggagcccgggacgaacttctccaccacgccctacggcatcatgctccaggcccggcacttctacgcgatgaagaccatcaagaccgagcccaaggactggaaggacacgttcttcccgatcgtccacaatctgccggggcggtag

SEQ ID NO: 5986 - DNA, 444 bp, Methylobacterium sp.
atggaagcctacgcgctctgcgcgcgcgcgatgcccagcgtgacggaatggcaggcggccatcgacgaaatcgggttcgatctgaaactcgacgccgtgcgcatgccgccggccacgcaagggcatctgtccgcgacttggcggcgccgcgaggccggcttcgagtgccagatcattccgctgtcggatctgacggacacctatatcgacatcgacttcggcaggccgtggacgtgtgtctatgccttctacttcgccacgctcccggcttgcgccggggcgtggatggctgtcgcggcctgcgcggcccggtcggacggtatcgtcttcgatccgcaagaggggcatctgctcaccgccgaggacgcgatccgctacgcgcgcgacacggtggcgcgcatcgtcagtctggacgcgcagttcgagacctcggcggacgactga

SEQ ID NO: 5987 - DNA, 342 bp, Methylobacterium sp.
gtggcggccgcactggcctgggccgtgttcggtacctgggccgaagcccgtcgctcgtccttgcagaaggacattccggcactccgcccggggatcgaggccgatctggccgcgagaaactgtccggccgtccggatcgacacggagcgtttccgtcagttctcgcgcgagaaccatctgaaccacgcggacttcttcacgaagaagcgctcggtcgccctgcagcacggcctcgacgcggaactggcgcagctccgggagcgtccggaggaggcctgcgcgcagatgtggaccaagtacggcgacgacggcaccgtgcagcacctcctcgtccgcaagtag

SEQ ID NO: 5988 - DNA, 219 bp, Methylobacterium sp.
ttgacccacgcccatgaccgagaggatgcccacctgggcgaaggggatgacccggtgctcgacgcggtcgccgtgcttcggtgccgcgggtacacggtcgagccggatgacgactgcgcgcgctggcggatcgacggtgctgactggatcacgctcagcgacctgttcgcgcgggctctgcggctcggcttgagagacgggccgggacgcgcgcagtaa

SEQ ID NO: 5989 - DNA, 1242 bp, Methylobacterium sp.
atgacgccgagcatcgaaccgcgcggggacgccccctgcgacctgcgcctccacgacgccgcgctcgccgagggaagccgggtgacgatcgacatccggggcgaccgcgtggcggcgctgcgggatcccggcgcgccgctcccgcccgccggccgcacgatcgatctcggcggcgcgctgctgctgccgggcctgtcggacgggcacatccacctcgacaagtgcctgctcggcctgccgtggcgcccgcacgcgacggcggggtccgtccgcgcgatcatcgaggacgagaaggcgttccgccgcgccacgcggatcccgctcgccgagcagggcgccgaggcgctgctcgaacgcatgctccgcggcggcacgaccagcctgcggacccatgtcgacgtcgacgacgtcacgcggctcgaccacctcgcccagatcctcgacctgcgggcgcgctgggccgaccgcctgcagatccagatcgtcgccttcccgcagagcgggatcctgggctgcccgccggtcgccgacgacctggacgcggccctgcggatgggcgccgacctcgtcggcggcctcgaccccgtcggcatcgacggagaccgcgacggtcacctggacatcgtcttcgccctggccgagcggcacggcaggggcatcgacatccatctccacgagggcggcgcggccggactcgtcacgatcgcggcgatcgcggcccgcaccgaggcggccgggctcggcgggcaggtcaccatcagccacgccttcgccctcgcggaggccgacgacctggaactcggccggatcgccgaggccttgaaccgggccggcgtcgcgattctcagcagcgtgccgggtggcgcccgatgcccgccgatcccgcggctgcgcgcgctcggcgtcccggtctgcctcggcaccgacaacgtccgcgactgctggaatcccgcgacggtgacgagcatgatcgcccgcgcccagctcgccgcctaccggttcgacctgcgcaccgacgcggacctcgcggcgttgctgctgccgatcaccgccgtcccggcgcgggtgctgggcctcggtccgggcgcggtggcgcccggcgcgcgggccgacctgatcgccttcgcggccggcggcgtgccgcaggtgatcgtcgagcgccaggagcccgtgctcgtcgtggcgcggggcgccgtcgcggtcgaccggcgcggcgcggccgcaggagccccgctaccgtga

SEQ ID NO: 5990 - DNA, 915 bp, Methylobacterium sp.
atgaaccggcgcttcttctgccgcaccctgctcgcgggcggtgtcacgctcgcgcttcccgtccgcggccgtgcggccgggaccaccgtcgccgccgacgacggcgtcgcggcggtggacacccacgcccatgtcttcacccggtcgctcaccctcacgggcgaccggcgctacgcccccgactacgacgcgagcatcgccgattaccgcgccatgctggaccggaacggcatggcccgcggcgtgctgatccagccgagcttcctcggcaccgacaacggctacatggtctcggccctgcgctccgcgccggagcggctgcgcggcatcgccgtgctggccccggaggccgagaccgccaccctgcgcgacctcgccgggcagggcgtcgtcggcctgcgcctcaacctgatcggccggccggacccggatttcgccagcccggtctggcgcgcccacctcgcgcgcgtcgcggatctcggctggcagatcgaggtccaggccgaggcgcggcgcctcgcgcagctgctgccgccgctgatcgcggcgggcgtccccgtggtggtcgaccatttcggccggatcgaccccgccctcggcatcgccgatccgggcttcgccgacctgctcggcttcggccgcggcggccgcgtctgggtcaagctctcgggcgcctaccgcatcggcagcggcgaggccggccggcagacggcggtgcaggccgccgagcgcctgcgcggcgccttcggggcgcggcgcctgctctggggcagcgactggccgcacacgcagttcgagaccaaggccagccccgccgaggcccggcgcgacctcgacgcctgggtgccggacccggccgagcgccggatcgtcctggccgagacgcccgccgaactcttccgcttcgaccgctag

SEQ ID NO: 5991 - DNA, 954 bp, Methylobacterium sp.
ttggcggacagcgcgcacacggccgatcggtcgatccctccctgcccgatcaccggtgcccccgcgctgcgctgcgtcgagcgcctggacgccggcttcctgacgctcctctggcactattccgggcgcgtcgatgtcgggccgctgctgcgtcccgccggcacgttccggctctgggaatcccccacgggattgatcttcttcgatccgccggtggccggcgatgcggccttctaccgggcgttctacggccggatcgccgcgcacgataagctcgccggcccggagacggagcgcctggaattccgccaggccgccgcgcacgtgccgtccggggcccgggtgctcgatgtcggctgcggccacggcgggttccgcgcctacgtgccggacgccacctataccggcctcgacccgaacttctccgccgaggacccgaccggcgcgatcctcgacgagaccgtggaggcgcacgcggcgcgcgtcgggccggtctacgacgtcgcctgcgcgttccaggtgatcgagcacgtggcggacccgctgggtttcgcccaagcgctcgcggcctgcgtcaagccgggcggcgtggtcctgatcggcacgccgctctggccctcgcccaacaccacgatcccgaacttcgtcatcaacgcgccgccccaccacctgacgtggtggacgcccagagccctggaggcgctggccgggacgctcggctgcacgcccgaggccgtccacgccatcggcatggaccggcacgattcgctgatccactggatggccaaggtcagccccgtccgctgccgcgaccgcttcttccggcggacgtggtcctgggcggcggcgctcgccttcgcgtacggcgtcggcgccgtcctcgaccgcgtcctgccggtgccgaagcggacccgcccgaacgcgctgctgctcgcggcgcgcaaggcggcctga

SEQ ID NO: 5992 - DNA, 432 bp, Methylobacterium sp.
atgtcgtcctccccgaagcccaagtccgccaccgagaccgatcgctcgatcggcggccgtatcgcggcgctgcgcgtggcacagggcctgagccagaccgatctcggtcaggccatcggcgtcagcttccagcaggttcagaagtacgagaaagggcgcaaccgcatcggcgccgggcgtcttcaggccatcgccgacctgctgagggtgccggtggacacgttcttcgcggacccgcgggacaacggcggcggacgcgtcggacccgcggccctgttcgaggatccgaaggtcatggaactcgtcctggccttcaccagcatcaccgacgagacgacccgcggcgggatcctgtcgatcgtcaaggcggccgccgccctccaggagagcggcgcggccgcgccgcgtccggacgccgtcgacgaggcgtga

SEQ ID NO: 5993 - DNA, 777 bp, Methylobacterium sp.
atgacggcgacgggcgatcagcgcgctcggtatcccagcctcgccggcaagcgcgtcctcgtgaccggcggtgcctcgggcatcggcgaggggctggtggaggccttcgtcgggcagggcgcccgcgtcctgttctgcgatatcgcggacgacgcggcccgcgccgtggtggcgcgcctcgcgcccggcgccgcgcacgccccgctctaccggcgctgcgacctgaccgatatcgaggcggtccgcgcgctggtggccgaggccgacacggtcctcggcgggctcgacgtcctgatcaacaatgccggcaacgacgaccgccacgctctcgcggacgtgacgcccgcctactgggacgaccggatggcggtgaacctgcgccacctgttcttcgcggcccaggcggcggtcccacccatgcgccgcgccggcggtggcgtgatcctcaatttcggatcgatcagctggcatctcgggctgacggagatgccgctctaccagaccgccaaggcggcgatcgagggcatgacccgggcgctcgcccgcgacctcggccgcgacaacatccgggtggcggcgatcgtgccgggcaacgttcagacgccccgccaggagcgatggtactcggcggagggcgaggcggagatcgtcgccgcgcagtgcctggacggccggatccagccggccgacgtcgccgcgctggtcctgttcctggcctcggacgatgcccggatgtgtacggcccacgcgtacttcatcgacgcgggctggcgctag

SEQ ID NO: 5994 - DNA, 1467 bp, Methylobacterium sp.
atgcaggacgaagctccggacgccaccgccgaaatcacgctggtgaagggggcccggtgggtcgtcgcctgggatccggacagcggcggtcacgtctaccgcaccggcgcggacgtcgccttcgcggacggcgccctcatccatgtcgggccgggctacgcgggtcccgagccggcccggaccgtcgacgcctccggctgcatgatcatgcccgggctcgtcgacatccacacgcacctgttctcggagccgatgaacaaggggatgtgggacgaggtcggcagccagcggctctacaacacctcgctctacgagtacctgccgatcctgcggcccgacgctgaggggacgcgggccgcctacggggtcgcgctcgcggagctcgccctgtcgggcgtcaccaccgtctgcgacctcgccctgccgagcgcgggctggctggatctcctcggcgcctcgggcctgcgggtctgcatcgccccgatgttccgatccgggcgctggctcacccgcaacggccacagcgtggactacgagtgggacgcggcggcgggcctgcgcggcctggagcaggccctcgccgagatcgcggcggcggaggggcacccgagcgggcgcctctccggcatgctctgcccggcgcaggtcgacacctgcacggcggagctgctgcgggacgcccattccgaggcggtcgcgcgcgacctgcgcttccaaacccacgcggcgcagtccctgtcggaattccacgagatcacccgccgcaccgggatgacgccgatcgagtggctcgacgatctcggcgtgctcaccgagcggaccatcgtgggccacgggatcttcctcgacgaccatccctggacccactggcacagcccgggctcggacctgcgccgcctggccgagcgcggcgccacggtcgcccactgcccaacggtattcgcccggcgcggcatcgcgctccaccatttcgggcgctacctccaggccggagtcaacatggggatcggcaccgacgtctacccgcacaacatgctcgacgagatgcgcctcgtctcgtacctcgcccgggtcgtcgccgagaatccccgcgacacccgcgcggcggacgtgttccacgccgccacggtgggcggcgccagggcgctcgggcgcgaggacatcggccggctcgaaccgggctgcaaggccgacttcgtgctcgtggactgcgggcatccggccatgcgcccgtgccgcgatcccgtgcagtcgctgatctactcggccggcgaccgcgcggttcggcaggtcttcgtcggcggccgcgagatcgtccgcgacgggcgcgccctgacgatcgactacgccgccgccgcggccgcgctggaggaggcgcagggccgcgcgctcgcgcaggtccggcagctcgactgggccgggcgcggccccgacgccatcgcgccgccgaccttcccggggctgtga

SEQ ID NO: 5995 - DNA, 681 bp, Methylobacterium sp.
atgcggcctcgcgacaccaccgagcccgcgcgcatcctgatcatcaacccgaacgcgtcccgggcggtgacggccgccatcgacgccgccctggcgccgctgcggctgccgggcggccccatcctcgcggtgaccgacctgccggagggcccggagagcatcgcgacccagcgggacgcggattcggtggtgatgccgctcgtccggtgcgtggcggacgatccgtccgacgccttcgtgatcgcctgcttcagcgatccgggcctgcacgcggtccgggaggcggcgagcggtcgcccggtgatgggcatcgccgagtgggggatcctgcgggccctgacgctcggggagcgcttcggcatcgtggccctgtctgagggcagcgtccggcgccagcgccgcacggtgcgccagatgggcctcggggatcgctatgccgggagccggccggtggaggcgcgggcctccgagacggcggacgccgcgatgggcccgcgcctgatcgcggccggtcggaccctggtcgagcgcgacggcgccgacgtggtcgtgctcggctgcgccggcatggcgcgccaccgggccgccgcggaggccgcgatcgggtgccccgttatcgagccctgccagcaggcggccgccgcggccctcggggccgtgctgctccgggccgccccgtga

SEQ ID NO: 5996 - DNA, 876 bp, Methylobacterium sp.
atggacccttccgagatcgcccgcgtccgccgcttcgcccgcgcggtcaccgccgaggtcggcgcgctcgattcctcgttcctcggccgcggccgtcccctgggcgcggcgcgcgtcctgaacgccatcggcgcgggccgcgcggagatcggcgcgatccgcgcctatctcggtctcgattccggcctgatgagccgtctcctgcggagcctggaggaggaagggctggtcgcgaccgcgccgcatcccgcggatgcccgccggcggggcgcctccctgaccgaggccgggcggcgcgagttcgcggcctacgaggcgctgtcggatgcccgcgccgtcgccctgctggagcgcgcaccgcaggtggacgcgctgctgcacgccatggaccgggtcgccctggccctcggccgcgataccatcgcgatccgggaggccgacccgaccgacgcgggcgcccgcgcctgcctcgccgcctactacgccgagctcgcgacccgattcgccggcgggttcgacgtcgccctgtcgtgcgacccggaggccgccgccatggtgcggccgcgcggcgtgttcctgctcgcgagcgccgacgggctgccggtcggatgcgtcgggctcaaggggggcggcggcgcggtggcggagatcaagcgactctggatcgatcccgcggcccgcgggctgggcctcgccaagcggctgatgcgggaggccgaggccgccgcccgcgacctcgggatcgggacgctgcggctcgacaccaacagcgccctccctgaggcactggcgctctaccggcggtcgggctgggtggagatcgaccgcttcaacgacgatccctacccggaccacttcttcgagaaggccctctga

SEQ ID NO: 5997 - DNA, 621 bp, Methylobacterium sp.
atgctgccggagacgagaatcccgaccctcacaccgggctacgcgacggtgccgcccggccatctcgccacgatcgtcaccagcctggagatgctgcggccgccgcccccgcgtcccggacggccgttcccgcccgggctcgccctcgagcccctggaacgcaccgacccggagacctaccggaacctgttccgggcggtgggcgccgactggctctggttctcgcgactcaccctgaccgacgaagcgctggcggcgatcctggccgaccgggatgtcgagatcctcgcgctgcggcgggacgggcggaacgtcggcatgctggaactggatttccgccggcccggcacctgcgagctggtcttcctcggactgaccggggacgcggtcggtaccgggatcggccgcacgctgatgaacgcggcgatcggccgggcctgggcgcgtccgatcgcgcggttctgggtgcatacctgcacgctggaccatcccggcgcgctcgccttctaccggcgctccggcttcgtgcccttcgcgatccacgtcgaggtcgcgcccgatccgcggctcgacgggaccctgccgcgcgactgcgccccgcacgtgccgcggctcggctga

SEQ ID NO: 5998 - DNA, 384 bp, Methylobacterium sp.
atgagccggcggctgatcacgtcggggtccccgttcgagcgggattacggctactcccgggcggtggtcgacggcgacaccgtctacctgtccgggacgaccggctacgactacgccacgatgacgatgcccgacggcgccgccgcgcaggccgaggcctgctggcgcacgatccgttcggtcctcgccgaggccgggaccggcctcgccggcatcctgcgcgccacctactacgtcaccgaccgggacgatgccgaggccgtgctggccgtctgcgggcgggtgctggcggacgtccggcccgccgccacgatcgtggtcgtggcgggcctcctgcgccccgagatgcgcgtcgagatcgaggtgaccgcgcggatcggctag

SEQ ID NO: 5999 - DNA, 1650 bp, Methylobacterium sp.
atgatgtcgcagattgtcctgacagggctgctcatagcggtcatcggtgtcgtcggactgcgcatgtattaccaggaaatgctgtcgggtcggctgcagtccctgcgcacggtcacggagttgttcaccacctatgcgcaaagtctcgagacccgggtcaggagcggcgccctgtcccgcgaggcggccgtggcggagctggccgagaccgccatggccatgcgattcgataacggcaccaactacgtcgccatctacgcgatggacggcacggttctggcggttcccgaccgccgtctcgtcggcagcaatcaactggagacccgggtcaacggcgttcgcgcggcgggaacgctgatcgatcggctgaagacctccgacacggcgacgctgagctatctctacccccggccgggacaggaaggcctgtctccgaagacgacgctcgccgtcaggttcgagccctgggacatcatgatcgcggcgggaacctacaccgacgacatcaggaccgccttccaggcgctcgccctcgcggcgatcggccttctgctcggggtcggcgcgctcggggtgatcggctccgtcctgatcgggcgcggcatcacgcgcccgctcgaccgcctcggccgccggatgcaggcgctcgcccggggcgacggcgcggagccgataccgggcctcgagcggacggacgagatcggtcagatggcccggaccgtcgaagtgttccggcaggcgctggtcgccaaggccgagacggaccgggcggtcgcgcgcgaagctgaggccaaggtccggcacgcgcagagcctcgacgcgctcacccgggcgttcgaggcccgggccggggcgctgatgacgggcgtctccgcggccgccacggagatgcaggcgactgccgaggcgatggcgcggacggcgtcgcgcacgagtacccgggcaacacgcgtcgccggagccgcgcaggagaccgccgggagtgtgcagagcgtcgccgcggccaccgaggagatggcgatcaccatccaggagatctccggacggatggcgcaatcctcggccaagaccgcgggggcggcgaccgaagcgcggcgcaccgacgctctcgtgggcgaactcgccgacggggccgagcggatcggggccgtcgccagcatgatcgcgggcatcgcccgtcagaccaacctcctggccctcaacgccacgatcgaggcggcgcgggccggcgaggcgggccggggcttcgccatcgtggcgggcgaggtcaaggcgctggccgagcagaccgcggccgcgaccgaggagatcgccgcgcggatcggcgcggtccaggcctcgacccggcaggccgtcgaggcgatccacgggatcggccgcagcgtgggcgaggtcagcacgctcgccgcgtccgtcgcggccgcgatcgagcagcagggcgcgaccaccgaggagatcgtgcgcatcgtcgcgcgcgcggcggccggcacggaggccgtcaccggcaacatcgccgaggtctcgcagggcgccgaggcgacgggcgaggccgccgagcaggtcctcggcgccgcgatcgacctgtcgcgcaggtccgatcagctctccgccgagatccaccggctcctcgacgggatccgggctgcctga

SEQ ID NO: 6000 - DNA, 837 bp, Methylobacterium sp.
atgtcggacgccgtgaccggaccggcagccatcgccggagagagccacgaggccccgccgcgcgacaaggagcgcctgcgcgcgggcgtcctcgtcctgctcgtgcagatcgcgcttcttgcggccctgctgtcggcctgggaatggcagacgcgcctgaacccgcaagcgtcgttcctgttcggttcgccctccgcgatcggccgcttcctctggcagggtctcgccgacggcacgctcctgcgcgacgcgggcgtcacggcccttgagacggggcttggattcctgatcggcaacgtcgtggggacgctcgctggcctgtcgctctggtactcgaccttcgtctcgcgggtcgtccagcccttcatcgtcgcgatcggctcgatcccgatcatcgcgctcgccccgatcatcatcatctggttcgggacgggcctcgcctcgaaggtcgcgatgtcgacgctgtcggtcgtcgtggtcgccctcgtgacctcctacaagggcgcgctcggcgtcgatccggaccagatcaacctcctgcggaccctcggcgcgcggaagccgcagatcttcgccaagctcgtcgtgccgtcgagcctcgccgacatcttcgccggcctgaagctgaccgtcggcttcgcgctgatcggcgccatcgtcggcgagttcatgtcgtcgtccgtggggctgggccacgccatcttccaggcgggctccctctacgcgatcccgaaggtgttcgccgcgctggtcggcacgatcgcgctggccctcgtcctgaccttcctggtcggtcgggctgaacggatcctcatgccctggcgggatcatctctga

SEQ ID NO: 6001 - DNA, 861 bp, Methylobacterium sp.
atgtccgaaggccccccgcacgccgcgacccaccccgcgcctccgcttgccgtcgagcacctcgccaaggcgtatcggacgggcggtcgcctcctgccggtcgtcggcgacctcaccttcgcgctcgcccgcggagagatcgtggcgatcgtcgggccttcgggctgcgggaagaccacgctgctcaacgccgtctgcggtctgacgccggtggattcgggccgcatcctctggaacggcgtgcccctcgaccggcgcggacggccgccgagcgggatcggctacatgctgcagaaggatctgctgctgccctggcgcacggccctcgacaacgtgaagctcgggaccgaactgcgcgggatgccgcgcgggcaggccgacgagcgggcgcgggcgctcctcgaccagctcggcctgcacgggttcgccggggcctatcccgcgaccctgtcgggcggcatgcgccagcgcgtggcgctcgcccgcaccctgatcaacgatccggacgtcctgctgttcgacgagcccttcgcggcgctcgacttccagacgaagctgctgatcgaggccgacacggtgcggctcgtgcgcgagggggccaagtccgccctcctgatcacgcacgacatcgaggaggccgtctcgatcgccgaccgcgtcctcgtgctgagcgggcggccgaccgccgtcaaagccagctacacgatcgacctcgactgcgcgcccgacgacatgatcggcgcccgggagagcgctggtttcggcgattacgtccgccagatctgggccgatctcgatatcccacgctccacgctcggcggtgccgggcgtggcatccgccgcgctgccgcgaggtcgtga

SEQ ID NO: 6002 - DNA, 954 bp, Methylobacterium sp.
atggctggtctggcggtcggtgcgccgctggtcgcacgggccgcgggcctcaagaccgtccgcttcagcgaggccgtgcataacctcggctacatcaacctctatgtcgggattcacgccgggatcttcgagaagaacggcctcgccatgcaggtgagcgccgccggcggcgacacgcagaccttcgcggccgtgctgggcggctcggcggatttcgccatcggcgatcccacgatggtggtgatctcgcgcgagaacggcggccccgggatggtcgtcggcaccgttgttcagcgggcccactacttcgcggtctcgaagactgtcgagcccttcaccgacccgaaaggcttcaagggcaagcggatcgccacctcgccggagcccaacaccaacttcagcgtcaccaagcggctcctcgagagcaacggcatgaagctcggcgccgacgcgacgatcgtgccggtgagccccggaaccgagatcgccgccatgctcgcgggtgcggccgacatcgcggtcgcctatcagccgggcgtggcgcaggcggtggcgcagggcgccaggatcgtgttcgatttctcgaactacgtcggacccttctgcaacaccgggatcatggtgctgcccggcacgatccagaaggatcccgagaccgtgcaggctctggtgacggccttcgaggaggccgggcgcaggacctacggcgatcccgactacgccaaaaaggtcgcgcggctggaattcccggatctgccgggcgaggtcgtggacgcggcgatcgaggccgagctgaaatacaagattccggcttcaaccgtcgtgaccgagaaggacgcctgggaaagcctgatgggcatgcagaagtacctcggcaacatcaagggcacgctcaccttcgatcaggtcgtcgacaatacctttgccgacaaggccgcgaagcgcgccggttga

SEQ ID NO: 6003 - DNA, 1500 bp, Methylobacterium sp.
gtgctcctgctggaagccgggcgcgactggcgctccgccgatgcgccgccggcgctgcgctcggccaacatcatcccgttcatgtatgacctggcccatcaggcggactggcagtggccggggctgatgagccggcggacccgcgtgcaggagccccgcttctactggcgcggtcgcgcgctcggcggcagttcgacggtcaacgcgcagatcgcgatccgcggcgtgcccgccgccttcgacgcctgggcggagcagggctgcaccggctggtcggcctcggatgtgctgccgctcttcgaccggatcgaggacgatgccgatttcggcaccgaagacggcgcccggcgcggcggtccgctcccggtccaccgcgcgaagccggaggcctggggcgcggtggatctggggcttcgcgcggccgccctcgcggccggccatccctggaaggcggacctcaatgcgccgacgggcgagggagtctcgtgcaacccgatcaacagccgcgacagtcaccgcgtcaccaccaatgacggctacctggaaccggcgcgcgaccggccgaatcttgagatccgctgcgaggccctggtcgatcgcgtcctgttcgcgggacgacgggcaaccggcctgcgcgtgcgcttcggtgcggaaccctggaccgagatccagggccgcgagatcgttctgtgcgccggcgccgtccacagcccggcgatcctgatgcgctccgggatcggcccggccgagccgctgcgcgcccttggcatccccgtccggcaggcgcacgaggcggtcggccgcaacttcatggaccatccgatcctgcgggcgacgatggatctgaagccggaacaccgagccctcggtccggatgcgcgccacaccaattgctgcgtcacctattcgagcggcctctcgggcggcggggagcgcgacatgatcttcgtcgcctacaaccaccggaccctgaccgggccggaaccgacgccgcagggcgccgtcggcgtcggcctctacgacgcgttctcgcgcgggacgctgcacctcaccgcggccgatccggaggccaacccggtcatcgacgagaatatgctcgatgacccgcgggatcgcctgcggatgcgcgacgcggtgcgccgcctcgcgggcttggcggcgcatccggccctggccgatctcgcaacggcgatccggttcggcgagagcccgcttccgatcggcgacgccgcgcgcctcccggatgacgaactcgatgccctgatgctcgccgaggccggggacatccagcacgccgccggcacgtgccgcatgaccggctggcaggacgcgtccggggtcgtcgaccccgatctcaaggttcgcggaatggatgggctgcgggtttgcgacgcctccatcatgcccagcgattgccgcgcaaacctacacttcacctgcgtgatgatcggcgaaaatcttgcgcggcgcatgttgacgggcggatcgcgtcacccgtga

SEQ ID NO: 6004 - DNA, 414 bp, Methylobacterium sp.
atggcgaccgtgaaactctggtccgatgccgatgctgaggccgacccgcgcgtccgcgcggtcttcgccgacatccgggcgacccgcggatccgatttcgtcaacaatttctggcggggcctcgccaacgatccggcactgctggagcggacctggtcgacgctcaagaccgtcatgggaccggggaccctcgatcccctgaccaaggaactggtctacatcgcggtctcgatcgcgaatggctgcccctattgcatccattcccataccgcggcggcgcgggccaagggcttgacggaggcacagcacggcgagttcctggcggtcgtcgggatggccaaccagaccaacgcgctggtcaacggcatgcaggtccccgtcgatcccgccttcagagtggaggaaggtccatga

SEQ ID NO: 6005 - DNA, 681 bp, Methylobacterium sp.
gtgggggcgcgggtgcagcgatccctgcgctcgcgcaccgtgacctggatgacggtggggttcgccacgatcctggtgatgaccgccatcgcgctcggcgccttcgtgtaccagcagcgcggcgtcgacgccgtgcgccacaccgtggcggtggacgggcgcctcgcccgggtcctgtctgcggtgcaggacgccgagaccggccagcgcggctacctgctcaccggcgacgaggccttcctgctgcccttcaccgaggggcggctgaacgtcgaccagcagctcgatctcctgcgcgacctcgtccaggacgaccccgaccagcgaggcgatctcgacaccctggccgggctgatccgccggaagctcgacgagctcggcgccagcgtcgccctcatgcgcgccggcgacggcgcggcggcccgcgcctcggtggcggacgggcgcggcaagcaggtgatggacgcgatccgcgaccgggtgcgccgcatggaggcgcacgaggcgcggcggatggagcggcggcaggcgacggtgtcgcggatcgccctggccatctgggtcatggtcggggccctggcggttctgttcgtgctgttcgccgtgtcggccctgcgggaggcgacccggcgcaaccggctgtcgcggttcctgccgcaggagctggtcctgcggcaggaa

SEQ ID NO: 6006 - DNA, 501 bp, Methylobacterium sp.
atgaaggatcgctggctccgtctccgtgccgacgactgcgtgacgccgtcgggtcacatcgtcgatccctattacgtgctcgagacgccggacatcgccctcgtgctgggcatcgacgcggccgatcacgtcatcctcgtacgccagtaccgtcatgcctatggcggcccgagcctggagcttccgggcggggccatcgaccccgccgaccccgacatcctggcggccgccgagcgcgagatgcgcgaggagaccggctacatcttcgccgatgccgagcgcgtggtcaccctgaacgcggatccggcccgctacgccaaccgcatgcatctcgtccgcgcgcgcgtgacagcggccgggccggcgcagccggatcccgccgaggacatcgccgtggtgcgcgtaccgcgagccgaggccttacagctcgcccagtcgggcgccatcgtcggagccgtgcacgccgccatgctcctgatcggcctgtccagcaccggatga

SEQ ID NO: 6007 - DNA, 603 bp, Methylobacterium sp.
atgacgactgatcacacagcaaacccgtggctgacgctttcgagtgagacgtaccacgaggacaagtacctgcgtctagacgtcgaccaggtgcgacatcaatcgggtgtcgagcacccctataccgcggtccgcttcaaggtttttggcctcacggttctgccgatcgacgatgccggccgcaccttcctcgtggggcaatatcgctatctgctcgatcgctacctctgggagttgcctcgcggcgggggcgcagttgacgtgccgccgatcgagacggccaagcgtgaactcgcggaggagacaggccactcggccgcgcactggtttgagctgcccaagctgactgcctcgccggagatcacgagcgaatgggcgccctgctacatcgcctggggcctgtgcccaatcagtgcggaagctgacccgcaggagagcctcagcattcgccgcctgcccttcggcgaagcggtcaacgcagtgcttgcgggcgaggtcgtcgacgcagcgagcgtcgcgctccttcttggaacagcggagcgggctcgccgtgggcagttgcctcaagatctcactgcgttgctaggcacaggcggcctttag

SEQ ID NO: 6008 - DNA, 759 bp, Methylobacterium sp.
atggatgcgatggatcgagagaacggcacgacgcgtctgggcatgctgacgccctcgtcgaacagcgtcctcgagccggccacggcgcatctgctggccggcgtcgcgggcgtgagcgcccacttcgcccgcttccgcgtgacggagatcggcctgtcggcggcggccctggaccagttcgaccccgagccgatcctggcggcggccgaactgctcgccgatgcccgcgtcgcagcgatcctgtggaacgggacctccggcgcgtggctcggcttcgacgcggacgagcgcctgagcgccgcgatcaccgaccggaccgggtgcccggcctccaccgccgcgctcgccttccgcgacctgttccgcgcccgggatttccggcggatcggcctcgtcacgccctataccggcgacgtgcagcgccggatccaggccaactggggcgcggccggcttcgactgcgccgccgagcgccacctcggcctgtcggagaacttcgccttcgccgagaccggcccggaggccatcgccggcatggtccgggcggtggcggccgagggcgtcgacgcggtggcgatcgtgtgcacgaacctcgcgggcgccgcgctcgccccgaccctggaggcggaactcggcgtgccggtgatcgattcggtggccgtcaccctgtggaagggcctggagctggcgggctgcccgacggcgcatctcgccgcgcacggccgcgccttcgcggcgggcggggcgggccgcccgtga

SEQ ID NO: 6009 - DNA, 984 bp, Methylobacterium sp.
atggccggaccgatcgggcgccgcgcggacgcgcccggaaccgccggaatcgacgatccgctgagcggcctcgcgccgctgctgcgcgtgcggccgcacctggacgacgtctgccggttcggcggcgcctgggccgccccgcacgcgccggagccgacgcggcaggcctattttcacctcgtgacgcgcggccgcgccacgctgcggcggcccgggggcgcgccgctgcaggtcgcggccggggacatcctgctcctgccgcgcggcgacgcgcacctgttccacggcgcggggtcgccgccgtcgacgcccctgcccgtcgcggtccgccacgcgcacgatctgcggttcaagaccaccgtcggggccgagccggacgtcgagctgatctgcggccgcctggccttcgaggcggcgccccagacgctgatcgtgaccgccctgcccgacctcctcgtcctgagcgtcggcgccgagcccctggccacccgcttcgcgccgctcctggcgggcatccgcgcggagctgaacgacctccgcgccgggtcggtcgcggtcgccgagaacctcgcgagcgcgctgttcatgatgatgctccgcgcgcatctcgaggcgtcggccccggccgagggcctgctgcgcctcctggggcagccgctcaccgcccgggcggtgctcgcgatggtgcgcgacccggtgcatccctggacgctggacgaactggccgcgacggccgccgcctcgcgggcgagcctcgtgcgcgccttccgcgtcgccgcgggcgtcgccccgctggaattcctcaccgacctgcggctcgggctcgcccatcaccgcctgcgcaccgagacggtcccgctggaccgtctcgccgcggaggtcggctaccagtccgcgcccgccctcagccgggcgttcctgcgcaagtacgggatccgccccggacaggcgcggcaggccgaggcgcccccgcaggcggtttga

SEQ ID NO: 6010 - DNA, 561 bp, Methylobacterium sp.
atgtccgatgttgcgctgctggtcatcgatgtccaggaatccttccggcacagacccttctggaacgacgccgatgtcccgcccttcaccgcgcgcctgcaggcgctcatcgacggcgccgccgcgcggcggatcccggtcctgcaggtgttccacgtggccgagagcggcccgttcgccatcgcttccggccatgtccgcaccctcgagccggtcgtgatcgcgccgacggccacgttccacaagcgccggcacagcgccctggtcgatagtggcctgtcgggctggctgacgcagcacggtatccgccggctgatcgtgtcgggcatccggaccgagcagtgctgcgagaccacggcccgccacgcctccgacagaggctggcaggtcgactacgtgaccgaggccaccctgaccttcgccatgacccacccggacggccgccgcttcggcgcggacgagatcaaggcccgcaccgagctggtgctgaccgaccggttcgcccggatcgccacggtggaccaggcgctggccggcccggacctgccggtcgccgcgtga

SEQ ID NO: 6011 - DNA, 939 bp, Methylobacterium sp.
gtgtggataccgagcccgcgctacccggacccggccgtcgagatcctcgacgccgccttcgcccgctaccgggtattcaacgcggcggtcgagcgcctcgcgaccggcttccgctggtgcgaggggccggtctggttcggcgacggacgctacctgctctggagcgacatccccaacgaccgcatcctgcgctgggacgaggagagcggggcggtcggcctctaccggcggccgtcgggcttcgccaacggcaacacccgcgaccggcaggggcggctcgtcacctgcgagcacgggggccgtcgagtcacccggaccgagcatgacggcgcgatcaccgtgctggcggacgcgttcgagggctgccggctcaactcgcccaacgacgtggtgaccgcggccgacggcgcggtctggttcaccgatcccccgttcgggatcggcgggttctacgagggcgtgcgcgccgagcccgaactgccgcagaacgtctaccggctcgacccagtcaccggcgcgctgcaggccgtggccaccgacctcgccggccccaacggcctgtgcttctcgcccgacggccgcgtgctctacctcgtggaatcgcgcgggcagccgacccggcggatcgtcgcctacgacgtggtcgccggccgcacgctccgcgaccggcgggtcctgatcgatgccgggccgggcacgccggacgggctgcgctgcgacgtcgacggcaacctctggtgcgggtggggcatgggcgacgacgccctggacggagtcatggtgttcaaccccgacggccggccgatcggccgcatccggctgccggagcgctgcgccaacctctgcttcggcggtcggcaccgcaaccgcctgttcatggcggcgagccagtcgctctacgccgtctacgtcgacgtccagggctgcgccggcgggtga

SEQ ID NO: 6012 - DNA, 837 bp, Methylobacterium sp.
atgaagcagacgatgccgcaaacgctgggcctcaaccgcatcctcggcggtgcgatcggtgtcatcgccctggtgtcggtcctgaccagcggcgcggtcctgatcacggccgatcagctgcgtgacgcgaccgatgcccggagccggtccaaccagctgatccgcgccctcgacggcttccgcgcggccatgctcaatcaggagaccggactgcgcggctacctgatcaccggccgcgacggcagcttggagccctaccgcacggggcgccagacactggacgaggcgatcgacaggctgaggaccctgatcggccacgatcccgagcggacgcgcctcttggccgacgcggtggccgcggcccgcagctggcagaccgaggtcggcgaggtcgtcgtgcgaatcgcggccgatccggcgaagcgggaagaggcggtcaagatcgaggcggacggtcagggcaagcggctgttcgacaccttccgggagaaactcgcggccatcgagggtctcgaaggagcggttcgggccgcgctggccgagcgcgtcgcgcggagcgagcgcaacgagagcctcgccctctggggcggtacgctgatcacgctgctgatctgcctgggcatcggggtcgccatcaaccgcctcgtcgtcaggcctctcgtgggggtgatgggcttcgtgggacgggtcggcgagggtgacctgtcgagcacgctcgatgtccgcgccggcggcgaagtgggccgtctgagcacgacgctgaacacgatggtctcgggtctctcggacctggcgcggacgaaccgggcggcgacggcggacctgaacgcggccgcg

SEQ ID NO: 6013 - DNA, 357 bp, Methylobacterium sp.
atgtcagcgacgacacctggtcgccagtcgcttggctttggggatgacctggatgcctttgatccggctgagttcgccctagtcaagcccaaagcgcccaagcccgaacccgagatctctcggaaggctgccgaggccgtaggctttcgcagccgcgaggcgcagaaggccgagccagcgccggccaagatccaacagcgccgtcgtcgcactggccggaacgcccagttgaaccttaaggccaagcccgagaccatcgccgcgttcacgcgcatcgctgatgccaagggctggggcttgggcgaggcctttgagcacgccaccgcgctgctcgagcgagagtacgctaccaagtag

SEQ ID NO: 6014 - DNA, 450 bp, Methylobacterium sp.
gtgtacgtcgactgcgccacctgcaagcgctcgggtcgctacacggtcgccagcctgatcggtcgttacggggccgacatctcgacgctcgacctgctgcggcacctgacggcctcgtgccgctaccagcgcgcgcccggggcgccgcccgcgcggaagtacgaacacctctgcctcgccgcgatcacgctgccgccggcgctcaagcaaatcccgccagtgccgccgggcaccccctatacgatcgaggtctgggaccgaatcggcggcaagctcgagctgcacctcgccacgatctacccgctgaccgtggcgatcgctgcgttcgaggccgcctgcctggagtggccaacgaacgaagtcacccttcgggatcgagctcggatcgtgcggaagcgggagctgccgccgcggagcaccaccgcgtccgcgtccggcgaaccacgctga

SEQ ID NO: 6015 - DNA, 1041 bp, Methylobacterium sp.
atgcgaccgaaaccgatcctgcagctgaggggcgagagcccgggtcatcgtcaggccgacgactggcgcgacgctgtcgcgccgttctgggatttcacgatccgccgggaggacctgcccgatttccgcggacagtcccgggtccgtcacctcggcaccgcgatcgtctgcagcgcccgcgcctccgggctccggttcgtgcgcgcgcgggccctgaccgcccggatgggcgtcgaccacatcgtcgcccacatgcgcgtctccgggcagtcccgggtcacgatcggcggccgggagcgggactgcgcccccggcgacatctgcctgttcgacctgtcgcagccgctctccgccgcctccacggactacgaggccatcacggtggtgctgccgcgcccgctcttcggatcccggcagagcggcctcgacgccctgcacggctcggtgatccggggcgcgaccccgttcggccggatgctcagcgaccacctgcactccctgagcgcgcacgcgaccgggttctcggagccggaggccgcggcggcggccgaggccacggccgcgctgctcggcgcggcgaccctgggcctgccggaggacggaggcggcacgcagccgcccgagcgggcgcctctgctcgtcgcgatccggcgcttcatcgaggccgagctggcctccgcggatctgtccgccgagacgatcgggcggcggttcggcgtctcgcgcagcgccctctaccggctgttcgtccccctcgggggggtctccggctacgtccggcagcgccggctcgcccgcgcctaccgcgacctcgccgccggcgacgggcgcttcgcccgcatctccgaggtggcgtatcgctggcgcttcgagagccccgcgcatttcacccaggccttccgcgcggaattcggctgcgccccccgggacgtccgcgggcgggccgcggccgaggccgatcggtccccggcctcggagccgccggcccaggccgagacctgggccgacttctaccagtgggtcctcaagctggcggcctga

SEQ ID NO: 6016 - DNA, 1029 bp, Methylobacterium sp.
atgatctcgatcggtatcgtcggatacggctactgggggccgaacctcgcccggtgcacctcggagagcgagcgctgccagctggtggccatcgccgaccagtcgcccgccgcgctcggccgggccggcaagcgctaccccgccgtccagctccatcaggactggcgcgacctcgtggccgatcccgcgatcgacgccgtcatggtggcgacgccggtgagctcgcacttcgagatcgccatcaacgcgctgcgggccggcaagcacgtcttcatcgagaagccgatcacgccctcggccttcgaggcccggttgctgatcgaggaggcggccaagcgcaacctgcggctgatggtcgatcacaccttcgtctacacgggcgcggtcgagaagatccacgaactcatcacgaccgacgccatcggcgacgtgttctactacgactcgacccgggtgaacctcggcctgttccagcgcgacgtgaacgtgatctgggacctggcggtccacgacctcgccatcctcgaccacatcctggacctcgccccggtggcgatctcggcgagcggcaccggccatttcagcggccgccccgagaacatggcccacctgaccgtcttctacccgcgcggcgtcgtcgcgcagatcaacgtcaactggctcgcgcccgtgaaggtgcggcagacgctgatcggcggcagcaagaagatgatcgtctacaacgacctcgacccgatcgagaaggtcaaggtctacgaccgcggcgtcaccgtcggcggcggctcggacgacatcaccgagctgatggtctcctaccggaccggcgacatgtggtcgccgcacctgtccttccgcgaggcgctgatcgtcgagatcgagcacttcgccgactccatcgagaacggcaccgcgcccatgaccgacggccacagcggcctgcgcgtcgtcgagatgctcgaagccgccatgcgctccctgcgccagaacggcacccctatcgacctcatgccacttgcgagggcctcgtga

SEQ ID NO: 6017 - DNA, 159 bp, Methylobacterium sp.
gtgaacgaggtttgccacagcctcagtctcagccgcaccactgtatacgaactgcttgccaagaagcgcctgcggtcgatcaagattggagtgaagaccctgatcccagccgatagccttcggagcctgatggcctcccttgagatggaggcggcataa

SEQ ID NO: 6018 - DNA, 927 bp, Methylobacterium sp.
atggatctcaacctgcggcaggtgcgggccttcgtgtccgtcgtccaggtcggcagcttcacccgcgcggccgccctgctgaacctgtcgcagcccgccctgacggttcagatccaacgcctggaggagatgctcgacgcgcggctcctcgaccggaccagccgcaccgtcgcgccgacgcggctcggccgcgagctgctgcccgtgttcgagcgggtgctgcgcgacctcgacgccgtggtggtcgacgcccgcgacctcgcggcaaggcgccacggggtcgtgcgcgtcgcgacgctgccgtccttcgcggcgagcgtgctgtccgacgcgatcgtccgcttccgcgccgagcaccccgccgtgacgttcctgatcaaggacgtcatcgcgcagcgggtgctcgacctcgtgcgcgaggaggaggcggatctcggcatcgtcggcggcgacgtccgcgatccagagatcggcgtcctgcaccggacgcgcgacgccctgcacgtgatctatcccgccgatcacccgatcggcgcgctgccccgggtcacgatcgcggcgctcgccgagcaccccctgatcctgatggacccagccacgagcgtgcgggcggtggtcgaccgcgccttcgtcggctcgggccggctgccccgcgtggcctgcgaggccacctacatgatgaccgccgtcagcatggtccgggccggcctcggcctgacgatcctcccgggcgcggcgcgggagatccgggccgagccgctgctccgttcgcggccgatcgacgacccgctgttcgagcgtccggtctgcctgatcaagaaggccgggcggacgatgccgccggccgccgaagcgttctgccggatggtggcggaccggctcgcggatccgggcgggacgtccgccggcgccgcgccgagcctctga

SEQ ID NO: 6019 - DNA, 831 bp, Methylobacterium sp.
gcggaggccgagatcgtcgcgtggctgcgcggcgcggtccggccgggccacatcgtggcgaccgtctgcgagggcgcgctgctcgcggcgcgggccgggctcctcgacggctacacctgcaccacccaccatgccagctgcgaccggctgagggcggcggcccccggggcccgggtcctggacaaccgcctgttcgttcaggaccgcgaccggttcagcagcgccggcgtcacggccggcatcgacctgatgctgcacctcgtggcggagtgggcgggcccggctacggcggtcgccgtcgcgcggacgctcgtcgtgtacatgcggcgcgggcccgaggatccacagctctcgccctggctcgaggggcgcagccacctgcacccggcggtgcaccgggcccaggacgcgatcgccgccgacccggcccgggactggtcgccggcgctgctcggccgggtcgtgggcgcgagcccgcgcaacctcgcgcggctgttccggctccacgccggcatgaccgtgacggacgcggtcaaccggtcccgcgtcgcgctggcccgggacctgatcgcgcagagcgacctcggcctggagcaggtcgccgagcgcgccggcttcggctccgcccggcacatgcgccgcgtctggcggcagttccacgcggcggcgccgtcgcgcctgcgcgccggacccgcggacggggcgtccgcgccagtccgcccgaggcccccccgagacacccgtccttgcgagcggagcgaagcaatccagggtagcgctccgctttccggcgtcgcgcgaccctgggtcacttcgctgcgctcgcgatga

SEQ ID NO: 6020 - DNA, 951 bp, Methylobacterium sp.
ttgcccctggcgctcgccgggtggccgcgcgccgtgctggcacagggtcaggcccatgtcgcggccctgtggccgttcgcggagggcgatttcgagggccgggtgctggcggaatcgttccacgccggcctgcgcgatcacggtcatcccgatcagcgggtcgacgatcgctggaccggggccgaccgcgagcgcacgcgtctcctcgccaccgaactggtggccgcgcagccgcaggtgatcttcgcctacctcagcgcgcagctcacggccgtggcggctctgacgaagcagatcccgatcgtgttcgtcggcgcctcgaaccccgtccgcttcgggtacgtggagagtctccagcgcccgggcggcaacatcaccggcttcacgctctacgaggcgccgctgggcgggaaatgggtggcggcgctcaaggaggccgttccgagcctcaggcacgtcaccctgctgtccaatccgagcaccgagatccgcggcgagaacctctacgccgggccgttccgcgccaccgcggccgcgctcgggatcgagccgcaggtggtgaagatcgacaaggcggccgagatcgagcctgtgatcgccgcgctcgcgcggcggggcgacgggggcctgatcgtcgcccccggcacgttcagcgaggccaacggcgaccagatcgtcgcgctcaccacgagtctccgggtccccgcggtcttcgcgatccgccgtttcgcctatcggggcggcctgatgtcgtacggaccggatccggtggagacggtccgccgggccgccgcctatgtcggccgcatcctgcgcggcgagaaccccgcgaccctgccggtccaggcgcccacgaagttcgacttcatcgtgaatctcaagacggcccgcagcatgggcgtgacgatctcgtcggcgctcctcgcccaggcggacgagatcgtcgaatga

SEQ ID NO: 6021 - DNA, 639 bp, Methylobacterium sp.
ctgaaggccggccgccgccagcacgccgccatcgtgttcgtcgacatgcgcggctcgaccaccctcgccgagagcctggatccgcaccggctctccgagttcctgtccgccttccggcggcgggtgacgcgcctcgcccgcctgcggggcggtgtggtcgacaagttcatcggcgacggcgccctggtggtgttcggcctgcccgagccccggcccgacgacgccgcccgcgcgctcgccttcgcgcaggacctcgtcgcggtgatcgcccgctggaccgacagggccggacccgcgcaggccgtgcggatcggtgtcggcgtccattacggcgaggtgttctgcgggatcatcggcgaggaggcgcgctacgagttcaccgtgctgggcgacgccgtcaacgtcgccgcccgcctcgagcaagcgaccaagctccacggcgtcccgatcctggtctcggaggccgcgcggcgggccgcgggggcgccggccgaggcgtggcgcgaggtcagccgcgagcccctgcggggacgccgcgagggcatggcctaccacacgcccgccgcctcgggagcggccggtcccggcccccgccgggaagaagatatcggactctcggcggtcgaaccggcactctga

SEQ ID NO: 6022 - DNA, 915 bp, Methylobacterium sp.
atggagacgtcccccgacgatccccgccggcccgagaaccgtctcgcctaccgcgccgccgtggaccgaccgcgcctgaccttgccgggcggcaagcacgtcgcggtctggccggtggtcaacgtcgagcactggctgatcgacaacccgatgccgcgccagatcctggtgccgccgaccgccgcgagcctgctcccggatatccccaactgggcgtggcacgagtacgggatgcgggtcggcttctggcgcttcctcgaggccttcgtcagccgcggaatccgcccgacgctgtcgatcaacggctcggtctgcacggcctatccccgcgtcgccgaggccgcccacgcggccggctgggagttcatggcccacggcttccaccaggtcccgacgcaccgggtcgcggaccagccggcgatgatcgcgcgcaccgtcgcggcgatcaccgagaccacggggcgcccgccgcgcggctggctcggaccgggcctcaccgagaccctcgacacgcccgaccacctgcgcgcggccggcctcgcgtacgtcggcgacttcgtggtcgacgaccgcccctgccgggtagcgacgcgcacgggcgacctcgtcgccctcccctactccgtcgagctcaacgacatcccgctgctggccatccagcaccaccgggccgacgagttcgtggagcgggcgctcgcccatctcgaccggctcgccgccgaggccgccggctccggccccctcggcggcgccaaggtgatgggcttcgcgatccacccctacatcaccggcgtgccgcaccggatcggcctgctggagcggctgctcgacgccatcctcgcccgcgacgacgcggtgttcatgcaggggggcgagatcctcgactggtaccgcgccaccggcgacgaatcctga

SEQ ID NO: 6023 - DNA, 633 bp, Methylobacterium sp.
atgcacttcgactccggcgagatctccactctcgtctggaaggctgccgcgaaactcgatgtggtttcgccgcgcaccggtcgccggctgcatgtcacgccgcgcaggctgagacataccttggctacgaatttcgcggctctgggcatccccccattcgcgatcgccgaggctctcgatcattcgagcctgaacacggtcatggtctacgtggacaatatcagggtcatccaagagaggatagaccatgccttggccgagtatatggccgaggtttccgggggcttcctgggccgattgatacccgacgaggttgccgccggcggatcggcggcagaccgcatctatgccgatttcggagaaggcgaggtcgaggcagtcggcaactgcggtctatcaagcgagtgcaacctcgccccgccgatatcctgctataaatgtcgcttcttccgcccgtggctcgacgcctcccacgaacgggtgctggaaatggtcgaggcgcgagcgcatcggttgcgtgaagccggtgcgatcgaacgtctggtcgagctcaacgtcgacgcgatccgtgccattcgtaatctcatgaacgaagcgtcggcgcttcggaaggccggtggaggtagcatataa

SEQ ID NO: 6024 - DNA, 456 bp, Methylobacterium sp.
gtgcggtcggacctggccggggggcgcatgtcccggcagcgcaagcgggacgcggtgttgtggcttctgcgtggtgaggacctggagagcgtctcgcgcggcctgggcgtgacggcggcgaccttgtcgggccggcgcgatgcattcctggcggcgggcgaggccagcctgtccacccggcccctcgatgcggaggcgctggagagcgggcgtctcaaggccaagctcggcgagatgctgctggagcgcgaggtgctggagaccaaggtcgccgccctggaggcgcgtggccccggccctttttggcccgcaggcggtcgcagccatgagccggaccgtctcgccggccagcggcagcgtctagggctggctcgggtgtgccggatctggcgcgtgtcgcgcggtacgcctgcggtgaaggccgcggtcgttctcccgatggggtgtcaggcagcg

SEQ ID NO: 6025 - DNA, 237 bp, Methylobacterium sp.
atggatgtgatggcgcggttttcgggcgggattggtccggttcggtccagcggcatccgggccgcggcccttctcgtgctgccggtcttgctgctggcggacgcgcccgcgcgggcccagtacgccgccagctgcccgccgccgaagaagttcgcggccggcgcctgcgtcaccgcctgcccgggcggctacgaggaccgggggccggtctgcgtctaccgcaacacctcccggtag

SEQ ID NO: 6026 - DNA, 198 bp, Methylobacterium sp.
atggtcgagacgttcttcaagacgctgaagagcgagttggtctggcgcaccgcgttccagacgcgagccgaggccaccatcgcgctggcccgttacatcgatggcttctacaatccctgccgccgtcactcggcgctgggcttcaaaagccccacccagttcgagaagggtatcgcccaccaaaccgctctccactga

SEQ ID NO: 6027 - DNA, 429 bp, Methylobacterium sp.
gtgatccgatccgccgctctcctgacccgccacgccgcgggcctgccggaccgcctcgcccggggcctcgccgcgctggcgctgctcgtgctcgcgacggccgcactggtggccgcgcccgcgcgggccgaggccgcgcgcccggagggcccggcctgcgccatcgcgagcccgcgcctgacgatcctgtccggcacgccggacgcgcagcccgaggccaagcgttccgaggcgaagcgctcggtcttcggccgcaccgatctgtgcgccgccgacagcgagatcctcaccgagttggggctgccgcgcccgccggtcgacgcgccgcgcccccgtcacactgtcaacgcatcgttcgactacaggtccgacagcgtgccggcctccgcgccggacggttcgccgcaccggcctccacgccgggcctga

SEQ ID NO: 6028 - DNA, 1206 bp, Methylobacterium sp.
atgccgcggctcggcgtggctgccgccgcgtggatcgtgctgttcctcttcgccccggtggtcggcgagcagatcaagctgccgggcgtcgacaaggccatctggatcggcagcgacctgatcgccttcgcgttcctggtcatgcgccgcgacctcgccgccaccctgttcggcagccgtctgctgctgctcagctggccgctcctcgcgatcgcgtccgccctgtggtccctgacgcccggcctctcggcctatcacgggctccagctgctcgcgacgatcgtggccggcatcaccctgcggacgacgatgggcctgtcccgcctcgtcaggatcgtcttcctgggcctcctggcgggacagctcctgtcggcctttctcacggtggcggcgcccgccctgacgcgcgggacggacggcaactgggccgggatctactcgcacaagaacgtcctcggatccctgtcgagcctccagatcctctgcgcggcctgcctgttcctgcagggctggaaccgtctcctgaccgcgttcggattctgcctggccctggcgctcctcgtgtcgacgcactcggccaccgccctggtagcggccgccgcggggctgctgccgctcgccgcgatcttcgcgtggcgccagggcaagcacgtgacgggcttctgcctcggcatcgccatcgctttggcgggcgtcgggatcctcgtcgtcgccgcgcggggcgccgacatctcggcgagcgtgctgtcggatctcggcaaggacaccacgctgaccggccgcaccatcctctggcagttcggcctcgaccagttctggcgggagccgctcatcggcatcggctacaaggcctactgggagagcccgctcaccacggctgcctacctgcacttcgtcacgaagcagaagctgtggttcttccacaacaacttcatcgacacggccgtggcgttcgggatcgtcggcctggtcctcttcacggccgcgctgctcgacaccgcgcgccgggtgatcgcccatttcgcgcgctcctccggctacgtcgaggcgtggccgatcctgttcatgagccagctcttcgtcctggtctgtttcgagtgcccgctcttcgtcaatcacggtctccaccagctcctgctggcggcgatcctgccggtggtgcggtcgccgaccgtcgacgggagcgacccggccgcccgcgactga

SEQ ID NO: 6029 - DNA, 666 bp, Methylobacterium sp.
atgcccgagtcagccctcccgtcgcgccccctggcggcgctcctgttcgacatggacgggacgatcatcagctcgatcgcctccgcggagcggatctggtcgcgctgggccgaggcgcacggcctcgacgcggcctccttcctgccgacgatccacggcgtgcaatcggtcgagaccatccggcggctgaacctgccgggcgtcgatcccgtggccgaggccgccgcgatcaccgaggccgagatggcggacgtcgacgacatcgtggcgatcccgggggcgcgggccttcctggaggcgctgccgcgccaccgctgggcgatcgtcacctcggcgccccggcggctggcggagcgccgcctcgcggcggccggcatgccggtccccgatctgctggtggccgccgaggacgtggcgcggggcaagccggcgccggactgcttcctgctggcggccgagcgcctcggcgtcgcggcgccggactgcctcgtgttcgaggacgccccggccggcatccgggcggccgaggccgcggatgcggccgtcgtggtcgtcaccgcgacccatcacgagccggtgaggaccggtcatccgacgatcgccgactacaccgggctgcgcgtcgcggcggcgccggaggggatccgggtgacacggaccgcctga

SEQ ID NO: 6030 - DNA, 480 bp, Methylobacterium sp.
gtggcgctcctgttcaacatcgatccagacagcgctgaggacagcgttccgttgtcggcgatcatcgacagcgttcacgttgatgatcgagagcgcgtcctggccgtgatccgccgcagcgcccaagaaggcgccacgtacctcaacgaataccgcgtcgtctcggccgatggccagacacgctgggtcctctcgcgggggcgcttcacaaaggaccatgctggccgcccggtgggcggcagcgggatccttgtcgacatcacggggatgaggatcagagagggcacgttcgatgatgttgagtccgggcagattgcggcgcccttggaacgagcagccgaccacgccatcagtgcgcagcaggcgatcgttgatctgcaagaccctgagctgaaggcctgtgcagacgcgctactgatggccctagggcgcaagcttgccgagcgagaagtcctggaacggcgcaaaggtatgcactga

SEQ ID NO: 6031 - DNA, 1290 bp, Methylobacterium sp.
gtggccgaaccgttcccgctcgcaccctcgctctgggccacgacggcggcgcccgcgccggacacgccgccgctggcccgatccggcctggccgaggtggtgatcgtcggcggcgggttctgcggcctgtccaccgccctgcatctcgccgagcgcggcatccgacccgtcgtgctcgaggcgcaggaggtcggctacggcggggccggtcgcaacggcggccaggtcatcccgggcctgaaatacgatcccgccgacctcgtcgcgcggttcggtcgggagcgcggcgagcggctcgcgcgcttcgcgggcgggaccgccgacgtcgtgttcgatctcatcgcccggcacgagatggacgtgccgcattcccgcgccggctggatccagggcgcccacaccgaggccgggctcgccgaggtcgccaagcgggcggcccagtgggcagatctcggtgcgcccacccgcgtcctcgacagggccgagaccgagcagctgctggggaccgaccgctatctcggcggctggctcgacggccgcggcggggcgatccagcccctgagctacgcccgcggcctcgcccgggccgcccagaaggccggcgccacgatccacggcggatcgccggtcaccggcctcgaacggaccggatcgggctggaccgtcaccacggcccagggcgagcgggtgacgaccggccgggtcgtgctgtgcaccaacggctacacgggcggcctgtggccgaacctcgcgcggacggtgatcgcggcgaactcgttccaggtcgccacagtgccgctgaccgacaacctgcggcgctcgatcctgcccgaaggccacgtctcctcggacacgcgcaagctcctgctttacttccgcctcgaccataccgggcgcctgctgatgggcggccgcggtccgttccgggagccgcgcgaccccgccgactgggcccatctcgagcggatcgtcggcaagctcttcccgcagctcgacgggatcgccttcgaccatcgctggtgcggccgcgtcgcgatcacccgggactacctgccccatctccacgagccggcgcccgggctcctcatcgatatcggctgccagggccgaggcgtcggcctccagtcggcgatgggccgggcgatggccgcctacatcgcgaccggagatgccggcaatctgccccttccgctgacgccgatcgagccgctgccgctccacgggctcaaccggctgtacgtttcggcgatcatcgcgtggtaccgcctgcgcgacggcggcatccgctga

SEQ ID NO: 6032 - DNA, 732 bp, Methylobacterium sp.
atgatcgtgctggaggacgtccgcaagcattacggcgcgctggaggtgatcaagggcgtctcggccgaggtcaccaagggcgaggtcgtctgcatcatcgggccctcgggatccggcaagtcgaccctcctgcgctgcatcaacgggctcgaggcctacgacggcggcgagatccgcgtcgacgggcagcgggtcgaccgggacaagcgcggcatcaaggcgatccgcacccgggtctcgatggtcttccagcgcttcaacctgttcgccaaccggacggcgctcgagaacgtcgtcgaggggccgatccacgtgaagggtgagccccggggcgaggccgaggagcgggcgcgcgcgctgctcgcccgggtcgggctctcgggcaaggagcacgcccggccgaacgagctctccggcgggcagcagcagcgcgtggcgatcgcccgggcgctcgccatgcggccggaggcgattctgttcgacgaaccgacatcggccctcgatcccgagctcgtcggcgacgtgctgaaggttatgcgtgccctggccgacgagggtatgacgatgctcgtggtcacccacgagatcggcttcgcccgcgaggtcgccgaccgggtcctgttcctcgacggcggccgactcgtcgagcaggggccggccgccgaggtcctcaaccggccgcagaatccgcgtacccgggacttcctgcagcgcgtgctgcacccgctttag

SEQ ID NO: 6033 - DNA, 693 bp, Methylobacterium sp.
gtggggtctgccgccgtcggccgaccggtcctgaccttcatgcgcgagttcctcgccgacgcccaggactacctgccgatcctgctgcagggcgtgcagctcacgatcctgatcacgatcgcgtccctggtggtctcgacgctgctcgggctggtctgggcggtgatgcgggtctccggcatcgcgatcctgtcgggcttcagcgcggtgatgatcaacatcctgcgcggcatcccgatcatcgtgcagctgttctacatctacttcgtgatgcccgatttcggcctgtcgctcaccgcggtccaggcggcgatcatcgggctcggcatcgcctactcggcctatcaggccgagaacttccgcgccggcatcgaggcggtggatcgcgggcaggtcgaggcggcgctgtcgatcggcatgggctggggcatgactatgcggcgggtgatcctgccgcaggcgatccggatcgcgctgccgccctacggcaacatcatgatcatgatgctcaaggactcgtcgcaggcctcgaccatcacggtcgccgagctggcgctccaggggaagctgatcgcctcgtcgaccttcaagaacaccagcgtctacacgctggtggcgctgatgtacctcgcgctgagcctgccgctgatcctgctggtccgccacttcgaggcgaagggacggcatcgatga

SEQ ID NO: 6034 - DNA, 762 bp, Methylobacterium sp.
ttggccaagctgtgtctgtcgtcggcgctgctcctcggcgtcctcggcgcccccgtcggcgcgcagtccctgaaagtgggatcgacgcccaccggcctgcccttcacgttcctcgataccaagacgaacagcattcaaggcgtgatggtcgacctcgtcaacgcggtcagcaaggaggcgggtttcacggtcgcggtcgagccgctgcaattctcgacgctgatcccggcgctcaccgcctcgaagatcgacatcatcgcggcggcgatgttcatcacgccgcagcgcaaggaggtcgtgtcgttctcggcgccggtctacagctacggcgaggggctgatcgtcccgaagaccgacacgaaggactacacgtccttcgccgacctgaagggcgagacggtgggcgcccaggtcggcaccgccttcgtcgagcccctgaagaagtcgggcctcttcaacgaggtgaagatctacgacgcgatccccgacatcatccgggacgtcaattccgggcggctgaaggccggcttcgccgacgcgccgatcctcgcctactacgtcaagcagggcctgtttcccggcgtccgcctcgtcgagaccttcaagccgaccgtcgtcgcctcggtcggcctcagcgtccgcaagaccgacaccgagctcctggccaagatcgacaaggcgctcgccaagctgaaggccgacgggacgctccaggcgatcctgacgaagtggggtctgccgccgtcggccgaccggtcctga

SEQ ID NO: 6035 - DNA, 504 bp, Methylobacterium sp.
atgcgggcaggatcgacgcaggcaggaccgatcggcgggcccgggaagcgttcgcggcgcgacggcgccgcgatctgggtcgtcctcgccctcacctacctagtcttcgccggctcggtgagcctgaacgaggggatggccgccgtcggctgcgccagtctcggtacgctctggtggtggggcgttggacggcgcggcgggctgcgcttccgcttcgaccgtgaggcgctccgcccgctcggccccgccatccgcgacatgccgcgccagaccgcccgcgtcgggctgcacctcctgcgcgcgatcctcggtcgcgcctgcggcggcgcgacccgcgagcggagcgccgcagagatcgcctgggccaggccggagggtgacgcggcgccggcggcgcgggcggtcggactgctggccgcgtcgctcgctcccgacagctacgtgctcaccctcgaccgcgcgcacggaacggtggtgacgcacggcctggaggaggcgcgatga

SEQ ID NO: 6036 - DNA, 1602 bp, Methylobacterium sp.
atgatgaccagaatcaaggcgctgttactgggctcctcggccctgatgatcccgatcggcggtgcgcacgccgccgatctcccgacgttcaaggctgcgccggtcgagttcgtacgcgtttgcaacgcctacggcgccggatttttctacatccccgggaccgatacctgcattcgtctgtccggacgagcgcggtatgacttcctgtatcagaccagcaaggttcgcacgggcggcggcggcgacctcaccggctatctcggcctgatgcgtctgaacctcgattcgcggacccagaccgattacggaaccctgcgcgccttcctgcgcatcgatgtcgccaaccgcagcggcccgttcctgacctcgggatcccggcagcgcgagagcttggccatcgcgggcctcggcgccgacgccttcggccgcacgcagacctacgtcaacgccgataaggccttcattcagttcgccgggctcaccgcgggccgcgcgtcctccttcttcgacttctacgcgcacgatttcgagctgatcggcggcacggccggttccgatacgttcagcacgaacctgctcgcctactcggcgatcctcgggaacggcatcacgctgaccgcctcgatggaagatccgacctaccggcgcttcccgatcttcggcaccggctcggcagtcggcgccttcacggccggcggcggcttcgcgggctacagcaacgccttcaacccgttcaccccctcgacctggctggcgccgatcgtcgtcggtcccggcaacgtcgccttcgtcgacgtcacccagaagagccgcatgccggacttcgtcggcgcggcccgcatcgaccaggcctggggctcggcgcagctctcggccgccgtccacgagatcaatgccggcgacgccggcagcacggtcgcgggcatcaccaccgccacgaccggcctgggcatctcgccgacgggacgcgcctcgaacgcctacggctgggcggtccagggcggcctgaaggtcaacctgccgttcatcgcgacgggcgacacgctctacctccagggcgcctacgggcagggtgccatcgcctatacgggcatctccaactacacggcgccgtacgacgccctcggcgcggcgccggtcggcggcggctcgttcgcgcaatactacgcggacgcggtgctcaaccccgcgaccggccgcctcgaactgtcgacctcgttctccgctgtcgcctccctgctccattactggtcgcccgcctggcgctcggccttcttcggcagctacgcgcagatcgactacaactccaaggggcgcaacgcgctgggcgtcctgggcttcggcttcgccccggccggcgccagcacgtcgaatgccctggccttcgccacgagtcccatcctccggggcaacaaccagatgatcaccggcgccagcctgatctggacccccgtgaaagatctcgatatcggcgtcgagggcgagtacatccgcacggcgctcaacagcggcgtcacgccggacatctccaagaacgcgctgcgctacgtcaattcgcaggatgcggcccaatttcggttccgcgtgcagcgggatttctga

SEQ ID NO: 6037 - DNA, 294 bp, Methylobacterium sp.
atgaagaacatcatcctggcctgctcgatgggcgcgatgctgatcgcgggacctgctctcgctcaggacggtggcgccaccatcgaccccagcctcatcgtccggaccaacggcagcggtctcgatgcgtggtccgcctccgagggcaacgacaaggcgggcggcatgtgggagggtgcgaccggctacagcgccgcgatccagcggcccagcgcggtcgagaccgtcccggccaatcgccagtggagccatctcaacagccgcgagcgtcgccgcggccagcccgcctactga

SEQ ID NO: 6038 - DNA, 1386 bp, Methylobacterium sp.
gtgcgccttcttgaggtccggcgcaccagcggcttccgggtcgcgtgcctgttcttcgcgaccttcgggaccgcctcgctcgcgctgtcgggctttctctacgtcgacacgcgcagctacggccgcaaggccgcgttcgagtgggtcgagtgggaatcgaagcacctcctgaacctgtcgccgcgcgcgctgcgcgagcggatcgacgcctccgaggatttcgccgagggcgggcggccgctcgtcctgttcgggcccgaccacgtgcgccgggccggcgcgccgatcgccttccccgacaaggcgcccatcgggaagccgttcatcctggcgcagccgctggatcaccgcagccgcacgctcttcagccagctcaccgagcttccgagcggcgagtacgtcctggtcagccggtcggcccaggatctccagtccctcgagaaggcgctggtcgagaccttcgtctggggcatggccgccaccatcgtgatcggcctgatcggtgccgtcgtgttcggcgccggctcgctgcggcagaacgatgcgatcaccaaggcggtcgagcgcatcatgcgcggcgacctgagcgagcgcctgccgacgcggggcgtgtcggccgatctcgcccacctcacgcgcgtcgtcaacgacatgctcgatcagctcgagcggctgatgctggagatcaagggcgtcaacgagaacatcgcccacgacctgcgcaccccgctgacccgggtggtcggcacgctggagcggtcgctgcgcaaggccgacagcgtcgtggcctttcgcgccttcaacgaggacgtcctggccgaggtcaagagcatcgtcgtccggttctcggctctgctgcgcatctccgagatggaggaccgcctgcgccgatcgggcttcacccaggtcgatctcggccggctgctcgaggatgcggtggagtactacgagcccctggcgatcgagcgcgacatccgactcctctgggaccggccggacggcctgtgcacgatcgagggcgaccgcagcctgatcttcgaggcggtgagcaacctgatcgacaacgccctgaagttcacgccgggcggcgggcgggtgacggtcgcgctgctccggaatccgacagggatccaggtcaccgatacgggctgcggcatccccgcggaggagctgagtgccgtgcgcgcccggtatcgccgcggcgcgctgaagaccgacaagagcgggttcgggatcggcctgagcctcgtcgattccatcgcgcggctgcacagcgccaccttcgacatcgcctccgacgggagcggctgccgcgtgaccctcagctggatccacagcgtctcgggtcactcgtcgatcgatctcctgccggccgcgtccctctga

SEQ ID NO: 6039 - DNA, 669 bp, Methylobacterium sp.
ttggtagtcgaggacgaccggcgggttgccgcggagatcggttcggccctcgcggaatacggatttcaggtcgacgaagcgccgagtggcagcatcggattacgcaaggccctggacggtaactttgacgtgatcgtgctcgaccgaatgctcccggagatcgacggcctgtcgctgctgaccgagctgcgcgccgcgaaggtctcgacgccggtcctgatcctcagcgccctgtcggccgtcaacgagcgcgtcgacgggctgcgagccggcggcgacgactacttggccaagccgttcgagttcatcgagctgaccgcccgcgtcgacgcgctggcgcggcgcaagatggcggccgaggcggtgaacgaactcgtggtgggcgacctgcgcctcgacctgatcgagcgcgtcctccactgcggggaccgcgagatcgagctcctgcccaaggagttcgcgatcatcgagttcctgatgcagaacgccggcacgctggtgagccggaagatgatcttcgaatccgtctggggctacagcttcaaccaccagtccagcgtcatcgacgtccacatcggcaagatccgcaagaagctcgatcccgacgggctgaacccgcggatccacacggtgcgcaacacgggcttcatcctccgtgcgccttcttga

SEQ ID NO: 6040 - DNA, 1386 bp, Methylobacterium sp.
atgacccgtttcaacgacgcccccgggagcggcgccgaggctgccgcgcgggcgcaccagcacgcggccgagatcgacccgctgcggcaggacggggccggcgaggccctggtccacgccgtgccgccaccgccgcgcaagcgcccgttcctcgtggcgttcctggcactcggcagcgccctcggcctcggcgcctggcaccattgggaaacctaccaggcctccctggagactcagaccgaggccgtgaacttcgtccccacggtccgcaccgggccggcgcaggtggatgacgggccgatgacgctgaccctgccgggccagaccgaggccttcgatcatgccgacatcttcgcccgcgccaccggctacatcgccgagcgccgcgtcgacatcgggtcgcgggtcaagaagggcgatctcctggtccggatcgccgcgccggacctcgaccagcaggccaggcaggccgaggcccagctcggccaattcaaggcgcagctcgcggtcgcgcaggcggatgtcgagcaggccaaggccagcgtgacgctggcgaacgtgaccgacgcccgcaccgcgacgctggccgggcaaggctgggcctcgaagcagaacgccgaccagacccgggcggggatgctgaccgccaccgcgaccctcgccgccgcgcaggcgaaggtgaaggtcgcggaagccaacatcaccgcccagcaggtgaccgtcgaccggctccgcacgctgaccaccttcgagaacgtcgtcgcgccgttcgacggcatcgtgaccgcccgcagggtcgatgtcggcgacctcgtccacggcgatgccggctccgggacgccgctcttcacggtcgacagcaccgatgtcctgcgcgtcgcggtgcaggtgccgcaatcggccgccgtgggcatccgggacggggtgaaggcgcgggtccaggtggcgcagatcccggaccgcatcttcgccggcacggtgtcgcgcagctcggtggctctccaatcctcggtgcggacgctggacacggaggtcgacgtcgccaatcccgacggtgtcctgcggccgggcctctacgtcgccgtcaccttcgcggtgccgcgcacgcatccgcgggtgaccgttccgtccgaggcgctcatcttcgacgcggacgggacgcgcgtggccgtggtcggggcggacgacaccgtccggctccggccgatcacgatcgcgcgcgatctcggcacgcgcctcgagctgcgcagcggcctcgacagcggcgagaccgtggtcctcaacccgcccgccggccttcaggacggcagccgcgtcgccccccggggctccgtcgcctcccaggtgccgacagccaagctctccgagcaggcgagcgcggagtga

SEQ ID NO: 6041 - DNA, 930 bp, Methylobacterium sp.
atggcattcgccaatggcagcgagcggcgcgtcgcatacgtcgccgagaccaacttcggcgtgatccccgccacccccgccttcaagctgctgcgcatcaccggcggcacgctgcggaccaacaaggggaccgtggtctccgatgagatccgggccgaccgcaacgtcgcagacgagctgatggtctcgcaggacgtgtccggctcgtacgacttcgagctgtccggagacaccttcgacgacatgctcgcggcggccctccgcggcgcctgggcgaccaacgtgctgaagaatggcgtgctccggccgtcgttcacgatcgaggagaccatcaacttcggcggcagcaactccttctcccgcttcgccggcgtcatggtcagcaagctcgcgctgaacctcagctcgcggcagaaggtgaccgggtcgttcgacctgatgggcgcgcaggagacgctcgactcggcgatcatcaccggcgcgacctatgcggccgcgagcacgacccagcccgcaaccgcctcggccaacgtcggcgccctgacggtcggtggcaccacgacccccttccgcgtgaagcagctccagctgtcggtcgacaacgagctgcgcgtgcgggaccaggtcggctcgctctactccaacgagttcggcgctggccggtccaacgtgaccggcacggtcgactgctacttcgagggtaacgaccagttccaggcggtgctggcccacggatccggcgcgatctccttcaccgtcggcgtcgaggccaacaagaagtacaccatgctgatcccgaaggcgcggttcctcgatggtgctcgcaacgccggcggcaacaccgacgacgtcatgatctcgctgccgttccgcggggtctacgacgcgaccaccggcgccagcctgcagatcacccgctccgtcgcctga

SEQ ID NO: 6042 - DNA, 1215 bp, Methylobacterium sp.
atggcgtcgatccggagttgcgtgctctcggtcgcgatcggcttcgccgcgctcgccgggccggcccttgccgagccgatccgcgtcaaggtcggcgtcctcaacgacatgtcgggcgtctacgccgataccggcggcaagggctccgtcgtcgccgcgcagatggcggtcgaggacttcgccaagaccgagccgggcgtgcaggtcgagatcgtctcggccgaccaccagaacaaacccgatatcggcgccgccgtcgcccgccagtggtacgaccgcgacggcgtcgacgcgatcctcgacgtgccgacctcctcggtggcgctggcggtgagccaggtcacccgcgagaagaacaaggtcttcatcgactcgggagccggcaccacggagctgaccggcaagcagtgctcgccgaacacgatccagtggacctacgacacctacgccctggcgcacggcacggccggcgccatgctcaagcgcggcggcgacacgtggtacttcctcaccgccgactacgcgttcggcctctcccttcagaacgaggcgaaggccgtgatcgacacgggcggcgggcgggtactgggcgccgcgcgggtcccgttccccgccacggacttctcctcgttcctgctgcaggcgcaggcctcgggcgcgaaggtggtgggtctggccaacgcgggcggcgacacggtcaacgcggtcaagcaggcgcacgagttcgggctgaccgacggcggccagaagctcgccgccctgttgatctacgccgtcgacgtccacgcgatcggcctgcagaccgcgcagggcctcgtgctgaccgagtcgttctactgggatctcaacccggagacgcgggccttctcggagcgcttctacccgcgcaacggcaacagcatgccgacgatgaaccacgcgggcgtctatgccgggctcctgcactacctgaaggccgtagcggcgacgaagtcgacggacccgcagaagaccatggcctggatgaaggccaacccgaccgacgacccgctgttcggcaagggtgtggtccgggcggacgggcgcaagatccacccgatgtacctgttcgaggtgaaggcgccgtccgagtcgaagggcccatgggacctctacaaggtgctggagacgatccccgccgagcaggccttccgccccctctccgagggcggctgcccgctcgtcgccaagccgtag

SEQ ID NO: 6043 - DNA, 621 bp, Methylobacterium sp.
gtgggcgtcggcgtgcgcacgaagcggcggggcggcagcagtgtggcgcgcgcgctcgctgtgtcggatgtcgggacttggacctggcacatcgccgacgatgttctgcggtgcgaccccgtcgccgcgaccatgctgggcttgccgagatcgaaaagcggcagcggcacgaccttcggaagcttcctggaccgcatccacccggaggatcagcgtcggatcgcgtcgaccctcgacgacctccgccgtcagggcggcctgtacatcgcgcagtaccggaccgtgccggagccgggcgaggtccggtggatcctcgcgcgcggccgcttcatcctcgacgcgcagggcggcgtcagcgaggcccacgggatcgtcatcgacgtgaccgagtgcggccgcgacggcttcctcgacgaatccgccttctgcgcgaccgacgtggcggccggcggcatcgaccgggtcgccgagatggccctggccctctacaacgccgccgaggacggcctgccccagccggggttcgagcgcctgaagccgctgctcgacgtgctgctgcacgagatcggccggcagctcgtgctggcgcccgcggtgccggatctcgacagggttcactga

SEQ ID NO: 6044 - DNA, 405 bp, Methylobacterium sp.
atgctgatcagcgagcaccacgtgcgcgagtgcgcctactacatctgggagaacgagggccggattcacgggcacgctgcggcccactggatccgcgccgagtccgagctgcgcgcgaacgcgatgctcgcggccgccgcgtccgagacggtcgaggccgccgcgaaggccgcgccggtgaagaccgccgccaagccggtcgccaagactaccgccaccaaggccgccaccaagaccgctgccgccaagcccgccgcgtcgaagaccgccgctgccaagcccgcggccgtgaaggccgccgcgaagccggcggccccgaaacccgcccgcgcctccaaggccgcggtgaccgccggcctcgccgccaaggcgaagcccgcccggaccccggcctcgatgcactga

SEQ ID NO: 6045 - DNA, 444 bp, Methylobacterium sp.
gtgaccaacctcgagcggttctaccggtcggtccacggccgcgatctccagccctgggagcgtcagctcgccgtgcggatcgcggccgccctcaacaccacgacggacgacgacttcgtcgtccacctgctgctggtgtacatgtccaccaacgccatcacgaacatgtacaacgagctggtggcggcgcggaacggtctcgccgaacacaaccgggacctcatcggggcgctgacggcggacctgcggcgcaacaggctgatcacctacgttctgctcggcgcggccgccctcggtatgctcgtcggcgccggcatcctcggcaccgtcctcaacctcgcgcaaggctccgcggccagcgcggcgcgcctcgccgcggcgctggaatcctgcgagtcgcgcggcccggccggcgcccagcgcggcctcgggatcggccgctga

SEQ ID NO: 6046 - DNA, 834 bp, Methylobacterium sp.
atgaccgacacgacgcagagcaaggttccggcctggtacagcccggacgagatccaggacatccagcgcgatcttctgggcgccgccgcgaaggttctcgtgctctgcctcggcggcaagggcggtgtcggcaagacgaccatcgccctccaggtggcggatctctgcgcggaggtcggtccggtgctggcgatcgacaccgacccggccaaccggcacttccacacggccctcatgcaggagaccacgcccggcagcgacaacttcgtcccgcgccgtcccggcatcaccgccatccggcagcgcctgcgcgccgaggacagcacgggccgcgtcgacccgaccctgtgccaggacctgatcgagcgcgtgaccgaggcggccgagcgcctcgtcgtggtcgacttcccggccggcgacaccgagacgacccggcggtgcaccgagatcatcgtggagagctgccgggaggccaatgtccgccttgccgtggtggtcgcggccggcgcggtggatcccacagccctggaggtcctgcgcgagctccggcccatgctgatcgagtgcgaccgggcgatcctggcgaagaacactgcccaggcggccaatttcgactatctcgaatcgtccgacctcgtgcgatccctgcggaagcagtcgaactttcgcgtcatcgagatcgagcggatcggcgagcggctgatcgaggccctgcgggtgcagaacacgacctggcaggccttggcgaacagtgcgccgatgcgcctgcgggtcgagggccgccgcctgcggcgcaacttccacacggcgtggcgggatgccctccggccgtga

SEQ ID NO: 6047 - DNA, 324 bp, Methylobacterium sp.
gtgaccgagagcctccccgccgccttcgccgcgacactcaccgggtccgagccgccgagcgtctgggacgccccgctcgccgcgctctggtggctcgcccgggacgcggccggcccggcctccgccgcctgggagcgggcgcaccgcctcgtccaggacgccgacgggtccgacgcggcctgggtccacgcccatctccaccggatcgagggcgacgacggcaatgcgcgctactggtacgcccgcgcgggccgcccggtcccggacggcacgctcgcggaggagcgggccgcgctcgtcctcgccctctggccgaggtcctga

SEQ ID NO: 6048 - DNA, 435 bp, Methylobacterium sp.
atgaccgcatcgagtgacgcgcgcgcacgcttcgcgcggctctgcgggggcctcgccctcgccgcgaccctgctctccccggcgcccgcttcggcggccgacccgtgcgagggcacgacccaggcggatctcaacgcctgcgcggctgccgattaccgggccgccgacacggcgctgaacaccgtctacgggcagctgatgaagaagatcggcccgaagacgaaggacgccctgcggggcgcccagaaggcctggctgtcgtaccgggacgcgacctgcttcctcgagaccatgggcctcgacgggggctcggcccacgcgatggagtacaacggctgcctgaaggggctgaccgacgcgcggatcaaggtgctgaagggttacctcgactgcaaggccgacgacgtgtcgtgcgtcggccgcctcggcgaatga

SEQ ID NO: 6049 - DNA, 696 bp, Methylobacterium sp.
atggccgaaccgatcgtcttcgtcggcgactcgatcacggagctctggggcttccaccgggccggcactttcgaggcctacgacctcatcccccgcggcggctccggccagacggcgcgctggatcaccatgcggttcgcccgcgacctcgcggagaccggcgcccggggcgtgcatctcctgtgcggcgtcaacgatatcggccgcaacgagggcgtcttcgtcccggtcgaggagatctgccggacgctcgccggcatgctcgacgaggcccgcgccatgggcgtgaaggcctggatcggctcgctcacgccggtggacggcatcccgtggaacccggaggtgcgggacgcccctgccatgatcgcggcggtcaacgcgtggctccgggaccacgcccacgagcacggcgcgacgttcatcgactatcacgcggtgctggcgacggagaccggcgggctccggccggactacggaacggacgggctccacctgagcccggccggatacgcggcgatcgagcctttgatgctccgggcgctcgggcgcatcccggatgccccacccgcgcctgcccagccggtgaagaatgcgcccgcgaaggcgaccagatccgtccgcacgcgcctcatcggcgtcgcggtggcggcggcattcttggccgccatcgccgccctggtcctcgagctccgctga

SEQ ID NO: 6050 - DNA, 1062 bp, Methylobacterium sp.
atgcgtattctccatctgctgaatcacacgcgccgactgaacggccatgtccacgcggccgtcgacctcgcgtgccaacaggcgcaggccggacaccgggtcgcgattgccagtcagggtggagatttcgatgctctgctccggtccaacggcgtcgagccgatcttcgcgagccacgcgcgcacgccggcccggatcctgacgtcgttcttcggatgtggcggcgtgctccggcgttggcgtcccgatgtcgtccacgcccacatgatgaccagcgccgtgctggcgtggccgacctgcaagctgatgcgcgttcccctcgtgacgaccgtccacaatgagttcgagaagggtgccctcctcatgggccttgggaccagggtcatcgctgtgagcggcgcggtcgccgcgtcgatgcggaagcgcggcatcgcggcttcccgcatcgacgtcgtgctcaacgggaccatcggctcagcccgcatgcgcggtcggtccgaggagccgcagaacctggatcatcccgccatcgtcttcgtcggaggcctgcatccccggaagggattgcccgatctgctgcaggccttcgacaaggcgttcccccacaatcgcgccatgcggctctacgtcgtcggcggcggtcctcaccgggacgcctacgagcagaccgcgcgcacgctggcctgcgcggatgccattaccttcgccggaccgcgggacgatccgtaccgctggatgctgggcgccgacatcttcgtgctcccgtcccacgccgatccggcaccgctcgtgctctccgaagcccgggaggcgggctgcgcgatcgtcggcaccgacgtcgacgggattcccgagctgctcgacgggggaagggcgggcgttctggtgccggcaaacgatccggacaagcttgcgcaagcgctgatcgcgctcacgagcgatccgggcgagctgagcgcttggagagcgaagagtcagatcaacctggatcacctgcggatcgcacgggtggccgacgagaccttgaccgtctatcggcgcgctgccggcctcgcggggtga

SEQ ID NO: 6051 - DNA, 1626 bp, Methylobacterium sp.
atgcagaccctgcgcggcgccgacatcgtggcccggaccctggaggcgctcggcgtcacccggatcttcaccctgtcgggcaaccacatcatgccggtcttcgacgccctgctggagaccgggatcagcctcgtccacacccgccaggaggcggcctgcgtccacatggccgacgcctggggccggctgaccggcgaggtcggcgtcgccctggtgaccggtgggcagggccacaccaacggcgcggcggcgcttaccacggcgctcgcggccgagtcgcccgtgctgctgctctccggccatgcgggcctgtcggagctcgggcgcggcgccttccaggaactggcccaggccgacatcgcccggccgatgaccaaggccgcctggaccgccgggtcggtcgccgccctcgggccggacctcgcccgggccttccggatcgcccgggaggggcggcccggcccggtccatctcagcctgccggtcgacctgctggagacggccgtccccgccgcctcggtgcggatcccggaccgggccgcggccgccatccgggccgccgagccggcgccggatctcgtggccgacctcctcgctgccctcgcgggggcggaacggccgctgatcgcctgcggcccggcactgtgcgacgcctccggccgggctgccatggcaacgcttgaggaaaccctcggcctgccggtcgtcggcatggagagcccgcgcggggtcaacgatccggcgctcggcgccttcgccgaggtcctggcgcggaccgacctcctcgtgctcctcggcaagccgctcgacttcaccctgcgcttcggcgcggcccctgccctcgcgcccgactgccgcttcgccctcgtcgatcccgatccggcgctgctggcccgcgcgccggccgaccgcctcgcggtctcggggctcgccgatccgcggccggtgctggcggcgctgaccgcgcgcgccaccgccctcccccgccgggaggcctggcaccgggaggcgcgggccgccctcgcctaccggccgcccgcctgggcggatttccacgggacgggtcagcgcctgcacccggtggagctgtgccgggcggtcgacgccttcctggaacgccgccccgacggcacgctgatctgcgacggcggcgagatcgggcaatggccgcaggccctggtccgcgccgggcgccggctgatcaacggcgtctcgggcacgatcggcgcgtcgatccccttcgcgatcgccgccgcactggagcggcccggcgccccggtggtcgcggtgctgggcgacggcaccttcggcttccacatggccgagttcgacaccgccgtgcgctatcggatcccgttcatcgcggtggtcggcaacgacgcgcgctggaacgccgagcaccagatccagctgcgcagctacggccccgagcggacgcgccactgcgacctgctcccgacccgctacgacacggtcgtccaggccctcggcggcttcggggcgctggtgaccgaggcggccgagcttccggcggcgctggaggcggcccaggccagcggcctgccggcctgcgtcaatgtgatgatcgagagcgtgccggcgccggtgatccgccgtcccggctga

SEQ ID NO: 6052 - DNA, 1164 bp, Methylobacterium sp.
atgaggacgacgcgccgcgttttcttgacgggggccgcatccgcagtcgcgggcggcctggcgccgggggtgatccgctcggcctgcgctcagggcgccgggtcgacggtccgcatcggcatggtgctcccggtgacggggcccggcgccgatgccggccgctacgcgctcgccggagccaggatcgccctggagacggtcaacaaggccggcggcgtgctcggcaagcccctggagatcgtcacggaggacgatcagaccaccaatcccggcgcggtcttcgccttctcgaaactggcgtcgcagggcgacctcgtcggcttcctcggctcgatccgctcgacgcagaaccacgcgatggcgcccgacatcctcaagacgggaaagcccgtctgtttcggcggcaccgacccggtcctgacgcagctcggcaatccctggctgttccgcttccgccccaacgacaacttctcggcccgggtgatcgccgagcacggcgtcaacgggctgggcaagaagaagtgggcgatcatccactccaccgacgccttcggcaccagcggcgccaaggcgctgaccgagagcctcgccaagggcggcgccacggtcgccctcgaccagggctacaccaaccagagccaggacttcacgccggtcgtgctggcgatccgtcagtcgggcgccgacgtgatcggctcgtacttcaccttcgagaacgacatcggcatcttcgcccggcagctgcgccagctcggcgtcaccgcgccctgggtcggctcgccctcgatcaccaacgtcaccgccctgaagctcgccgggccgtccctgtacggcacctacggcgtggccgactacgccgaggagtcgggcgacgccgcccgcgcctacggcaaggcctaccgggcggcgatgaagatcgcgcccgacaaccagtcctcctggaccttcgacgcggtcacggtgctcgccaaggcgatcaacgcggccggcaagaccgacccgcaggcggtccgcgaggcgatcctggcggtgcgcggccacgagggcgccgagggcacctacaacttcgacaagaacggcgacggcctgcacggctacaacgtcgtgcgcaacgacaagggcaacatcgtcttcgaccggcggatcgacttctaccaagggtga

SEQ ID NO: 6053 - DNA, 876 bp, Methylobacterium sp.
atggacctgatcctgcaactcctcttcaccgggatcggcatcggctccgtctacgccctggtggcgctcggcttcgtgctgatcttccgcgccaccaacgtggtgaacttcgcgcagggcgagttctcgatggtggcggccttcctgatggtggtcttcgccgtcgacctccagtggccctactggctctctctcctcctgaccctcggcgggatggcgctgctcggcgccctgttcaatctcggcgtctactacccgctgcggcaccgcagctacctgccggtgatcatctcgaccatcggcgcctcgatcttcctggcgaacacgacgctggccctctacgggccgcagccgcaggtgctcccgccggtcttcgagacgcaagggttcctgctcgggccggtcttcctcgacagccagtacctgctgatcatcgcggtgacggcggccctggtggcgttccagtactggttcttcgagcacactctggtcggcaagaagcttcaggcgacgtcccaggacaaggagatggccgcgctcctcggcatcccggtggccgggatgatcatgctgaccttcgtgtacagcgcggtgctcggcggcatcgccggcatcctggtggcgccggtgctgttcgtgtcgatccagatgggggccacgatcgccctcaaggccttcgcggcgacgatcatcggcggcttcggcgacgtcaccggggcgatcatcggcggcctcgcgctcggcatcatcgagaccttcggggcggcctacatctcggtcccctacaaggacgccttcgcgttcctggtgctggtggtgttcctggtcgtgcgcccgcagggcctgttcggcgagcgcgtggcggagaaggcatga

SEQ ID NO: 6054 - DNA, 762 bp, Methylobacterium sp.
atgatcgaatccagtctggaccggggaccgggtcggggcgcgcgcgccggcacgacccgcatcctcctcgtcgaggacgacgcgggtatgcagcgcatcgtctcggaccacttcgccgaccacgacgtcgccgtgaccgcggcgaccgaccgggcggaggcggagaagcggctcgcggaggccacgttcgacctcgtcgtgctggacctgcggctgggctcggagaacgggctcgacctgctgcgcgacctgcgggccaggagcgacctgccggtgatcatcaccaccggccatcgccgggacgagatcgaccgcgtgatcggcctcgaactcggcgccgacgattacctcgtgaagccctacgggctgcgcgagctgctcgcgcgggtcagagtcatcctgcgccgggccgaggtggcgcccgccccggcgcgggtccaggaatctcatcgcagccgcttcgaaggctgggtgctcgaccggcgccgccggcgcctcaccaaccccgacggtgcggatgtcgcgctcagcaagggcgagtacgccctgctggtggccttcctcgacgcgccccagcgcccgctcagccgcgagcagctcctgcaggccacgcgcgtccacgaggacgtgttcgaccgcagcatcgacgtccagatcctgcggctgcgccgcaagctggaggtggatccgagcgcgccgcgcctgatcgtcaccgagcgcggcgtcggctacgtcctcgccgcgaccgtcgagaagctctag

SEQ ID NO: 6055 - DNA, 609 bp, Methylobacterium sp.
atggtcaacaagcacgtcgcgatccggaccgaggacggcgtatgcgggacgcacgtcgtcgcgccggacggcgcggggccctggccggccgtgatcctgtacatggatgccggcggtatccgaccggccctcggcgacatggcgcggcggctcgcgaccggcggctatcgcgttctgttaccggatctcttctaccgctacgggccctatggccccttcgtccccgcggacgtattcaaaggcgatttccgcgcaatcctcggcccgctgatggcgacgaccgacaatctcaaggccgcggccgataccgcggcgctcctcgcctatctcgacacgcgcggcgacgtcgcggggcgcgcggtccgggcggtgggcttctgcatgggcggccgcatggccatcacggcggccggcacgtatccggaccggttcgcggccgtcgccagctaccacggcggcaatctcgcgaccgaggaacccgcgagcccgcatcgtgtggcgcccgcgctgagggccgaagtgtatatcgcggccgccgagaacgacggaagctacccgcccgcgatggccgagcggctggagacggcgctgtcgcgagcgagtgtctga

SEQ ID NO: 6056 - DNA, 336 bp, Methylobacterium sp.
atgctgaccaggaccgcgatctacgagggcacggtgcgcgacgggcgggaggaggagttcttccgccgggtccgggacgagctggagccgttctggcggcggttcccgggcgtcaccgccgtgcgggtccagcgcctcgtctccaaggacgacgacgcgcggccgatcgccatgatcctggagatggacttccccgaccaggcggccctggacgcctgtctcgcctcgccgatccgcccggaatcgcacgccgccaccgaggcggtgatgcagatgttcgacggccgattctaccatctggtcagcgccggacggaccttggcgctggtggattga

SEQ ID NO: 6057 - DNA, 1077 bp, Methylobacterium sp.
gtggccccttcagagcgccgcatcaacgggttcgacggcctgcgggccctggcgttcctgatggtcttcgtcagccacaaggcgccgagcccgagaaccgaggccctcggcacggccggcgtgtggctgttcttcgtcctgagcggcttcctgatcgtccggatcctcgccgcggcccgcacctccgtggaggcgggcgcgtcgacgccgctcggcagcctcgggctgttctaccggaatcgcgtcgcccggatcgtgccggtctactacgtcttcctgttcgtgctctacacggtccggcccggtgacccggccagtctcggcaacgacgcgttcaagctcgcgacgtggttctacgtcaccaacatctacatcgagctgaacggctggggcaccgagctcggccatctctggagcctcgccgtcgagcagcagttctacctgctgttcgcgccagcggccctgttcctgccgcggcgccacctcggcacgctgtgctggctcctggtcgggatcagcgtcctggcgcacggcgccctgtggcgggcgggcgccgcgccgcggtgcttcgacgtcgacaccctggccaatgtcggactgatcgcgctgggcgggctcgccggcctgcgcacccggccgctcccgggctggctcgcccgcgacgccgccctggccggcgtgctgatcctgttcgtggccctgccgctcctgatcgcgccgaccggctggtggctcgttctcggtcgcctcagcggcgtcctggcggcgctgctgctgctgcaggtggtccaggcgcgggagggccgcgcggtcgccctcctggagatcccgtggctgcgccggatcggcgtgatcagctacgccgcctacctgttccacgtgccgctccacgcggagcgggtgctggccctcgtcggcctcgacgtcgccggaccgcgctcggtctccatggcgctcgacctgatgctgacgctgctgctggcggaactgtcgtggcggctcctggagcggcccgcacgccggctgctgcgggccccgcgccgacgggtcggcgcctccgcgctggtcggccggtaa

SEQ ID NO: 6058 - DNA, 489 bp, Methylobacterium sp.
ttgttcgaccgcctggaagcgctgcggggaaagccggtcgagaacgtctttctcgccgtcgccaacgcgcctgcgctgtgtgacggggttctcgcgatggcgatgtcgctgcgccagagcactctgctcgaccggcaacttcgcgaactagccgtcctgacggtcgggcttgagacgcgggctgactacgaggtcgcgcatcactggaactcggcggtgaaggccgggctgtcccaagccaagctggagcagcttgcgcagttcgagacggatgaccggttcaccgcttccgaacgcgccgtcatgcgcttcgctcgcgacgtgacgcggaccggccgtgtcgatgacggcctctgggccgaattgtgcgggttcctggacgagcaggagcgactagaactggtcctgacgacggcttggtacaactgcgtcgttcgcatcctcctccccctcaatatcgaacttgaggactggttctcacgtctctga

SEQ ID NO: 6059 - DNA, 1236 bp, Methylobacterium sp.
gtgttccgctggtaccgagaggtcggtccggccgagcgtcgcaccttctgggcctgtctgggcgggtggtcgctcgacgccctggacgtgcagatgttcagcctcgccattcccgcgctggtcgcgagcttcggcctgagccgctcggaggccggcttgatcggcgcggtcacgctcgtcgcggcggcgatcggcggctggctcggcggcctcgcggcggaccggatcggccgcgtccgggccctccagatcacggtgctgtggttcgcggtcgcgaccttcctggcggccttcgcgcagagcttcgcccagttgctgaccctgaaggcgctgcaggggatcggcttcggcgccgagtgggcggccggcgccgtcctgatggcggaggcgatccggcccgagcaccgcggccgggcgctgggcgccgtccagggcggctgggcgatcggctggggcgcggccgtgctcctgtccacggcggccttctcggtgctggatcaggagacggcttggcgggccctgttcgcctgcggcctcgcgccggcgctcctcctgctctacctccgccgctccgtccccgagccggtccgacccgtggcagggccggcaccgtcacgggccggagggctcgcgatcttcgcgcccggcctgcgccggatcacggtgctcgcgacgctgctcggcctcggcgcccacgggggcttccacgccctgttcacgtggctgcccacctacctgagcgtcgagcgcggcgcctcggtcctcggcaccgggctctacctcgccatcatcatcgcggccttcggcctgggctgcctcgtcgccggcggcctcgtggaccggctcggccgccgccggaccgtggcgctctacgccgccggttgcatggccctggtcgtcctctacctgctgctgccggtcggcggcaccggcctgctcctcctcggggcgcccctcggcttctgcacggccggcatccccgcgagtctcgcggcgctgttcagcgaactcttcccggacgggctgcgcgggaccgggatgggcttctgctacaatgccggccgcctcgcctccggcctgctgcccctcggcgtcggcctgctcagcgagatctgcggcctcgggccggcgatcggcctggcggccctcggcgcctacgggctcgtcctcctcgccgtcgcgctcctgccggatcggcggtgcggcggcgcgctgatcccccagaccgtgagatga

SEQ ID NO: 6060 - DNA, 246 bp, Methylobacterium sp.
atgacgacgactgcaacgcgccccgccggcgcgaacgataccggcttgtctctcgcccaggacttgttgtcgggcgccgaggcaatcgccctcttcatgttcggagaggcgaccgaggccaacaagcgcaaggtctaccacgccgcgcagaagctcggcctgccgacgttccggattggtggcaccctgtgcgcccggcgctcgacgatcctcgcgtggatcgagcggcaggagaatgctgcgtga

SEQ ID NO: 6061 - DNA, 1059 bp, Methylobacterium sp.
gtgcgaatcccagccacgacccgcatcccgcgcctggccctgctcctgccggtgatcctgtcgacggcactgtcgtcggccctgccgcgtccggcccgggccgacgacagcgtcgcgaccctcgcgaccggcggtctcgtcctggagaagacggaccggatcgccctcgtctccgaggacctcttcctgtccgagaaggcggtgcgcatcgtctaccgcttccgcaacctgaccgaccgggacgtcgagacgacgatcgcgttcccgatgcccgacatctccgggggtcccgacgcgatgctgaacatcgccgacccgaagcacgacaacttcctccgcttcaccaccgaggtcgacggccggccggtcgactcgcaggtcgagcagcgcgccttcgacacgccggccggcaagccggagatcgaggtgaccgggcggctgcggagtctcggcatccccctcgtcccgacggtcgaggcgaccgagaccgcgctggctgccctgggcgcggatcagcgccgcggcctcgtggcggacggcctcctggagccccaggacatgggcaagggtacgacgagcctgttcccggtctggaccctgcggtcgaagttctggcgccgtcaggtcttcccggcgggccgcgacgtcgtcgtccggcagagctacgttccgggcgtcggcggcctctccagcctgtcgttcgggaccgcgaccgagggtgccgacgagaaggccgagtacgcgcggaaatactgcacggacgcggccttcctgaaagcggcgcaggggctcgcgcgcaggatcgaggcggcgggcgggcggggggtgcaggccttcgagcagtacctgtcctacgtgatcacctccggcggcaactgggccgggccgatcggcacgttcaagctgaccgtggacaagggcgatccgacgacgctcgtgtcgttctgcgccaccggactccgcaagaccggcccgacgaccttcgagagcgtcgtgacggattacgtgccccggcgcgacatcgacatcctgatgctcaagaccacgacgggccgatga

SEQ ID NO: 6062 - DNA, 942 bp, Methylobacterium sp.
gtgagcgccgtcagcctcagcgtcctgatcgtcacctacaatgccggccgggacatcgagacctgcctggacctgctggcggcgagccgggtgagacgctcctacgaggtgatcctcgtcgacaacgcctcgaccgacgggacgccggagcgcgtcgcgcgggcgttcccctgggtgcgggtcatcgccgagccgaccaatctcggcttcgcgggcggcaacgcgcgcgcgctggagcacgcgcgcggcaccgcgatcctgctcctcaaccccgacgcgttcctgcacgacccggacgcgctcgcgggcctcctggaccatctcgacgcgcatccggatgtcggggcggtcggcccgcgcctgaccttcccggacgggacccatcaggtcggcgacgccggctacgagccgcgcccgctctcgatcctggtgcacgccgccggcctgtcgggccgcctcgggctgcgcggcctctacctcgccggccgccaggccaggggcgcgcgggccctcgacgtcgactggatctgcggggcctgcctgctcctgcgccgctccgcgatcgccgcgatcggcggcctggagagcccgatgttcctctacggcgaggacgtggactggggctgccgcctgcgcgatgccggcctgcgcgtcgcctaccgcccggacatcgccgtcacccatctccagggcggctcgggaagcgcccgctcggcccgctggctcgacgggctggcggccatctacagcctgcgcaatgccgggcggctcctgtcgtcgcccgccttcttctccggcccgctccggctcggtttcaccctgcgggccgtggcctacggtgtcgcggcccggctgcgccggcagccggacctcgcccgcaaggccgaggacatgcgcaggttctccgggcacctgcgcagtcttcgtctccgaccgcgatga

SEQ ID NO: 6063 - DNA, 213 bp, Methylobacterium sp.
atgagggacgagccagaccagacgctctcggacgaggagctggaccgtctggcgcgcgagctgttcgccgaggtccgcggcgagtactcggaagcgaaagtggagcgggccctgaagaccgccggcgaggtcgccggggaagtgctccccgggataccggactggctgctcgacggtagcgacgacgccagcgctggcgacagtgggacctga

SEQ ID NO: 6064 - DNA, 792 bp, Methylobacterium sp.
atgccacccgccgagggaacccccatctggttcgagctgaacgcggccgacccggacgtcgcccaggccttctacgaggcggtcgctggctggcgcgtcgcgccgtcgccgatgcccgagcacggcggctaccggatcgcggaggccgacggggcgcccgtggccgggatccggcgaccgacgcccgaggcccccggcctccccggctgggcggtctacctcgcgacctcggacgtcgacgccctggcggcccgcgcggtcgatctcggcggcgcggtccggttcgggcccgtggacatcccccatgtcggccgcttcgccatggtgagcgacccgcagggcgtggtcttcgccgcgatgaatccggcccatcccggcgcgagccgggccttcgggccggtgccgctcgagacggagcggacgcgcggccacggcgtctggatcgagctcgccacccccgatcccgcggcggccatcgccttctacggggcgctgttcggctgggagaagctcggcgccatgccgatgggcgacttgggcgagtacgccttcatcgggcggggcgacctgcgccccggcgcggtgatgtcgagcgcggccaccggcgcgccggcccgctggaactggtacatccacgtcgccgacatcgacgccgcgctcgcgaccgtccgggcggcgggcggcacggtcctccaggggcccgacccgatccccggcggcagctacgcggccaacatcgccgatccggcgggccaccagctcggcctcgccggcccgcggcaagccacgtga

SEQ ID NO: 6065 - DNA, 144 bp, Methylobacterium sp.
atgagcaagccgaagcctccgaccaacgcgctcctgacaccggagaagcgcaccgaggacgtcgatcagacgatccgtcctctgagcctgtccgagttcatcggtcagcgcgcggcgcgggcgaacatgcaggtgttcatcgag

SEQ ID NO: 6066 - DNA, 171 bp, Methylobacterium sp.
gtggaggcgttccgcgccaaggtcgagcgtggcatctactcgcagcctgtcaggcagcagggatgtctgccgaaatggcatcgggagcggctgacgcacgacatcgccctccggcacgggctgcagcacgagctaccgcttatccggaaggactttgagcatctgatctga

SEQ ID NO: 6067 - DNA, 1182 bp, Methylobacterium sp.
gtcaaggacagcctgaacgtcgccgggttcgcgaccggctggggcagccggctctacgcgggggagggggccggggaggccgtcgaccgcgacgagacgccggtggcgcgcctgcgtgcggccggggcggtgatcctgggcaagaccaacgtcccggagctgaccgtccaaggctacaccggcaacccggtccacggggtcacccggaacccgtgggatccggcgctgacgccggggggctccagcggcggcgccgtcgcggcggtggcgtccgggatcgggcccctggcggtcgggaccgacgcgggcggctcgatccgccgccccgcctcgcataccggcctcgtcggcctcaagccgacggccggccgggtgtcgcggacgggcgggctgccgccgatcatgctcgacctcgaggtggtcgggccgatggcgcgcaccgtcgaggacctcgcggcggccatgcgggtcctcggggcggccgagccggattccgtcgcgccgcacggcttcggcccgttcgggagcgccgcggtgccggaacgcccgctgcggatcctgcacgtcccggccttcgggacggccccggtcgaccccgagatcgccgacagcgtcgccgaggcggccgggcgcctcgccggcctcggccaccgggtcgagaccggccgcttcgacgcggcgacggccatcacggcggcgtggccggtcctgggccaggcgggcatcgcgtggctgatgcgcgcgcatcagggcggactcgacgcgctcggccccgacatccgcgccctggcggaggccggggcggccctgtcggcggccgacctgttcgaggtgcagcggatggcactggcactgcgccgggacctcgccgccctgtttgccgaccacgacctgctgatgacccccgcggccgcggcgctgccatggccggcggaggacacccatccgccgtgcatcgccggggtaccggtgggcccccgcggctcggcgaccttcacgggcttcgtcaacgccgccggctgcccggggatctcgatcccctgccgcccctcgggcgccgggctgccgatcgggttccagctcgtggcgccctggggtggcgacgagaccctggtcgcgatggcggccgcctacgaggcggcccatccctggcggatggtctgggaggacgcggccccgtga

SEQ ID NO: 6068 - DNA, 1515 bp, Methylobacterium sp.
gtgatgctcgtgatcctcgacggctggggtctgcgggacgcggtggccgacaacgccgtccaccaggccaggacgccggtcttcgacggtctgatgcgggagcgcccccggtcgcggctgaccaccttcggcgccgatgtcggcctgcccaaggggcagatgggcaattccgaggtcggccacctcaacatcggcgcgggccgcgtcgtcctgcaggacctgccgcggatcgacgcggcggtcgccgacggctccctcgcccggaacccggccctggtccggttcatcgaggcgctgcgcgcgtcgggggggacctgccacctcgtcggcctgctgtcgcccggcggcgtccacgcgcaccaggaccacgccgtcgcgctggcgcgcgcgctgacgacggccggcatcccggtccggctccacggcttcaccgacgggcgcgacatgccgccccgctcggccgccacctgcatcgccgacgtcgcggccgccctcccgaagggcgcccgcatcgcgacgctgtgcgggcgctacttcggcatggaccgcgaccggcgctgggagcgggtccagacggcctacgacgccctcacggaggcgcgcgggacccggttcgagcgggccgggcaggcggtcgccgcgtcctacgcgcaggacgtgtccgacgagttcatgcggcccgcgatcatcggcgactatgccggcatgcaggacggcgacggcatcctgagcttcaacttccgcgccgaccgcacccggcagatcctggaggcgctgctcgacccggccttcgcgggcttcgagcgcgcgcgcacggtccgcttcgccgccgccctggggatcgtccagtacagcgtcgagatcgacgccttcgccgagaccctgttcggggccctcgacctgcccaacggcctcggcgagaccgtggcccgggccggacgcgcgcagctgcgcatggccgagaccgagaagtacccgcacgtcacctacttcatgaacggcggccgcgaggagcccttcgcggggcaggacgcgatcctcgtgccctcgccgaaggtcgcgacctacgacctgcagccggagatgtcggcgcccgaactcaccgaccgcgccgtggaggcgatcggctctgggcgctacgacctcatcatcctgaacttcgccaaccccgacatggtcggccacaccggcagcctcgcggccgccgtgaaggcggtggagaccgtcgacacctgcctcggccgcgtcgtcgaggcggtgacggcccagggcggggcgctgctggtgaccgccgaccacggaaattgcgagatgatgcgcgatcccgagaccggcgagccgcacaccgcccacaccctcaacccggtgcccgccgcgctcgtcggcgtcgacggcgtgaccctggccgacggacggctggccgacgtggcgccgacgctcctcgacctgatgggactggaccagccggccgagatgaccggcacgtcgctgatccgcccgcggggcgagggctga

SEQ ID NO: 6069 - DNA, 624 bp, Methylobacterium sp.
ttgaacagtctcttcgcgcaggcggaggcctcctcacccttgagcgccatcggcgatctctcggcggacgagcggacgcgcctcatgggcagccgaaccggctaccgggacttctacagccggctcaaggacatgcccctcgcggtctcgcgggagaccggccggctgctctacatgctcgcgcggacccgccgggcgcggacgatcgtcgagttcggcacgtccttcggtctctcgaccctgcacctcgccgcggccctgcgcgacaacggcggcggccggctgatcacctgcgagttcgagccgtccaaggtggtgcgggcgcgggcgaacctgatggaggccgggctcgcggacctcgtcgagttccgcgagggcgacgccctccagaccctcgacctcgacctgcccgactcggtcgacctgctgctcctcgacggggcgaaggggctctatccggaggttctgagcctcgtggagggccgcctcggaccgggggccctggtggtcgccgacaacgcggaccacagcccggactacctggcgcgggtgcgcgcgccgagccgcggctacctgtcggtgccgttcgccgacgacgtcgagctgtccgtgcggctcgggtga

SEQ ID NO: 6070 - DNA, 936 bp, Methylobacterium sp.
ttgcgccgccgcccggaattcgagcggctggtgaccttcgcggaggccgggtcgcagatcgcggtgcgccgcgcgcgcgcgtatcccgaccttcccgccgcggttcgaggcgtcacgaacctggtgccgtctgagacctacgtgccgggctccctctggtctgaagtcctcgaggcgcggctggcgcgggaaggctggtgcccggacgcggtcgccgcctgggccgggacgtggcttcaggccgtctcgcgccgcttcgcggcgggagcgccgctcgagatcgagacgatcctcccgggacgagccctcgacgccataccgaagaatctcgtctcgggcgccgacggcacgttcatcgacctggaatgggacctcggtgaccctctggacgccggccacctcgccgtgcggggcctcgtcaacgcgctgaccgacgcgcgagactggcattccggcgggccgtccaccctgaccgttctggacgccctgcgggccctgttgccgcggctcgggctggctctggacgatgcgcagcttgccgaccggctggccctggagagccgtttccagacgatcgtcagcgaccgggtgacggagcgcggcctggactgggcggcggcgacgcgcctgccggtcgacctggagacccggatcgacgcggatccgcgcgcggcgctcgcggaggcctccgcggagatcgcgcggctccatgaggagaacgcggccctgcgcgccgcgcgcgccgtcgacgccgccgcgcacgaggccgccgcgcgcgagagcgtccgccgcaccgaccgcgtgatcgcctacgcggccgagatgcaccgcgcgcgcgaccaccttcaggacaccctcgacgcccgccgcgcttcggccggcgacggaagccgcctgtcccttcgcctcctgcgtctcatgagaggaaccccgtga

SEQ ID NO: 6071 - DNA, 1014 bp, Methylobacterium sp.
atgacatctgccggtccgcaccgccgcgccgtcgcgctggccgccctggccgccctggttctcggagcgccgttccccggcaccgcccgcgcggccgaccgggaggtcaccttcgcccaccaggacatggtggtgccgttccgcgccctgatggcctccggggcgatcgagaaggcgaccggctacacgatccactggcgcaagttcggcggcggcggcgacgtgatccgcgccatggcctcgggcagcgtccagatcggcgaggcgggggcgagcccgatcgcggcggccgcctcgcaggggctcgacatccagctgttctggatcctcgacgagatcgccgacgccgagcagctcgtggcccgcgccggcagcggcgtgacgggcgtggccgacctgcgcggcaagacgatcgcggtgccgttcgtgtcgaccgcgcattaccagctgatcgccgccctggcggaggccgggctgacgcaggccgatgtccggatcctcaacatgcggccgcccgagatcgccgccgcctgggagcggggcgacatcgacgcgaccttcatctgggacccggtgctcgcccgggtgaagaagtccggcaccgtggtggtctcggccggcgacctcgcccgccggggcaaggccaccttcgacggcctcgtggtcgaccgggcctgggcggcgcggaaccgggacttcctggtgaccctcgtccggctgatcgccgcccaggacgcggcctacgccgccaggccctggggcgccgacgcgccggaggtggcggcggtggcccggatcagcggctcggcgcccgcggaggtgcccgcgagcctcgcggcctaccggttcccgaccctggaggcgcaggcctccccggcctggctcggcggcggcgccgccaaggccctgaccgagaccgccgccttcctgaaggcgcaggggcgcgtgcaggcgctggcgcccgactacgcccggttcgtcacgacggaggtcgtggacgcggcccggaaatag

SEQ ID NO: 6072 - DNA, 201 bp, Methylobacterium sp.
atggcctacgatcgtcctgcctggactggctccacgccctacgatgtcgaaaccacgggctcgttcggcgccccgctcggcggccgctacgatcgcgacccctggacctgcccgcagagctcggccgcggagggcaatgccaaccagcagaacttcccggtcaagcagtacggccagaccgccggcggcaaccgctgctga

SEQ ID NO: 6073 - DNA, 276 bp, Methylobacterium sp.
atgtcagctgaggccacgctctgggatctggtgaccgccgagcgtatcgccatcgaggatgtcggcgccgccgtcgacgcctacctggcagaaccgtcgacccaggatcacgccatcggtccggaccacgtgctcgatctcgcggcggccgtcgcggcccacccctccgcgcccgcgatcgtggtcgacaccgagtccgacgagccgtcgcgccgcatggcggtgcgggcggccctgctcatgagccgccccaccacccgatcaaacagcgactga

SEQ ID NO: 6074 - DNA, 1245 bp, Methylobacterium sp.
atgagcctgcacctggacgatcccgtcaccgacccggtcgaagatcggctgccgccgccgccgtcgccgccgcaccggatccgctcggacgccgaggcgatcgcggccgcgcgggccgtggcccggatcttcgcggcgggcgccgccgagcgcgaccgcgaccggcgcctgccctgggcggagatcgcggccttcacggagagcgggctcggcggcatcacggtgccgcgcgaacacggcggcgccggggtctcgcacgcgacgctcgcggaggtcttcgcgatcctggccgccgccgacggctcggcggcgcagatcccccagaaccagttcggcgtcctggcgctggtcgcggccgccgccagccccgcccagcaggcgcggatctaccgcgacgtgctcgccggccaccggatcggcaatgccggccccgcccgcaacggcaaggcgatcaccggcgtggacacgcggctgaccgccggtccggagggcccgcggctcagcggcacgcgcttctactccacgggcgcgctcttcgcccactggatcccgacgcgcgcggtcggccccgacggcgggccgctcctggtcttcgtgcgccgggacgcccccggcgtgcgggtggtggacgactggcagggcttcggccagcgcaccacggcgagcggcagcgtgatcttcgcgcaggccccggtcgaggcggagctgacgatcgacctcgcgcccctggccgggcgcccgggcctgttcgggccggtctcgcagctgatccacgcggcgatcgacgccgggctcgcccggggcgcggtcgccgccgccctcgacttcctgcgcacccggacccggccctatcccttcaccgccgagaccgtcgcggaggatccccacatcctcggcgaggtcgggcggctcaccgtcgacctgcacgccgccgaggaggtcctggcccgggccggacgggcgctcgaccggatcgccgcggcccccgtcaccgcccagagcgcggccgaggcctcggtggcggtggcgcaggccaagatcctcaccaccgaggcggccctggaggcctccgagcggctgctcgagctcgccggcgccgcggcgacccgcgacgggtacaatctcggccggtactggcgcgacgcccgggtccacaccctgcacgaccccgtgcggtggaagtatcacctcctcgggaaccacgccctgaacggcgtgctgcccgcccggcaccagtggaactga

SEQ ID NO: 6075 - DNA, 963 bp, Methylobacterium sp.
gtgccgctgcgacggcgtccgacggccgcgcggcggccgagcgagaagcggatcgcaccgaccgtctcgactcccgaccacggcctttccgaactcgcccagatcgaggtcaatctcgaagccgacaccagcaccctgtgggctttcatgcgcccgcagggccgcccgtgccagaatcccgagatgctggccgatttcagccggctgcaggatggcatcgagcgcggcttcggcaacggcggcctcgacctgaactactttgtcttcggttcacgatttcccggcgtgttcagtctcggcggtgatctgagcctgttcgcgagcaggatccgcgcgggcgacgaggccgcgctggtcggttacggcaacgcgtgcgtcgatgtccttcatcgcaacatgaacgcgctgaacctgccgatcatcacgatcggcctcgttcagggcgacgcgctgggcggggggttcgagggcctgctctcgttcgacgtgatcgtcgccgagaagggcaccaagttcggcttcccggagatcctcttcgggctcttccccggtatgggggcctacagcttcctcgcccggcgtctggggaccatcagggctcaggagatgatcctcgatggaagaacctacaccgcggaggagatgcacgaactggggatcgttcacgtcctcgccgagcgcggccagggcgaggcggccgtgcgcgcctacatcgccggcaaccaccggcgccgcaacgggcagcaggcgatctatcgagccgcccgggaggtcaatcgcatatcgttggaggaactgagaaagatcgtctcggtctgggcggccgccgcgatgaatctcacggacagggatctgtgcatcatggagcggctcgtcctggctcaggacaggctcaggggaaaagcccaggccgctcaggcccgcacggtgaccgcgcgggggctggcggcgtcaactcgctag

SEQ ID NO: 6076 - DNA, 87 bp, Methylobacterium sp.
atgcctcagatgttcgactggatcttcttcgcgatcatgctgccgttcccggcctatctggtctgggacttcatgcggcatcgatag

SEQ ID NO: 6077 - DNA, 927 bp, Methylobacterium sp.
atgccggggcctgagcgcgacatcgtcatcggggcggacggcttcctcgggcgcaacctcgtccagcggctccgggccgagggccgcgaggtcgtcgagatcggtcgggcggcgggcgacctctccgagtgggcgaacgtcgagcgggcgctgcgcgcggcgcccccgagcagccggatcttccacgtggtgacccgccagcgcaccggcgcggtgcagtatgacatccagggcgagctcctggcgatcaacgcccgggtccacctgaacgtcctcgaggcgtggcgcctgttccagccgcaggccaagctcgtctccacgggctcgtcctgcacctatccggaatcggcggagccgctccccgaggcgcggttcgggcagggagccacgcatccctcggtgatcggctacgggctcgccaagcaggtcctggcgacgggctcggcggcctacgcgcaccagtacggcctgtgtttcctgcactgcgtactggcgaccctgtacggaccgcacgacaacaaggcctccgaccgcagccacttcgtcggcgccctgctcgaccgggccgtgcgggagaaggcggcgggcgctgcgcagttcgaggtctggggcaacccgcagaccgtccgcgaggtgctgtacgtcgacgaccagatcgacgcgatcctggcggccgaccgggcgttcgacaacgagatcctcaactgcgccgccaacacgcccgtcaccgtcgaggcggtggcgcgggcggccctggtggccctcgactggtccgtccccctggtcagcccgcccggctcgttccaaggcgcggcctacaagatgctcgactcgtcgcggttcctcgaccggagcggctggcggccgcgcatcgctctcgaggcgggcctgcgcaggcttgtcgcggcggagtacgccgaccgttag

SEQ ID NO: 6078 - DNA, 978 bp, Methylobacterium sp.
gtggccgccctccccctaacctccctgcccgacaccgtcgtcgtcgtcggtgcgaccgggttcgtgggccggaacctcgtcgcgcatctcgccgaccgcgtgccgcggctgatcgcggtcagcccctccggccgcgcggtgccgggggcgcatgaggccgcgcgcttcgatgccctggaggcgctgtcggttcccgccgacgccatcgtcgtcaacgtcgccgcgcagcgctacgacgccgacaaattcgagactgcgcagagcgacctgctgaccggcaatgccgagatcgccaaccgcctctaccggttctgcctgacgaagggcatccgcgaggtgcgtgcggcctcgagcgtcgcggtctacccggcggccctcgatcccctcgacgacgcgcaggctgtcgacctcaacgcgccgcccaaccggaacgaggccttctacgcgtggtcgaagcgctggtcggaggtgatcgccgacctccacgccgagcgctacgggatccacacaatcagcttccgcctgagcaacccctacggtccccacgactcgacggatccgcgcaaggcgcacgtcctgccggccttcgtgatgcgcgcgctcgcaccgggggagcgcttcgagatcaagggcaacccgctggtcgagcgcgacttcatctacgtcggcgacgtcgtcgacgtgttcgcccgctccctggagatgcgggagacgagcgatgcgctcaacctctgccgcggcgagaccacgaccctgctcgacctcgcccgcaccatcctggaggtcgccggggaggaccggccggtgcacgcccccgacacggcgacccacggcgtgctcgcgcgccgctcgaccaaccagcggctgcgcgagcgcttagggatgtcgaccttcacgggactcgcggacgggctgcggccgacgatcgcgtggtatcgcgaggcctatcgcgacggggcgcatcatgccggggcctga

SEQ ID NO: 6079 - DNA, 933 bp, Methylobacterium sp.
atgagaattctgatcaccggcggcgcgggctatatcgggacgatcctggtgccgatgcttctggagcgcggccatcacgtgacggtgctcgacacgttcaagtccggcgctccggacctgttctcggcctgccagtacgacacgttcgagccgatcaagggtgatgcgcgcgacacgcgcatcctggacgagctgatcccgaaacacgacgtgctcatccccctcgcggccctggtcggcgcgcccctgtgtaaggaggacgcgatcggcgccacgacgctcaaccgcgacgccgtgatcgccctggtcgagcgcgcgggcggcggccagaggatcgtctacccgacgaccaactcgggttacggcgtcggcgaggccggcaagttctgcaccgaggactcgcccctgcggccgatctcgctctacggcaccaccaaggtcgaggccgagaaggccgtgctcgaaagcggccgcggcgtcaccctgcggctggcgacggtgttcggcatggcgccgcggatgcggctcgacctcctcgtcaacgacttcacgcaccgggccgtgaccgaccgggcgctcctggtgttcgagggccacttcaagcgcaactacatccacatccgcgacgtcgccaaaggcttcatccatgcgatggacaattacgaccggatgcgcggcgaggcgtacaatctcggcctgtcgagcgccaacctgtcgaagctggaactctgcgaacgcatcaaggtgcacgttccgaacttcgtctacgtcgaggccccgatcggagaggatccggacaagcgcgactacatcgtgtccaacgagaagctggaggcgaccggctggttccccgatttcgatctcgaccggggcatcaaggagctgatcaagggcttccggatgatccgcaactcgcggttcgccaacgtctga

SEQ ID NO: 6080 - DNA, 1752 bp, Methylobacterium sp.
gcctacgcggtcctggccgccgccctggtgacgctggccgcgacgacgccgctcagcggctacgccctcaacatcctgatgcaggcggcgacctacgccatcgcggtgatcggcctcaccgtggtgctcggcctgtgcgggcagatcaacctcgcccaggccgccttcttcgggatcggtgcctacgcggtcgggctcggcacggtcgacgggggcctgaacttctggatctgcctgatcaccggcctcggtctcgcggtcgtgctgggcgccgcgctcggcgcctccacgctgcggctcggcggccactacctcgccatggtgacgatctcgttccagcagatcctgacgctggtcctcaccaactggatccccgtcacgcacgggccggacggcgtgccgaacatccgccgcccggccctcttcgcggacgggcagagctacctcgccctgtgcgtgctggtgctggccgtcgtcggctggctcgtctggcacatgccgcggacgcggctcgggcgcgccatgcgggcggtgcgcgacaatgagctcgcggcgggggtctcgggcatcgacatctaccgcaccaaggtcgcggccttcgccctcggggcgctgctggcggggctcggcggcgggctgttcgccggcagcttcacctatatcagcccggaccagttcgccttcgccgagtcgatcgtgttcctgacgatggcgctgctcggcggcgtcggctcgccggtgggcgccgtgatcggcacggccctgctgatcctgatcccggaatggctccgcttcctcaaggagattcccgggctctacctcgcgatctacgggctcgcggtgatcctgatcgtggtgttcatgcccgacgggatctggggcttcctcggcgaccaggtccggcgcctgcgccgggcccgcccggtcccgccgcccgccgccgagctgaccctgagccagggcgagccctccgcggcgccgatgctggaggtgtcggacctgtccaagcacttcggcggcctcaaggccgtggacgcggtgagcttcacggtggcgcggggcggcatccacgcgctgatcggcccgaacggttccggcaagaccacgacgctgaacgtcctgtccggcctctacagccccacgggcggcaccgtgcggctggccgggcaggacgtcacgcgcctgtccccgcaccggcgggcggcggccgggatcgggcgcaccttccagaacatccgcctgttccgctccatgagcgccctcgagaacgtggtcatcggcgccgagcgccccaacaacccctcgggcgcccgcgaccgggcgagcctggaggcccgcgcccgggcggcgctggccttcgtggggctggaggatcgggcgctggagccgatctccggcttctcgtacggccaccagcgcctgatcgagatcgcgcgggcgctggccggcaaccccgcgctgctgctcctcgacgagcccgccgcggggctcaattcgagcgagaagaacgccctcacggtgctcctgcgccggatggccgcaaagggcctgaccatcctgatcatcgaccacgacatgacgctggtgagcgacgtggccagccacgtcacggtgctgaacttcggccgccgcatcgccgacggcgtcacggcgaccgtgctgcgcgagccggcggtgatccaggcctatctcggcgaggacgccgcggccggtccggcggcgagcctcaagaccgacctcgccccggcctga

SEQ ID NO: 6081 - DNA, 756 bp, Methylobacterium sp.
atgacgacgcccgccacgccactcctcgagatccgcgacctcgtcgtccgctacggcgagatcgaggccgtgcgcggcctgtcgttctcggtcggcgccggggaggtggtgacgctgctggggtccaacggcgccggcaagtcgacgactctcaaggcgatctccgggctggtgcggcccgccgccggcacgatcctgctggaggggcggccgctggagggcctgaagcccgaggcgatcgtgcggctcggcgtggcccacgtcccggaggggcgccgggtcttcccggggctcacggtgcgcgagaacatcatgctgggcgcgtccaaccgctccggcctcggcaagcgggcgctgcgcgacgaggtcgaggcgatgttcgacctcttcccggacatccgccggttcggcgacgccctgggctggacgctgtcgggcggccagctccagatggtggccctcgcgcgcggcctgatggccaagccgcggatcctgctcctcgacgagccctcgctcggcctggccccggtgatcgtccaggcggtgttcgcgatcatcgccgaggtgcgccgccgcgggaccaccgtgctgctggtggagcagaatgcccggatggggctctcggtcgccgatcggggctacgtgctggagacgggccggctcgtcctgcagggcgcccccgacgccctctgggccaacgacgagatccggtcggcctatctcggcggacggacgaggcccgaactcgcgggctga

SEQ ID NO: 6082 - DNA, 396 bp, Methylobacterium sp.
gtggccgccgcgacggagcccttgacggagagcgccgacgcgttggtcttgggcacagacttcttcggcttcttggcttcgcgatttccgcgcttctgttccgctgccatgatctcgctcctggatacgatgacagccccgacgacgtcgtcctcaccgttcgggcgtcggctggtctggaagcaaccggatcgcggtcgcgaccggggtctcgaacaggccgaagacggcaacgaggcggtcgcttgcccagagttcggcatgatgccccgcgatcagacccgctgcctgccgcttggcgtcgccgtcgttgcgcgctgtgatgacgcaagtcgtgagcacaccaccggtcggggcgagccgatggacctgataggcgcggcgcgcgtgtcgtga

SEQ ID NO: 6083 - DNA, 939 bp, Methylobacterium sp.
gtggtcgacgtcttcacgcacgccggcacgggcggcaatccctgtcccgtcgtttccgacgcgcgggccctcgacgcggaggccatgcggggcgtcgcccggcgatacggccacgaatcgggcttcgcgctgccggccgatgacccggcccacgatctgcacctgcgcttcttcgtgccgaaccacgagatggagatgtgcgcccacgccacgatcggcgtcctgtgggtgctcgcccgcgaggggcgcctcccggacgggtcggtccgcatcgccaccggcagcagttccgtaactgggttcgtcagcccgcgcggcgcggatgcttggagcgtcgcgatcacgcagtcggtcggccgcgtgcggccgctgacggacgagcagagcgccgcagctcaagcggcgctcggaatcgggcgcgacgccctcgctgcgcggccggtccataacgctgtgacgtcgcggatcaagacgctcgtgccgatgcgcgatgcggcggcgctgaacgccctcgcgcccgacagcgatgccgtcgaggctgcctgcacgcggatcgggtcgaccgggctctacccctacgccgtgctcgacggcccggcccggctgttcgaggcgcggcagtttccccgcgcctccggctatcccgaggacgccgccacgggcatcgcggccgcagccctggccttcgggctgttgcaggacggcctcatcgagccggacgaccgtccgatccggatcctgcagggtcgggctatgggccgcctgtccgagattcgggtgcggctcggcttcgtggacggccgcccggtcgggtgcctgctggagggcgacgtcgcgctcgccgagtccgccgacagcgtgaccgcgacggatgagggcggccggatcgcgggggagtggctcaccgagccgtcacggcccggaggccggcgtcggtaa

SEQ ID NO: 6084 - DNA, 474 bp, Methylobacterium sp.
atgaccgacctcacggtccgcccggccggccggcccgacctccccgcgatcctcgacctctacgccgagctgaacggcgggcgggtggcgaccctggagcaggccggggcgctcctcgaccggctcgcgacctatcccgattacgggctctacgtggccgaacgcgacggcgcggtcgtcggcaccttctgcctcgtcatcctcgacaacatcgcccactggggcacgccctcggcgctcgtcgagagcgtcgtggtcgcgtcccggcaccgcggcggcggccacggccgggcgatgatgcacgaggcggcccggctcgccgaggcgcggggctgctacaagctcgccctgtcgtcgaacgtcgacgccaagccggcccacgccttctacgagagcctcggcttcgagcgctacggctacagcttccgcctcgatccccccttcctgcccgacgccgcggaggcgacccgatga

SEQ ID NO: 6085 - DNA, 312 bp, Methylobacterium sp.
ttgcaggccgaggtcgaggctgacccgaccttcgacccgccggcacttcgcacccgtcccgacctctggccgcacctcgccttcgtaagcaacgccttcagcgagctgtcctcggaccggccgctgggggcgttgggcggttgcggcccgatcccgtggagcgccatcgagcggtatgcggcgcgctacgagctcgacgacctcgaatccttcgagcggttcgcgcacctcatccgtgcgcaggaccgggcctatctcaccatcatggctgagaagcagaagagcgggagcggcggcaagggtaaaccgtag

SEQ ID NO: 6086 - DNA, 351 bp, Methylobacterium sp.
atgcatccgctgaaccggcgcgtcgtcgcggtcccggccgtcgcgcttctggtcgccgcgcccctgccgggtcgcgcgggcgagttcgcgcaggtcccgccggtgccgggcatggccctgaccctgcccgatcccggcatggccaacggggcgcccgctccgacggcggcaccgacccccgacccggccgcggagccgcccgctccggtcagagcggcctccgttccggcggtcgagcgccggttccggcgcctgggcagcgggctctcatcgatcgacggacagctcccgaaccagcgcaccggccagcgtcaccagcacgtggtccgcgacatctgcatcggctgctga

SEQ ID NO: 6087 - DNA, 375 bp, Methylobacterium sp.
atgactcgcgccctgctgttcgccgccctcctgggaacggcggtcgtgccgggcaccgcccgggctgccgaggaggcagacgacaccaagcgcgcggagacgatccggggtctcgtgcggatcgtcggcgcgcaggccggcatcgtcctgcactgccgcaagctctacaccatcgacgacacggtgtccgagggcctgtcccgcacggtccgccgagccctcgacgccggcctcggccaccagcgtgcccggaacgccatcgccgaggagggccggcgggtcgcggacgagatcgccgcggtcggaccggagcaatggtgcgccgaccagcgcgacctgctcaacacggacggcgtccgcgtcttcatcgactga

SEQ ID NO: 6088 - DNA, 207 bp, Methylobacterium sp.
atgctgatgctcgtcctcctcatcgccctgctggccgtcgtggtcgccatgttcgtcctgcggcggtggaccgggcggctggcctcgctcgcgacgctcctggccggagcgatcatggtcctgtggctcgccgaggtcggcctgcttcccgggacgcagggcccgttgacggcgtaccgccccctcgtgcccgggctcgaccggtaa

SEQ ID NO: 6089 - DNA, 255 bp, Methylobacterium sp.
atgttggacgatgcgtttacctacggcggttgggtcctcggcctgatcgccgtcggcgtgtggatctggctcgcgcggcgcgccttcccgagtttcgaatccttcgtgaagggcttcgacgacgagctccagctcggcgccagcccggaggagcgcgcgcgcagcgcgcgctggcgtcaggtccgtcaggccgccatggccctgacggccgtcgcggccctgtgtctgtcgatcggcttcgcgattcccgactga

SEQ ID NO: 6090 - DNA, 270 bp, Methylobacterium sp.
atgatgatgcacgtgaagatgatcgcggccgccgcggctgtcgtcggcggcctcggcctggcctccgccggcgcggcgcccctggcgcccgccggcgccgacacgctcaccggccccgccgcggtcagcaccgtcgcgttcggctgcggccccggctgggcgcccggcccgtacgggcgctgccggccgatctaccggcggccgcgcttctacggcccgcgctgcttcttccgtccgaccccgtggggaccgcggcgcgtctgccgctaa

SEQ ID NO: 6091 - DNA, 237 bp, Methylobacterium sp.
atgctcgcgctggatgctggaacggctcaccggagccgcgcttacagggccttccggctcgaccgggccggccgcgtccgcgcggccgagatcctgtcggccgaggacgacacgcaggcgcgccgccgcgcccgggcgatggtcgggcgcgacgcgatcgagctgtgggagcggacgcgcttcctcgggcgcttcgagcccaccgtggcggcggctcaggatcgcgccggccgctga

SEQ ID NO: 6092 - DNA, 246 bp, Methylobacterium sp.
atggtagagttcgttcgcccgctgatgtgcccagtgatgcggaagctgatcgggatgatcgtccgcatgtcgcagcaccccggccttcaggagcagggacagttgattgatcagctcacggagctcgagaccgagggcatagccagggatgttccttggcggaccgtggaggcaatccgcgccacccggttgaggctgcgcgtcgagggtctgatgccccggacgccactcccgcgcggtcactga

SEQ ID NO: 6093 - DNA, 951 bp, Methylobacterium sp.
atggcgctgcgggagccccgcgcggacacggcggacgcctgtcccgggctcgcgggcggtgtcgggcgacgggcgcgggccattcccctccgccggcgcctcaccgtcgcggcggcggggcgcggccggctcctcgccgcggcgccgctgccgctgctcctggcgctcgcggccacgacgacgccggagcccgtcgcggtcgggctcggcgggctcgccctggcgtggctctcgctgcgggtgcagcgcctgcgcggggccgcgtgcgccgcgacgcggcagcggaacaacctcgcgcgcctgaccgcgccgacggtcgcccgatgggtcgccgagacggatcgcgccgcccggcgccccggctgggagcaggaggcgacggtgctcttcgccgacatccgcggcttcacccgcctctgcgagggcatggcgcccggcgaggtcgcggcgttcctcgccccgttccggtcccgcgccgcgcgggcgatcgaggcggcgggcgggctcgtcgacaagttcgtcggcgacgaggtgatggcggtgttcggcgtgccggacgcggcgcccggggatgccggtcgcaccgtcgcggcggcccgcgcgctcgcggccgcgatggcggcctggagcggggaacgcgggcaggccggcctgccaccggtgcgggtcggcgtcgggctgcatcgcggcccggtcttcatcggcgtcatcggggcggagcgcgtcgagttcacggcggtcggcgacaccgtcaacgtggcccgtcgcctggaacagatgacccacgcgctgccctgcgactgcctcgcctcggaggcggtggtgcgggccgcgccgtccggcggggcgcggatcgtcgccgtcgggcccgtgcgcggcgcccgcaccgtcctgcgcctgttcaccctccggctcgacccggcggcgccgtctcgggacgggtccgagtga

SEQ ID NO: 6094 - DNA, 240 bp, Methylobacterium sp.
gtgaaccaccagcgccgtctcctcaacaaggcagcagaggcacgggattaccagatcacgatccgtcagagggcggacgcgtcctggcccggcgaccacagccggctgacggcgctcgagagcaccggtcatctccggcggatcgacgtgctcgagggtccgggtggtccggtggcggtctggcagatcaccgcggccggcctctcccagctccgggctctcacgtcgggagccgagtga

SEQ ID NO: 6095 - DNA, 1098 bp, Methylobacterium sp.
atgaatctgctgaagcggttgttcggacgcgccgatgcggcacgggcggcggaggcggcgccggacgaaccgcttctcgtcaacgcctacgcgaccgtgcgcgacctgcccgcgctccccttcgaccacgcgctgaacggccggcgggacctgtccgaccccgaattgcagccccatctcgacgggttcatcggctacgtcatgggacggggcgacgggcagatgaccgccctccgctaccatctctggcgccacctgcagcgcgtccgcaaccacgtcagcttcgcggtcgccgcgtccgacctgccgcgcgtggaggcctgggcgctcgcggcgaacgccgtcctcttcctgcccgacggctccgtgcgcgcgcccgacatggcgctcctcctgtcggccgcgggcgagacggatccggccgcgcgtctgccctatccgcccgacgccgtcgcgcgccgcgcccggaccctggagcacctggaggatctggacccgaagccgccggccggcatgccccccgcgctcggcgaggcggaactcgcgctgcgaccgccggcggaggtgctccggcgggctttggccctgctctacgtcgcggcttgggggcaggccttcggcgccggaacgacgctgcgcgagccggggcagagggcgctgaatccgaccggcttcgcggccctgtcgccggccgagcgcgcccagatcgaggcggcggacccgaaggacgccgcggcggcgtcctggcgctacgaggccgcgaacaccctgctgtgggcgctcggcgtgcgcgcggcccggatcgccgaccgcgacgccacggtcgacgtcgacgcgctctggcgggcggtcgcgccgctcgcccgggacgcgggcgcggccgacgccgcgcggctgcggccgcccggcgagatcctggaggcgctggaccgcgcgtggcgggcgcactgggtcgtccggcaggcgcggcagaaggggacgaccctggcggggctcaacggcgacgtcgtggcggagcgccacgtcgcgctgaactggctgaccggcttccagaacgaccgcgacacgccgtgggacgcgaccgacacgccgacgtga

SEQ ID NO: 6096 - DNA, 348 bp, Methylobacterium sp.
atgcagtcgtcgcggtgggccggcgccttcctggctgccggcctgatcgtcgcgttcgccccgccggcgcgggccgacgccgccctggtcctgcgggagacccggctgcacacgccgccggactcgcacgagccgcagcgggcgatggtcaacctgcgcaacaccggcccggacctcgcgacgaacgtgaccgtcctgtgcaccttcacgggggccggcgggacggtgctcgacacgcagcaggcctcggtgccggaggtcgtgagcctcgccgacgtgcaggccgagacgatctactacggctggccccgcgcgagcagcgccacctgccgcctcgccgagccgtag

SEQ ID NO: 6097 - DNA, 960 bp, Methylobacterium sp.
atgtccaagcccaaccctcgcaccgcagctgcgattaccctgcgcgacggcgccagcgcgattgcggacctcgaaacccaacaccgcatggccgagcgcgcgctctccggagcggaaggcgccctacaagaggcgtcggccaagtatgatgctgcgctcggcgaagggcgcgaggccgcactcgcggcccgtcaggtccgcaccacggccgaggtcgatctcgatattgctcgccgcaacgtcgacactctaggccgcaaactggcggatgcgcacgaggccctgcggctcgcggggatcgagcacaagcggaccgaggccgagcgtctgcgcagcgtcttcgaggagacggtgcgtcaggggctcgcgcgcatgggcgttgacgcgcgttccattcttcgcgcctgggcagaggcggagcttgccattcgggaagcgcgggctgcgcaggggcccaagggccccgctattcccgatgcggaggagtttcgcagcgtccgccgaggagctgataaagagatccggcgcacccggatcacgcgatggatccggcccgggacgcgggagccttacgccgacgagatcgagcgggagattatccgccacggcagcataggcttcctccccaacccgtgcatgtcaggcggcggccgcgaaatcgccgagcgcggcgttttcgaccgtgtcacttacgagaaggcggtcggcgcgatccatatgccgaagctgatcgaaagcttgtgtgttccagccctcgtcggcggccaggtgccgggctggatgccagtcgagggtcatgtcgatccgcgcacgatcctgactcggctggccgagcttgagcatcctgcagccgaacccaagggcgagctgcagaccgtcgataccttcgtgcatctcgtcggcgccgaggctgccgcggcctgggactgtcaggaattccgtgtgcgggcggcgggttga

SEQ ID NO: 6098 - DNA, 1680 bp, Methylobacterium sp.
atgagcagcacgctcccgatcaccggcccggacaagtccctcgataccgccctgcgacgcctcgtccgaccggtggcggagcgggcgcgctattacctgatcctgctcgcgcagatcggcgccctgctggtcctgctgaagatctcgcacggcgtcacggcgatcaacaactactacggcgtggtgctgccggtggcgctggccctcgcgatgacgcgggtgcgcttcgccgccgccgatctcgcgtcggtccggctgctgcagatgatcggcgtgatcgcgggcggctacgcgctgatccactacccgctcttccccgtcattctgcccggggcgaaggcgaccgtcgccgtcacggccatcgcggtgctgtgggtcgcggccgtggccggcggcgtgctctgcctgcgctggccctcgctcgccctgatcagcgccacctacctggtctggagcaagcaggcggtcatccgggtgaccggcctctggcacgggcacatcatcgacgtggtgccgctcgcggaggtgagcttctgcctcgtcgcgggcctgctcgtcgcccacgggacggcgcgcctgcgcgactggcgcgggctcggcgccgcggcgcggtcggacgtcgcgtcggccagcgcgatgttctcgaaggtgctgatcgcggcggcgatcagcatccatctcggcaactactattcctcattcctggccaaggtcacgctcgacgacgggccgttctcctggctgctcaacaacgatcccggcaagatcttcatcgtcggcctcgacaacaaccacgtcccctacgccggctggccggtgctggtggaggcgatgcggacgatcctgagccattcgagcgcgctgaccaacacgctcatcctggtcggccagggcatcgccctggtggggatcctcatgccgcgccgctggctgctgctgctgctcctcggcttcgacgtgatgcacctgtcgatcatcgtgctcatgggcgccaacttcgccccctggatcatgctgaacctcgccatcgcggccgtcgtcgtgagccggcactacgagcgccccccggtctcggtcgggatcctgtcggtgctgttcatcctgaccggcaacacgttcatgacccaggcctggctcggctggtacgacaccctggccaacaacaagatgtacttcgaggcggtcgaccggaccggccagcggcactacgtgccgaccaacttcttcaccttctactcctacccgttcgcccacatggcctacggcgcgcccgacgcggcgaacgccttcgccctcgacaacccgaacggcggcacgcaggtcttccgcaaggtcacggcctcgacgacctgcgacgttcccgtcctgaccgcaccggacggcctgggtcaggaatactcgaagtcggagatcgacgggccggcgctggacgcctacgtccggggctaccaccgcctcgtcagcacgatccgcgacaggacgggcctgttcccctacgcggtctatccgcaccacttcttcgtcccgctccagtacgccgccggcttcgacaccctcgccatggccgacatcgtcgcctacgtgtaccggcgcgaatccgtctgcttcagcctgcaggacggcgtccccgtccgccgcgtggtgtccgaagccgagcacaggatcgacctgaccccatga

SEQ ID NO: 6099 - DNA, 1680 bp, Methylobacterium sp.
gtgatcagagcctttcactgcctcgcgaacggcacggtgaccggtctgggtaccctgcgcggccatcagacggatctgctcgagcgggctcgcccctacgtcatcctgctcgcgcagatcgcgatgctcctcttgctgatcaagatggcgcgcaccttcgacgagcgcagcgtcgtcggcgtcgccttcccgctcctgctcgtcgcgatcatggtgcgataccgtccggccgcggccgatgcggctttggtgcgcctgctccagctgatcggcgtcatctcgggggcctacgcgcttatccactaccccctgttccccgtcgtccatcaaggggtgagggcgaccgtcgtcttggtagccttgggcgggctgtgggtggccgcagtcgcctgcggcgccctgtgcctacgctggccggtgctcgcggtcgtgagcgcgtcctacttggtctggagcaagaaggccgtcgtgtgggtgacgggcctctggcacggccacgtcatcgacgtggggcccctggcagaggtcagcttctgcatcctcgccggcctgctcgtcgcccggctgttcgagcatgtgcgcgatcggctctcctggagcacacccgtcgcagcagacatcggtgtcgcgagcgcgctcttttcccaggccgtgatcgccgcagcgatcagcatccacttggggaactactattcctcgttcctggccaaggtcaccctcgacggcggcccgctctcgtggctcttgcacaacgatcctggcaagctcttcctcgtcgccctcgacgacaaccacatcttattctcgggctgggactggctggtcgacgccgtgaaactgattttgcagcacaccagcgctgtgacgaacgccttcatcctaatcggtcagggcctggcgctggtgggcatcctgatgccgcgtcgctggttgctgatcctcctgctcgccttcgacatcatgcacctctcgatcgtggcgatcctgggtgcgaatttcgcgccgtggatcttcctcaacctcgcgatcgcggccgtcgtcgtcagccggacctatcggcgtccgcccctgctgatcggcctgttatcggtcctgttcatcctcacggacagtcggttcatgagccaggcttggctcggctggtatgacacgctggccaacaacaaaatgtacttcgaggctgtcgacaagaacggcacccgtcactatgtcccgacgaatttctttaccttttactcctatccgttcgcccacatggcctacggctcgccggacgcggccaccgcgttcgccgtcgataatcccaacggcggaacgcaggtgttccgcaaggtgctggcctcgatgacctgcgacgtgcccgttctgacggcacgcgacgacgccagtcaagataaggcaaaggatgggatcaacgtcccggccttcgatgcctatatccggggctaccacaacctcgtcagcaaagtcttcgatcgaccaggcgctttcccgtcagccgtctatccgcatcactttttcatccctatgcagtacggcaccagcttcaatgcagtgaagatgagcgatatcgtcgcctacatctaccgccgagaatccgtgtgcctcagcgtgcaggacggtgttcctgtccggcggatcgtctccgaggccgagcaccggatcgcggtgacgccgtaa

SEQ ID NO: 6100 - DNA, 183 bp, Methylobacterium sp.
atgctaccgtccgttcagacgaccgatctgctcggcctcggcttcctgatcatcgggctcgccgcagctgggatcgccagcgcgagccggtccgcgcgcttcgcagaggagccgcgcgaggaactcgcgggcggagcgctgctggtggcgatcctcggcctcgccttcgtgctcgccgagtga

SEQ ID NO: 6101 - DNA, 183 bp, Methylobacterium sp.; identical to SEQ ID NO: 6100

SEQ ID NO: 6102 - DNA, 2103 bp, Methylobacterium sp.
atgctgcgtcttccgcgtccgtccatcggcacgatcctgtgcgcgatcctgttctcactcagcgccatgctgctggccgcgggcgcccggacggcgctggaggccggggcgcaggagcgggagagccgccgcgtcgtcgcgctcacggaaggcagccgtatcctcctcgagatcctgctcgctgtgcgcctcgagcgggggcggaccctgcaggcgctgatcgccgcggacaggatcccgcccgccgacgcggccctgatcgcccgacagcgcgcgacccggatcgatcggctggaggcgctcctgaggctggtgcgcgcgatcgacaccgccgcggtggcgaagacggtcgatccgctccgacgggcgcacgaggccgtcaccggcctgacgtcgcggatcgacgcggccctctcggtcccggtcgcggagcgcgaagccgcgaccgcggaggtcgccgcgaccgccttccgggatctgctcgacgcgctcacggcgaccagcggggccgtcgacgtcacgatcccgcgccgggacgcggcgctggcccgcgccctggacgtcaagcgcgccgcctggatcacgcgggtcgcgatcggcggcaacgtggcgcgggccgagacggccgtgacgcggggcacgggctggtccgaggaggagcgcctcgccgaggccgaggagcgcggccgcgtcgcggcgagctgggcgaatctcgtcgatcacatggacgacacgctgccgccggcggtccaggacgccttcgtgagggcgggcgccagcaacttcgagggcgaggtcgcggcgcggcggcaggccctgcgggcggccctgagccggggccgcccgcccggcgtcgcgatccaggacctgcgcgaccgcaacacgcgggaggtcaacaccatcgccgacctcgccgaggcagccctgaacgcgatggtcgcccgcgcgcaggcactcgccgcggaggcgggggcgacgctgctgcacaccgccctgttcctcgccgcatcggtgctgctcgccggtgccggcgccgtcgtcgtcgtccgccgcgtgctcggaccgctccgggccatgatccaggcgatgcgggcgctcgcctccggcgacgtcgccgtggagatcccggcccgcgggcggcgggacgagatcggcgcgatggcggcggccgtgcaggtcttccgggacaacctcgtccgcacccgcgccctggaggcggaggcggccgaggcggcgcgcgccgcggaggcgcagcgccggtccatgacgcacacgatggcgcggagcttcgaggcggcggtggccggcatcgtcgggcaggtctccgccgccgcggccgaactgcagaccacggcctgggagatgaccaccaccgcccaggagacggccagccagtccgataccgtggccgcggccgccgaggaggcgtccgccggcgtcagcacggtggccgccgcggtggaggaactcggcacctccgtccaggagatcggtcggcaggtccagggctcgtccgagctggcccggatcgcggtcggcgaggccgaccagacggccgccctggtggcggcgctcaacgcgtccgtcgcccgggtcgacgccgtcgtcgagctgatcgcccgcatcgccgcgcagacgaacctgctggccctcaacgccacgatcgaggcggcccgcgccggcgaggccgggcacggcttcgcggtggtcgccaccgaggtcaaggaactggcggcccagaccggtcgggcgaccgacgaggtcggccggcagatcggcgagatccggaccgtgaccggtcaggcggtgcgggcgatcggcacgatcaccggacggatcggcgagatcgacgccgtggccgccgccatcgcggccgcggtggagcagcagggggcggccacgcgggagatcgtccgcaacgtcgcccaggccaatgccggcacgcaggaggtcaccggcaacatcgccggcgtggcgcaggcggccgaccggaccggccgcgcggccgaccacgtgctgacggccgccaccgcgctgacgcgtcagtcggaggagctcgccgcggaggtcgagcgcttcctcacgggcgtccgggccgcgtga

SEQ ID NO: 6103 - DNA, 294 bp, Methylobacterium sp.
atgccgacggcgctcccgtcccgagcgacgcccgtgcggcgcctatcctggcccgataccgctcgcctgctgatcctgatggtgcgtgtgcgcctcctcgaccttcggctgcatgtcgtcgtccgacagggctcgggcttggccaatgaccggctgctgcgcctgatgcggcgatggctggcgctgcacgaagcaatcggcgctttgctgccgggcatgccggagccgcagcacgtcgccgaggtgagggcgatcctgcgagtaccggcggccaagcccgagacggggctgtag

SEQ ID NO: 6104 - DNA, 501 bp, Methylobacterium sp.
gtgatcgatgtcagcttcatgctggtcgacgcgacgcgccggcaggtggttgatctcgggccgggctcctacgacctggagcgtacctatctggtcagcgccgggtcgggcatcaccgatgtggcgcatgtggaccgaccgtgtctccggatcgtggcgatcaggggcacgacgacgttccgcgcctccgcccgcacgctgacccggacgcagcccctccccgtcccgtccgtggccgaggcggtcgcgcgcatgcgcgccggccaggcggacgccttcgccctctcgcgcgacacgctgtggccggtggtcccgcagctcccgggctcccgcatcgtggcgggcggcttccagcagacgcagatcgcagtcgccgtcccgaagggccggcccgccgccctcgcccgcgtcacggcgtggctcgatggggcgaagcgcaccggcgtcgtccggcggatcttcgatgcccgcggcttccatgacgacgcggtcgcgccctga

SEQ ID NO: 6105 - DNA, 2691 bp, Methylobacterium sp.
cccctcgcacgcctcgaccaacgcggcctcgacgctctcctcgccggccacgcgctggcccccgacagcctcgccgacctctacccgctcacccccctgcaggagggcctgctcttccacgcccgcctcgagcccggggacgcggcctaccgcaaccaggtccgcctcgacctcgaacccctcgatcccgaccgcttcgcccgcgccgtccgcgccaccctcgagcgccacgacgtcctgcgcaccgccatcctcgaccccgccgacggcccgcccctccaggccgtcctcgatgccgtgcccgaacccctcacccgcctcgactggaccggggagccgtcgagccaggacgcgccgcacgaggatgccctcgccgcccgcctcgccgaacgcctcgccgactgcctcgccgccctggccgccgaggagcgcgcccggcccttcgacctcgcccgggccccgctcctgcgcctcgtcctggtccgcaccggaccggaccgccaccacctcgtgctcaccgtccaccacctgatcctcgacggatggagcaccgcacgcctcgtcgccgaggtgctcgcccgctaccgcggagaggagcccgagcccgtcacaggacgcttcgccgactacctcgcctggctcgcccgccagccgcgggccgccgccgagcgcttctggcagcacgccctcgccggcctcgacgcccccacccgcctcgccgacaccttcgacccgcccggcatgaccggcatgaccggcgcgcccggcgcccgcgacggacagcgcccgcccggccacggggaggtccggcatcacggcgaggtccggcaccgggtgccggccgccgccgccgggcggctgctcgcccgcgcccgggccgcgcacctcaccctcaacacctgcgtccaggccgcctgggcccggctcgtggccgcccgcaccgggcaggcgcgcgtcgccttcggcaccaccgtggccgggcgcccggccgacctgcccggggccgagaccgtgctcgggctgttcatcaacaccctgccggtggtcgtggacctcgacccggcccggcccctcggcgcgtggctggcgggcgtgcaggaggccggtctcggcctgcgcgagcacggccacctgccgctcgccgccatccagcgcctcgccggccccgcgggcgcgggcacgggcacaggtacgggtacgggcggcctgttcgacagcctcgtggtgttcgagaactaccccgtcgaccaagccctcgccgccgcccgccacggccgggacggaaacggaaacagggacggaaacggcgacggcgacggaaacggtggcggcgacggagacgctgccgacccgcacgccttgcgcctcggcccggccatcgtcgccgagaccacgcactaccccgtcaccctcgtggtccacccggagaccggtcccgacgggacgcggctggccctgcgcctgagctacgccgccgaccgcctgggacacgcggacgccgaggcgctgctcgccgccttcgtggcccagctcgccgccctggccgaggccgacccggcaaccccgctcggggcgctgccgccgccgctgcccgacagcgaccgggcggtgatcgggtcggcgaacgcgaccgcgcgggcctacccggacggcgccggcgacgtcctcgccgccttcgcagaccaccgcgcgcacgacccggacgcgatcgcggtgaccgacgcgcagggcgcgctcacccgccgcgccctcgacagcgcggcctccgcgctggcccgacgcctcgtccgcgccggggccggtcccgacactctggtcggcgtcgggctggagcggtcctgcgcgctgctcgtcgcctggctcgccgtgctcaagacgggagccgcgatcctgcccctcaaccccgagctgccgcgtccgcgcctcgtcgcgaccgcccgagaggcggccctgcgcctcctcgtcaccgagtccggcccggccgcgcggatgcccgggccggcggagcttccggacctgcagatcctgaccccggacctggcagaggcggcggacgatccggcgctgccggccgcggcgccgcacccggacgccctggcctacctcatctacacgtccggctcgaccggcacgcccaagggctgcgccaacacccgcgccgccatcgccaaccgcctcgcctggatgcgggcccatttcgcggtcggccccgccgacgtgatcctgcacaagaccccggtctccttcgacgtcgccgtctgggagatcctcctgcccctcgtcagcggcgcccgcctagtcatggcgcccccccaggcccaccgcgacccggacgcgctggccgccctgatccggcggcacgcggtgacgatcgtgcacttcgtgcccgccctgctggaggcgttcctggcgtccggccggctcgccgcctgcccgagcctgtcccgcatcgtgtgcagcggcgaggcgctcgcccccgacctcgcggccgccgtccgcgcccagagccgggccgacctggcgaatctctacgggccgacggaggcggccatcgacgtcagcgcctggacctgcggacccgagccggacgccccgcgcgtgccgatcgggcacccgatcgccaacacgcagctccacgtcctcgacgacgcgctgcacccggtgccggtgggggtggtgggcgagctctac

SEQ ID NO: 6106 - DNA, 1635 bp, Methylobacterium sp.
cgacgcctgtcgcgccgggacagcttcttcgagcggggcggcgactcgatcctcgccctccagctcgtcgcccgcgcccgggagagcggcctcgcgctgaccccgcgggacgtcttcacccacccgcgcctcgccgccctggcggcgcatctcgacgcggccccgaacagcgcggccgcgccgcccccccaggtcgacccggcgcgcgaggccggtccggttcccctcaccccgatccagcgccggttcctcgacggccccgtcccgaaccggcagcactggaaccaggcgatcgtgctcgcgccccgggcccccctcgacccgggccgcctcgcggaagcgctcgcggccgtcgaggccgctcatcccgcgctgcgcctgcgcttcgcgcgggacgcgcacggggcctggacccagacctgccgggcaccggggcaggagcccccgctgtggcggcgcgcggcggacggcgcgccggccttcgcggccctcgccgcgcaagcccagacgagcctcgacctggccgaagggccggtctggcgggccgtgcacgtcaccctgccggcggaggggaccgagcgcctcctcctcgtcgcccaccacctcgtggtcgacgccatgtcgtggcgtatcctgatccaggacctcgcggcggcgctcgccgggcggccgctcgcgcccccgccgacgagcttcccgggttgggcccgcagcctcgacgtcctggcccggcaccccggacatgccgggcgccgcgaatcctggctggctggctggctggccggggggccgggcgccgatgccgcgttgcggccggtccggcccgaggcacccaacgtcgaatccgcccagaccgagatcgccgacagcctcgacgccgacaccaccgacgccttcctccgccgggccggccggccctacagcgcccatcccgacgagatcctgctcaccgccctgtcgatcgcgctggcgcggcgcggcgacgggacggcggtgggcgtgattctcgagcgccacggtcgcgatgccgacgcgctggccgacgcgctcgccgaacccctcccggaacccgtcgccgaacccctctccgacgcgcaggacggcccgaccctgccccgccacgacctgagccggacggtgggctggttcaccacgctggtgccgctgcggctcgaccccctcggcggcgagccggacctgccgccggacgacgacgcccgcggcctcgccctcggtgctgccctcggtgctgctctctgccgggtgaaggaagcccgccgcgccctgccccagcccgacctcagccacgatctcctgcgccacggccccgcagcggacctgcgccaccgcatcgccgcgacacccgagcccggcatcctcctcaactacctcggccagatcgacgccgaccgcgccgaccccgacgcgcccttcgccctcgcccccgagagcgcggggcccatgcgcgacccccacagccccgcaggcgccgagctcaccctcaccgccctcgtgcgcgccggccgcctccacctcgcctggcgcttcagccccgaccgccacgacgccgccgccatcgccgccatcgcccgcgacacccggcagaccctcgaagccctcctcgcgcactgcgcc

SEQ ID NO: 6107 - DNA, 1038 bp, Methylobacterium sp.
gtggcggcccccaagcgcgtctgccgattcaacgtctggatcaatccggtcttcgacgcgcgcctgggggccgagcccgacatcgacctgcaggtcggtgacctgcagggaccggaggacgcgctcgcggcgctgctggcgcgggcccacgtcctccacgtctcgccggcgcgggacgagctgccgcgccgctggcacgtgaccgacacgctgctggccgaatgccccgacctgctcgcggtctcgtcggccggcgcgggcttcgacacggtggacgcagccgcctgcacccgggccggcgtcgcggttgtgaaccaggtgggcggcaatgcccgctcggtggcggaactggcgatcggcctgatgctcgccgtgtcgcgcaagatctgcgtctcggaccgcctgctccggaccgcgcgcggcttcacccgcgaatcgctcatgggccacgagatcggcggcgcgaccctggggctgatcgggatcggtcataccggccgcgaggtcgccaagctggcccgcggcttcgacatgcgggttctcgcgcacgatcccctgctcccggacgcggagatccgggcccgcggcgcggagccggtggaccgggcgcggctgctcgccgaggccgacatcgtgtccctgcactgccccctcgacgacaccacccggggcagcttcgacgccgcgtccttcgccgcgatgaagccgggggcgctgttcatcaccaccgcccggggcggggtccacgacgaggcggcgctcgccgccgcgctcaccgccggccatctcgccggggcgggcctcgatgtctgggcgccggaaccgccgcccctcgacgcgcccctgctgcagctcgacaccgtggtggcgacctaccacaccgccggcgtcacccacgaggcgcggcgcaacgtggctgcctggggggccgatcagatcgtcggcctgctccggggcgagacgccaccgcggctcgtcaatcctgaggtctggcccacagtcctcgagcggcgggcgcggctgctcggcggcgcctga

SEQ ID NO: 6108 - DNA, 798 bp, Methylobacterium sp.
atgaagctcggtgcctacaaggatcgtctcagcggccattgcggcttcctgttcacggagctgccgctggccgagcgcttcgcggcggcggcccgtgccgggttccgcgcggtcgagcatcccaacctgttcgcgacgccggcccgggaggtcgcgggctggctggagcgggcgggcgtgccgctggttcagaccggcttcccggcgggggacgccgccaagggcgagaagggcttcgcggcgctgcccgaccggatcgatcacttccgctccacgatcgagccgaccctggactacgtcgcgcagctcggctgccggatggtccacccgatggcgggggtccggcccgctggagtcgagcgggcgcggctctgggacacctatctcgacaacctcgccttcgcggccgacgccgccggcgcgcgcggcatgacggtgatcgtcgagccgatcggtcccggctcgatcgccgactacgcgatcgacgacccgctgctggcggtcgaggcgatccgggcgatcggccgcgacaacgtcaagctgctgttcgacgcctatcactgcgtgtgcctgggccacgacccggcggcgctgatccgcgcgcacgcgccgctcatcgcccatgtccagatcgccgacgatcccgggcggcacgagcccgggaccggcacgatcgccttcgacccgatcttcgccgccctggaggaggtcggctattccggcttcgtcggctgcgagtaccatcccgcggccggcaccgaggcggggctcggctggatgcgggcgccagcggcgtag

SEQ ID NO: 6109 - DNA, 672 bp, Methylobacterium sp.
atggctccccgtatcgtcctcctgcacgcgacgccggtcgccatggcgccgatccaggccgccttcgccgagcgctggccggaggccgagaccgtcaacctgctcgacgacggcctgtccctcgaccgggcgaaggagccgggcgcgatctcggaggggatgatcgagcgcttcgtgcggttcggccgctacggccacgacatgggcgccgacggcatcctgatcacctgctcggccttcggcccggcgatcgaccggctgatcgagaccgtgccggtgccggtgctcaagcccaacgaggctatgttccgcgcggcgatcgcgcagggcgcgcgcatcggcatgctggcgaccttcgggccctcggtcggcacgatgacggacgagttcgaggagttcgtcgcggaggccggacgcccggcgagcctgcggacggtcctggtggacgacgcgatggcgcgactgcgcgccggcgatgccgagacccacaaccggctgatcgccgagcgggcgccggaccttcgcgactgcgacgcgatcatgctggcgcacttctccacctcgcgcgcggccgaggccgtgcggaaggccgtcgacgtcccggttctgaccgccccccacgcggcggtggatcggatgcgggcgatgatcgagaccggcgggagcgcctga

SEQ ID NO: 6110 - DNA, 1296 bp, Methylobacterium sp.
atgttcgccaagcgttacagattcctgatcgcgttcctgctgttcatcgccggtatcatcaactacatggaccgagcggcgctcggcgtcgccgcgcccttcgtcaagcaggacctgaacctgtcgccctcggagctgggggtgatctttagcacgttcttcttcggctacgcgctgttcgccttcgtgggcgggcagctcgccgaccgttacgggccacgcagcgtctacagctgggcggcagcctcctggtcggtcctgtgcatgctcaccggggcggtgaccggcttcgcccagatgttcatcgtccgcgccctgttcggcttcgccgaggggccgatgaactccaccacgaaccgcaccatcaccacgtggttcccccgcgaggagaccgcccggaccatcggcttcaccttctcgggccagacggtgggcagcgccatcgcggcgccggtcgtcggcctgctggccatccagtacggctggcgggtggcgttcgtggccatcggcgccgtcggcctgctgtgggtcgtggcgtggcggatgctgatgaccgaccggccgcaggacaacccgcgggtccatccggaggagatcgccctcgtcgagcgcagccgggcggtcacgcacctcgcgccctccgaccatgcccgctcgctcagggagtacctgttcctgccgagcaccctgtcgctcgggctcggcatgttcgcggtgaattacaccctctacatcttcctctcgtggctcccgagctacctcaccgacgcgctgcacatgccggtgaaggagatggcgctcgtggcgtcgatcccctgggcctgcggcttcgtcggctatgtcggcgggggcgttgtggcggacttcgtctacacgcgcatgggcgacaagctcgccgcgcggaagatcaccacgatcgtgccgctcgccatcgcgggggtggccctgatcatggtcaacgccgcgaccagcaccgccatggcggtcgcgctgatcgcgctcgccgtgctgatgctgaccagctcggtgcaatcctgctgggcgacgatccacgagctggtgcccgaggcccgggtcggcggcgtcagcggcttcatccacctcctgagcaacatctcgggcatcatcggtccgaccgccacgggactggccgtgcagtatctcgggggctacgccagcgccttcgtgatcgccgccctgatcgcggcggccggcgtcgtcgcgatggcgatcttcgtgcggcggccgcgcaacccggcggaagccggccccctcgccgcggccaaggccgtctga

SEQ ID NO: 6111 - DNA, 204 bp, Methylobacterium sp.
atgttcaagaatacggcgcgcgctgctctttgcctggcctgtctctggtcggtcacgccggccctggcggccccgaaggagatgccccagggcaagcgtgacgagatgtcgatgaaggacaccaagcacgaagtggtgatgcagcggaaggagaataaggaagccaacaagaacgtcgacagcctcatcacgaaccgcaagtga

SEQ ID NO: 6112 - DNA, 99 bp, Methylobacterium sp.
atgcctctgaagcccttctcctacctcatgatcggcgtgttcgcctccggcctcgccatgaccgtcttcggcgccgtcggcgtcctcgccggcagctga

SEQ ID NO: 6113 - DNA, 180 bp, Methylobacterium sp.
atgatcttcgacagcaaggataccgcgctggacgcgctcgccgcgcagtgcctgcgggttcgcgagctcatcgactcggtcggcgatccgctgatgcgggccgccatcgatctcctgcttctcgaggtcgcccgggccctcgcccagacgggtccgcaggaccaggcgagcggcgcctga

SEQ ID NO: 6114 - DNA, 231 bp, Methylobacterium sp.
atgactgacgacgcgaccccgccgacgacgcgctggctactggaacggatcgcagccacgctgaatgtctgtccgacctacttcctccagacggagcggcccgacgagaccgcggcggaccaggacgcgcgcgactgcgcggaggtcgccgcgctgttccaggcgatcaagtcgccggcgcggcgcaccgccgtcctgaacctgctgcgcgagatgagccgcgagacctga

SEQ ID NO: 6115 - DNA, 705 bp, Methylobacterium sp.
atgctcacgcttgagcgcgtggatgccggttacggcgcgaccagcatcctgcacgccgtctcgctcgaggtgcgcgcaggcgaggtggtgacgatcgtcggcgcgaacggggccggcaagacgacgacgctgcggaccatcgcgggcctggtgaagcccacccgcggcaggatcctgttcgaggacgaggacgtcacccggctctcgggccacgagatggtggcacgcggcgtcaccctgatcccggaggggcgccagctcttccccgagatgacggtgcgggagaacctgctgatgggcgcctaccgccgcgcggcgcgcgagcgccagtcggagacgctcgcggacgtgctcgacctgttcccgcgggtgcgcgagcgcctcgaccagaacgccgggtccctctcgggcggcgagcagcagatggtggccatcgcccgcgggatgatggcccgtcccaagctcctgatgttcgacgagccctcgctgggcctcgcgccgatcgtggtggcgcaggtcttcgcggtggtcgaccggatcgtgaagacgggcgccaccgtcctgatcgtcgagcagaacgtgttccacacgctgcaggtggccgaccggggctacgttctggagaacggcgagatcgtcctcgccgacgcgtccgcggccctgctcgacaacgaccacgtccgacgcgcctatctggggatctga

SEQ ID NO: 6116 - DNA, 843 bp, Methylobacterium sp.
ttgcacaagaggccgctcgccgccgtcacgatggcctacaacgaaaagaccatgcttccgctctggctgaagcactacgagcgacaagtcggggctgaaaactgttatatcctcgaccacggttccgacgacggctcgacgaccggactgcgcgcgaacgtcgtccggttgccgcggttgcccctgaacgagtgggagcgcgcccacacggtcagggatttctgcgcatcgctgttcatcggcttcaaatatgttctctatgcggatagcgacgagctgatccttcccgatccggacgtatcgtcaacgctctcagagtacatcgccgcgcggccgctgccccccatcctcgatctgttcggggccgacgtcatgcacgtcggggacgaggcccccatcgacgtcgcggcgccgatctccggccagcggagatacatccggccgatatcgaccctgtgcaaggcgaccatcgtgtcggagcgggtcgactggcatgtcggcttccactgcctgatccaggatcaccgccccgatttccgcgacctgttcctgttccatctggcgtatctggaccacgacatcctcttcaagcgccagcagaagcggaatgcggccgcgccgatcggcatcccgaactcccaccacgccatcgacccgacggagttcctgacgttcgtgaaggccgatatcggccgcgtcccgcgccgtcccgttcagatgcgtccgggtgaggctcatttcgagaccacgaagcggctgttcgccgacgcgatcgagcgcaagagcgcgatccaggcgcccgacctctggacgctgcccgaacgtttcgtcggatccttctag

SEQ ID NO: 6117 - DNA, 1413 bp, Methylobacterium sp.
atggatcgtgcgcagcaactcctgaggtcgctgaccaaggacgcccgcatcgtggagattggcccgagcttcagcccgctcgcgccgaagcgcgacggctggaacacgttcgtcatcgatcacgcgccgcgctcggagctcatcgagaagtatcacgaccagacggtcgaccgcatcgaggaggtcgatttcgtctggacaggcggctcgatcgcggacgcggtcccagtcgaccagcacggcaccttcgacgcgttcatcgccagccacgtcatcgagcacacgaccgacatcgtgaccttcctgcgcgcctccgagacgctgcttcggccggacggcgtggtgatcctggccgtgcccgacaagcgcaaatgcttcgatttctaccgttccctcaccgggacggcggacgcggtcgcggcgttcctggagaagcggaaccggcacacggtccggacccacatcgactacgccctgaacatggcgctgaaggacaacggcacggtcggcgcctggtcgggccgggacacgcggccggccattccggcgaatccgctcaccgacgagccgcagtggctcggcgccgcgcaactgccgtactacgccgacgcgcatgcctgggtgttcgtgccggcaagcttcaatctgatgatcctggagctggcgcagctcggctacatcgatctgcgcgtcgaggattttctcgaccgggacgcgacggaattcttcgtctggctccgcaagggacggcagcagctggcgccggacgagatccgcgagcagcgcaccgcgctgatgcagcgcgccatcgtcgagctggcggagcaggtgcagcaactgcccgagacgtccctcgtcgagatggcctcggcgggggcgctgcgggatcagctcctcaaggcgacttaccggaccgaggcgctccgcaccgtgctggcagcgctgcgggccagcatcggccgtttcgggctggatcgggccaagtttaagcgcctgatcggcgcggcgagccagaaggttccggggaacctctcggcggcggtccagcacaagatcctgctgaccgaggcgaccaagatcctcgacggcatcacggatcctgcggtcgaggccgacgatcgggatcccgccgtcatcgacggcgccgtcttggtggcgccgctcggcgcggcccagttcggggatccgctgctcgccgccgaactcgagcgcgagcgccagcgcgcccgggccgtccgcatggtgctggacgccgtgctcggaagcctgcgcggccgcgccctcgacaagaagcggttccgggacctcgtcacgcaggccgccgcgcggacgccgaatgacggccccgaatcggcccgccacgcggtgctgtccgaggaatcgcggcgggttctcggcctgccggtcgcctga

SEQ ID NO: 6118 - DNA, 321 bp, Methylobacterium sp.
atggacgacgacgtcgcagacggcatggacggcggcgacgcgagctccgcggcggctcaggaggcgaacgggatcgccttcctgctggcgagcgccgcctacctgacactcgcagacgcgcatctgcggcgggaaggcccggaggggctcgcccttatggacgagatcgaggaccggatcacggaggccctgcggagcttcgtcgaggagacgtcctacgaggatgcgcggccggacatcctccagcacgcgacccgcaaggtccgcgccctcctcgaagcggggcgctcgctggcgccggagatgcggcgattccagtga

SEQ ID NO: 6119 - DNA, 687 bp, Methylobacterium sp.
atgagcgtcctcgccacggcactgctcaccggtgcgagcctcggtctgtccatcgccgcgccgatcgggccgacgagcttgctgtgcgttcagcgaacgctgtcagggggcctgtcgaccggcctcgccaccgggctcggtgtcgccaccgtgcacctgacatacgggggtctcgtcatgcgctggggcgcggacctcgctgcggtgtggtcgaacggcgccgttctctccctgatctcgggggctgtgcttctcgccctcgcgttccgggtgcttcgcagcgtctcggtgctgcaggagggccgcgcgtgccgcgacacgctggcggtgagctacggcagcgcggtcgtgctggccttggcgaatccggtcacccccgtgctgttcctggccgcgatgccggctttcctcgagcgcgggaccgcgccgttcccggttctggcggccggtgtcttcgtgggctcgttcggctggtgggtggtgctcaacaccgcggtgtccctgttccggcgctgcgtgaccagccaggttctgaatcggatgaacaaggccgcgggccttcttctcgccctcctggcgctgagcttgctcgttcgggggctggacggtggcacggtggcccgttccagcagcgcgggcgtgagcggggtgtcgggcgcgggcgtccgagcgccgagccggctctga

SEQ ID NO: 6120 - DNA, 711 bp, Methylobacterium sp.
atgcctgaaccgctcctcgcgacgaccggcctgcgcgccggctacggcggcaagcccgtgctgcagggcgtcgacctcgcggtccggcccggcgagatcgtggcggtgatcggccgcaacggcgtcggcaagtcgacgctgatgcgcagcctcgtcgggctcttgcccgcctccgcgggcggcatcgcgttccggggcgcggcggtcgaggggctcgccgcccaccggcgtgcccgcctcggcatcggctacgtgccgcagggccgcgacgtcttcccgcgcatgagcgtcgccgacaacctgacggtcggcgcgtcgctgctgccgaagggcgagcggccggattacgagcgcgccttcgggccgttcccgatcctgcgcgagcggcgcgggcagcgggcggggacgctctcgggcgggcagcagcagcagctcgccatcggccgcgtcctcgtcggcgggccggcgctgatcctgctcgacgagccctccgagggcatccagccctcggtggtgcagcagatcggccgcaccctggtcgatctcaacaagcgcaccggggtgacgatcgtgttcgtggagcagaacctcgacctgatccgcgccatggcccagcgcagctacgtcatggacaagggccggatcgtcgcggagctgacggcccgggacctcgacgaccgcgacctcgtgcggcgccacctcgccgtctga

SEQ ID NO: 6121 - DNA, 993 bp, Methylobacterium sp.
atgcagtggctcgaccagtccatcatggcccgcaagggcgtcgccggtggcaagcccggccgggagcacacgatcaccgaggccgagcagggccgctaccactacgtctacgggcccttcgccgagccggtgctgaccgtcgatcccggcgccgtcgtcaccgtcgagacccacgacgccttcgagggcaagatccgccacgagaccgacagcccgacgcagatcctgaacttcccctacctcaacccgcagaacgggccgatctacgtcaacggcgccgagaagggcgactgcctcgcggtggcgatccgctcgatccggccgcgcggcccgcagccctgcggcacgacgctgatcatgccggaattcggcggcctcgtcgccaccggcgacaccgcgcttctcaatccgccgctccccgagcgggtgcgcaagctcgaggtcacggccgagaacggcgtgcgctggaacgaccggatcacgctgccctaccagccgttcatcggcacgatcggcacctcgccggagatcgaggcgatctcctcgctgcagccggactattacggcggcaacatggacctgccggacgtgggcgtcggcgcggtgatctacctgccggtgaacgcgaagggcgcgctcctctacctcggcgactgccacgccgcgcagggcgacggcgagctctgcggcgtcgcggtggagcacccgacccacacgacggtgcagatcgacctgatcaagggctggacgttccgctggccgcggctcgagaccgaggacttttacatgacgatcggctcgtcccgcccgatggaggacgccgcgcgcatcgcctaccgggagctgatccgctggctcgcggccgatttcggcttcgacgagatcgacgcctacatgctgctcacgcagtgcgggcgcgtgcggctcggcaacatggtcgatccgaaatacacgctcggcgcctcgatcacgaaggcgatcgcccacgcctga

SEQ ID NO: 6122 - DNA, 1002 bp, Methylobacterium sp.
atgacggctcggattctcggtgcgctcgtgtttgcgctcgccttcgtcacgcccgctgcggcgcagagcccgatcgtcatcaagttcagccacgtcaccaccaccgacacgcccaagggccagggcgccgagcggttcaagcagctcgctgaggagcgcaccaagggcgcggtcaaggtcgagatctaccccaacagcacgctctacaaggacaaggaggaggtggagatgctccagctcggcgccgtgcagatgctggcgccgtcgacgagcaagttcgggcccctcggcgtgaaggagttcgaggccttcgacctgccctacatcttccccaacgagcaggtgctgcggcgcgtccaggacgggccgatcggccagggcctgttcaagaagctcgagaccaaggggatcaagggcctcggctactgggacaacggcttcaagatcctcaccgccaacaagccgatgcacgcccccgaggacgtgaaaggcctgaagttccggatccagtcctcgaaggttctggaggcgcagttcaagcagctcggcgcgctgccgcaggtgctcgccttctccgaactctaccaggcgctgcagaccggcgtggtcgacggccaggagaacccgccgtcgaacgtgacgacccagaagctcaacgaggtgcagaagcacgccacgctgacctatcacggttacatcggctacgcggtcatcgtgaacaagggcttctgggacgggctgccagccgacatccgcaccacgctcgagggcgccatcaaggacgcgaccgcctacgagcacgagatcgccgacaagcagaacgagaaggcgctcgccgacatccgcgccaccggcaagaccgaggtctacacgccgaccgaggccgagaacgccgcgtggcgcaaggccctggctccggtccagcgcgagatggcctcccgcgtcggcaaggatctggtctcggcgctcaacaaggaagccgaggcggcgccgaacaactga

SEQ ID NO: 6123 - DNA, 810 bp, Methylobacterium sp.
atggacgcagagatctacgagatctacgcgatcaagtacgcgcatcatcaccgtatggcccgcgagaacttcatcggcggggacatccacgacggcccgatgccgatcgactacttcgtctgggtcgtcgtcggcggcggccgaacgatcgtcgtcgataccggcttcgaccgcgcgatggcgacgaagcggggccgcagcatcgtgcggccggtcgaggagggcctggcgcggatcggcgtcgacccgctgcgggtcgaggacgtcgtcctgacccacctgcactacgaccacgccggcaaccacgacctgtttccgacggcccgcttccacgtccaggaacgcgagatggcgttctgcaccggccggtgcatgtgccacccggaggtccgccaccccttcgccgccgaggacgtgaaggcgatggtggaccgcctgttcgaggaccgcgtccgcttccgcgagacgaccgacacgctgtatccggggatcaccctccaccgggtcggcggccactcggacggcctgcagatcgtccgggtccaaaccgcgcgtggctgggtcgtgctggcctccgacgccgcgcacttctacgccaatatcggtcgccggctcgcctacccgatcgtctacaatgtcggcgacatgttcgagggctaccggacggtccggcgtctggccgagtccgaggagcacatcgtcccgggccacgatccgcaggttctcgcgatctacccgccggcgtccgaggatgtcgccggctggatcgcgcgcgtcgacctgcctccgaccgcttcaccgacctactga

SEQ ID NO: 6124 - DNA, 120 bp, Methylobacterium sp.
atgatcgacgtacagccggaggatcgggccgcccgcgtgatcgaccgggtcctgctctgcgcagcgatgctctcgctcaccttcggactggcgacgggcctgtggggcctgctgcagtga

SEQ ID NO: 6125 - DNA, 216 bp, Methylobacterium sp.
atgctgctgaaccgcgtcctcgtcgccgcgctgatcgtcgcggtcgcggcgttcctgctgtacttggcggccctcgcccgcgcagcgctgtcgcccaacgagccctacgcggccagcatcggcctcaccctcgaccagtgcgtggccgcccaggacagcctgtccgccgaggcggcgcgcctctactgcctcaggcccgtcccgaagcgcctgtga

SEQ ID NO: 6126 - DNA, 219 bp, Methylobacterium sp.
gtgagcacgatgaccgccgaacccgacaacctcgtgctggcccttctgcggcgcatcgacgggaaggtcgatcggctcatcgacgacgtgaacgacctgaaggcccgaacttcggcggtcgaggagaaccttgcgggcgtgcatcgccgcatcgatcgcctcaagcttcgagtcgagcgcatcgagcgccggctcgacctcgccgacgcgccgcactga

SEQ ID NO: 6127 - DNA, 282 bp, Methylobacterium sp.
gtgaactcgacagccctgttcaccatgctgggcctcgtcatcggatgggcggttctggccggcgcggccctgatcaccgggcgggtcgccaccttcgcgttcctgatcctgacgctgatcgccctctacctctacgttccgtgggtgcggctgcgggcgagcgggatcgaggggtccagccggccggtccggttctggaccaacgtcgccatgctggccgtcagcctggccgcctgcctcgccttcgggatcatgctcgcccggcgcaccgggctcctgtag

SEQ ID NO: 6128 - DNA, 894 bp, Methylobacterium sp.
atgatccgcgctgatctcaacgactacgtctacttcgccgaggtcgtcgcgcacggcggcttcgcggcggcgggccgggcgctgcaccagccgaaatcgaagctgagccgccgcatcgcggccctggaggcgcgcctgggcgcccgcctgatcgagcggtcgagccggcgcttccgcgtgaccgaggtcggccagggcttctacgagtgctgccgggcgatgatgctcgaggcggagcgggccgaggcgctcgtcgcggaggcgcagaccgagccgcacgggcggatccgcatgagctgtcccacgggcctcaccgacatcgtcgcggcgcacgtccgcggcttcctcgtccgctaccccaaggtgcggctgcagctggtcgtgaccgaccggcccgtcgacctgatcgaggatcggatcgacgtggcgctgcgggtccgccgggacctgacgagcgacgcgtcgctgaccatgcgcacgctcggaacctcgcgctggatcctggtcgccgcgccgcgggtcgcgcgcggcctcggccccgacatcgccgcgctcggcgcggtcccgaccctcggcacccgcgacgatcccggcgaggcggagtggcggctggagcaccgcgacggcacgatcttcaccctgcgccacgagccgcgcctgacctgcggcgacttcgccgcgctctgcgacgcggcggccgacggcctcggggtcgcgttcctgcccgaccacgcctgcaccgacgcggtcgcggccggccggctcgtgcccgtctacccggactggcagggtcagcccgggatcgtgcacatcgtcttcacgacccggcgcgggctgccgccggccgtgcgcgtgctgatcgaccacctcgcggcgacattcccgaagctgtga

SEQ ID NO: 6129 - DNA, 342 bp, Methylobacterium sp.
atgagtctgctcaacactctcggcggctcgctggggcagatcgcgctgaaggcactgccgggcgtgatccagcaggtgctgcccggcggcctgaacgcgctgctcgatcagctccggcgctccggctacgagagccaggtcaattcctggctcggccgcggcccgaacgagccgatcacggccgaggacctgcgcaaggtcctcgacaacgagcaggtgcgccagatggcggagaagctcggcgttccgatggaccagctgttcccgaccctggcgcaggccctgcccgagaccgtcgaccgtcacagccccgaggggacgctgcaggcgccgaagacctag

SEQ ID NO: 6130 - DNA, 381 bp, Methylobacterium sp.
atgctcgcaacgctcgttgccttcatggtcgcgaacccggcgatgagccacgccctgacggcgattcccgagaccgccggggtggcggccgctctgatcctgttgcgcagtccccgcccggaaggcatcgcggcgctcgtggtctcgacctactattacggccgcgaggccgggcagcgggaacacgccctcaagcacgcgggctgggacgccgttcaggcgcatctcggcgccgagttcctgtacggctggtcccttccgaaccttcagcaatgggtggcgccgacctgcgcggccggggcggtcgcggcggcgatccatctggtccggtcgcggatggcgcgggccgctccgccgggtgcccggctcaggcgcgagtga

SEQ ID NO: 6131 - DNA, 246 bp, Methylobacterium sp.
atgaagcgcatgctcgtcggggccgccgtggccctcaccaccctggccgccgcgggcggcgccgaggcgaagggctgcatcaagggcgccatcgtcggcggcatcgcgggtcactacgccggccaccacggcctggtcggtgccgcggccggctgcgccatcggccgccaccgcgccaacgctcgcgaccgtcaggtcgagcagcagcagatggcgccgcaggcgcgccccgtctcggcccagtag

SEQ ID NO: 6132 - DNA, 117 bp, Methylobacterium sp.
atggggactttcatcttcggaacgctgggcggcctcatgatcgccggtgtcgcggcgatctacgcgaagcaggccgcgctggaagaagcggattcccacacggacgggcatttctga

SEQ ID NO: 6133 - DNA, 1365 bp, Methylobacterium sp.
atggccccgacagacgatccgaccccggtcctcgtcgatctcgcggccggtcgtgacccgcggatcgtctccgatgcggggacgggaacgacgtggctcgaggtcgacctcggcggccggttccctatccactccgtcgccctgcggccgggggagggggcggttcccccggagcccggcgacgtcgcggtggcggtctcgcaggatggcgcgacgtggaccgagccggacctcgccggctggaccgcgacgccggacgccctcgtcgccgcgatcgtccccgacgagcgggcctgggcgcgcgcggtccggatcgccgcgcccgaaccggcccggatcgccggcatcgacatccgcgccgacgaggccgcggtcgacctgatcgcgctgcgggcgatgctcggcctcgacgtgacgctcctgaacgagacgcccggcgccaacgtctacgtcacctacgcgctccagtcggcgcccgaccgcgccagccatgccctggtcggcctgtcgctgttcgagaacggcgccttcggcaactgcctcgtccagtacatcatcgcggtgtcgatcgcgaaggcgctcaacctgaaatacatcaaggtgccgaaggtcgaccgcagcaaggtgatcttcctgaccgagcggctgacctgcgacggcatcaccttcatcccgccggacgagccgctgccggcggacggctacttcctgtcgggcctgtatttcgacccgacgcagttcgagcgcgtgaccgcgctgcgggggccgacggattcgcgcgcgatcgtgcagagcgtgatccgaccgctgttcaacggcctgccgaagaccttcccggcgaagcccgacgaccagctcctgatccacatccggtcgggcgacatcttcagcacctgggtcgatccgcactacccgcagccgcccttcgcgttctaccggatggtcatcgaccggctcctggccgagggccggatccgctcggtcaagctcgtcttcgagaacaggctgaacccggtcatcgccgaggtggaggcgtacgcggagcggcgcggactgccggtggaggtccagagcgagtcgctgatctccgacgtcgcggcgctggtgaacggccgctatctcgtcttcgggctgggcaccttcgggccggggatctgccacctctcggatcgggtcgagcaggttttctacttcgcgtcgaactggccgcagggtttccagtcgatccccaccatcggcaaggtcgtcgaggtgcgcgatctcgagggccgctacatgaaggtgggcgagtggcagaacaccgacgcgcagcgccggacgatggtggattatccggccgaagccctcgccttcgacgacgcgtga

SEQ ID NO: 6134 - DNA, 240 bp, Methylobacterium sp.
atggtggtcgcagcgctgttgtttctcgtgggatggctgctcggccgatcctactcggtgatcatcctcgccctgacctcgtccgtgatcctgttcacggccacgacgatcttcgtgtcggtctacgggatcgacctgctgcgcgtcctgatcgtgttgggatatctcaccgcgcatcaggcgggatatctcctcggcgcctatctcaccggctaccccgagaacggtcgggggcggtga

SEQ ID NO: 6135 - DNA, 1260 bp, Methylobacterium sp.
atgacggaccggtacggggattccctttctcgccgcagcctcctgcgcgccggcggcgcggcgctcctcgcgccggccctcgcgagcccggcgctctcccagggacagtccgaggtgatccggatcggtcacctcacgccgcggaccggcttcctcgggccgctcggcgagttcgccgtgcaggcggcccagctcgcggtggaggagatcaatgccgcgggcggcatcgcgggccggaaggtcgagctgctgtcggaggacagcgtcaacccgcagaccgcctcggccaaggccgagcgcatggtccagcgcgaccgcgtggcgtgcctcgtcggcgagatcaactcggcctcggcgctggcgatcagccaggtcgcccagcgggagaagatcctgttcatcaacaccggcgccaactcggacgcgctacgcggctccgactgcaagcgcttcatgttccacgtcgagtcgcagaacaccatgatggtgcgggcctgcggccgggcgctgctcgaccggggcctgatcaaggggcggaaggtttacgcgctcaccgccgactacgccttcggccacgatcttctgaagcaggccaagaagtacttcgccgccaacgacgccaccctcgtcggcgaggatctgatcccgaccgagctcaccgatttctcgccgttcctgctcaagctccgtcaggccaagccggacctcgtgatctgcaacctcgcgggggcgcagatcaccaactttctcaagcagtacagcgagttcggcctgccgttcccggtcgccggcttcggcttcgacacggcgctggcctggggcgccgggcccggcaacttcctcggcacgtggccggtgatctggcaccaccagatcgattcgccctcggcgaagaagttcgtcgccgccttcaaggccaagtacaagaagccgccggagaaccagggctggggcgactacacggcgatgaagatcgtcgcgcaatcgatgaacgagctcaaatcgaccgagtcgatcaaggtcgtggagcacctggaatcgggcgcgaagttcgacatcgccaaggtccgcgagggctatttccgcccctgggaccacgagctgatgcaggagatgttcgcgatcaccgccctgccggcggatcaggtcaagaacccctacgacatcttcacctcgactggcccgctgcccggccccggcgagagcctggaagtgctcgccacgacccgcgacgagaacgcctgcaccttcccggcgtga

SEQ ID NO: 6136 - DNA, 876 bp, Methylobacterium sp.
atgcagctcgtcttcatcctggagcaggtgctcaacggcctgctgatcggcgtgcagtacctgctgatcgcgctgggcctgtcgctgatcttcagcctcggcgggatcgtgaacctcgcccacggcgccttctacgcgatcggcgcctacatgaccgtgctgctgacgccgaccatcggcttcggcggcgccctcatcgcctcgccgctcgcggtggcggtgctcggcctcctgatcgagcggttcctgctccggcgcttctaccgcggcgacccgacgctcggcctgctcctcaccttcgggctcgcgatggtggcggagcaggcgctgcgcatggccttcggggcggctccggtgcccttcgggatcccgccctggctgcgcgggcaggtcttcatcggcgacctgatctactcgcgctaccggctctcgatcctcgtcgtggcgctcgcctgcgtcgccggcctgtggctgctcctgacccgcaccagcttcgggcgggtggtccgtgccggcgtgcagaaccccgacatggtcgcggcgctgggcatctcgctccggccctacatgaccgcggtggtgacgatcgcggtcgggctcgcggcgctggccgggaccatgatggcgccggtcacgggcgtgcagcccgccatgggcgccgagatcctgaccttcgccttcgtggtggtggtgatcggcggtctgggctccttctggggcgtggtgctcgccgcgctgatcgtcggcgtggtccggggcctcaccgcctacgcctacccgccggccaccgaggccgccgtctacgccctcatggtgctggtcctgctgctgcgcccgcgcggcctgttcggcgagcacatcgcccggttcgagtga

SEQ ID NO: 6137 - DNA, 3168 bp, Methylobacterium sp.
atgccgatcgaggttgaggggccggacggcgcaatcaacgagttcccggacggcaccccggacgccgtcatctcgaaggcgatgcagtccgtctacggcgccccgaaggccgccccggcgacgacgggtgggctcggcgatctggtcgccgtggcgctgtcgcgcgccgagagcgcggccggcgggctcgtcgagcgcgcggccgagaaggtcgggctcgggcccaagggtccgtccccgtaccagcagtcgtcggacctggacgcccagatgcgcggcgtgccggccgccccggtcacgtccaagccccaggagggcggcgagcggcgctccggcgcgctggccggtctgttcggcgtggccgaccagggcgtgcgcggcgtcgcccagggcgcggcgaccatggccggcctgccggtcgacctgacgaccatggtgctcaacctgacgcccggcgtggcccagctccggaccgcgctcggcctcacgccgaacatctcgaagcccttcctgggctcggacttcaacaagagcgcgctcgacaccgcgaacgacgcgacgatcggcgggatcaacgcggccacgggcgccaacctcgacctgccggtgcgtgagggcgccaacgtgttcgagcgcgccgccaaccgggtcgggcaggagattggcggcgccgcgctcccggcgggcgcggcgatcggcaaggccgcccaggtcggcatggagggcgcgcgggcgatccagaacccgatcgcccggcacttcgtcgagcaggccgccgcgaacccctcgaagttcctgggccgcgaggtcggcgcggccggcgtggccggcgcgggtgcggccggcgtgaacgagctgacgcgcgcggccggtgtcgacgagcacggggttgggcacgcagccggcgatctggccggcgcgctcggcgccctgggcctctacgggatcggcagccacgcgatcagcaaggtcggcgacgtgtacggcgcgatcaccggcagcgatcggttcgccaatcaggtcgtgcgggacgcggtcgttgaccggctcgccacggcttcgggcgcgcccactgtgccggtcggcaagcgcgacgtgttcgacatgtcggacatcgtgtccgcgatcgagcgcggccgggccaacccgatcagcgacacggtccccggctaccaggacaccctggccgacgtgacccgcaacccgggcatcgccgcgacggagtacggccgccgcacctccggcagcccgaccctggcgcagcgcggcgtggagaacgagcaggccgtcaactcggcgatcgacagcctcgcccccgagggcaacgccggggcgctgcgcgaggtcctcgccggctggcgcgagcagctccagacaggcgcgagcgccgaggcccaggccgcccaggcccggttcgaggaagcggccagccgcctccaggcgcagatgcacccggacgcccggggccaggacatccgcgccgccctggaggacgcgaaggccgccgcgcgcgagctggagcgctcccattgggtcggcgtgtcgaccggggacgcggacatccgcccgctggtcgacgccttcgggaatgttcgcagcggcctcacccagaccgcccgggacctgttcgacccgtcgcacctcaccgggatcccgcagcggttcgtcccggccgaagccggcgccgcggccgatggggccggagcggccggccgggcggccatggatgggctcgacccgtccgagcgcgccatggccgaacggctgctgggcgaccgcccggccccggccggcgcggctgcccccgagcccgagcccgtgctggtccccctgcgcgagacggccgacctgcgctcggccctcgcggccgagcaccggggcgccctgtccacctctaaccccgtgcgtgcgcgcgtgatcgagcagtacatctcggcgctggacgactacgcccggcaggccaacccgaacgtcgaggcctacgacgcagcccgggacttctctcgccagctcaacgaccgcttcacccggccgcagacggacgtggcccaggtgctcgaccgcaatcagggcgtctaccgccagtccgacgcgagcgtcccgggccggttcgcgcgccccgacaccgccgaccagggcggcttcgaggcgctgatgcgcgaggccggcaccgacccgcgggcccgcaacgccgtggccgaccagatccgcgaggccgcgtcggccgcgcagacgccggaggccgcgacccggttcatggaggagcatagccgcgtgctcgaccagttcccggagctgcggacccagctcgaaacgcgcgcccggacgcagcggtcggccaacctcgcggaggagcgccgggccggcctggagcgcgagctgggcacggaaaacacgcgcggcagctcggccgtgggccagtacctccactatggcaccgagcagaccagccgggcgatccagggcgtcttctcggccgccaagcccgccgaggccgcgcgcgagctgctcgacttcgccggccgggagaagggcgcggtcgacggcatgcgccgggcgatttgggaggaagcggagcgcgtcggccggcggaagggcgagacgaccgcctcgaccgatggcgtgcagccgtggatgcccgggaagctcaaggcgttcgtggacaagcccaacgtgcgcgccgtgctccaggaggcctaccgggacgagcccgagcacctcgcgaacctcgacaagctcgccgaggtgctccagcacaccaacgtcggggcgcgcgggaaggcgccgaacagctccggcacggcgcagggcatgatggacacgatcagggcttccgtgtcgcccgagagcatccagagcggcgtcatgtcggtcaagcgcggccagatcggcgtgccgtggttcgtcacgtcgatcgccgcgcggctcgcccgcaacagcgtcaaggccgcccaggccggcgcgatcaaccgcatgctcgacgaggccctggtcaatccggaggcagccgccgcgctgctgcgcgagaacaatccggtcaaccgtgcctacctctcgcgcagctcgaagctgtgggggattgagcacgccgaccagatcgccagcgcgctcaacgacaacgaggagcccgatccggtgaaggacgcgctcaagaggagccggcggtga

SEQ ID NO: 6138 - DNA, 288 bp, Methylobacterium sp.
atgcacatcggacgcgtggcgggcgcgacccgcaacctcggagcgccgcgggactgggacccggcgaaggacggcatctgcggcggcctgccgatccgcgacgagccgcacagcccgggcgtgaaccgcatggtctcggcgtggctgccgacgccggaggagatcgcgctcatcgctgccggcgccccgatctacctcggcgtgctcggcatcgagcacccgcccgtctcgctgttcgtcggcaacccgccggcggacgatgccgcccagccggaggagcggtcatga

SEQ ID NO: 6139 - DNA, 258 bp, Methylobacterium sp.
atgtcaggaaccgaggacgatccagggattccgggctccgccggcgcggcggacccggccggaccgggcgccgcggccccgtcacgcccggtgccggtcggcggacccggccggccgatcgacgacggcgcgcgggaccggatcgggcgcggcctgcgcctgcactacgcgggcgtcctggccctgccgatcccggaccggctccgggcgctgctcgacgagctcgccgcacactccgacacggaggcctcgcgatga

SEQ ID NO: 6140 - DNA, 948 bp, Methylobacterium sp.
atgcgcgtcctcgtcaccggagcgggagactatctcggccgccgcctgctcgaggcgctgcgtcgggacctgccggcgggcagccccatcctcggcctcgaccggagtccgccaccgcccctcgacggcgtggcgctgaaggccgtggacccgttcgacgcgcgcgacctcgccgagacggtcgcggccttcgaccccacctgcgtgttccacctcgcggcgctggcctcggtggcgcagtcgagcgagacgccgtcctacgcctggcgggcggaactgctcggcaccctcaacctcgccgaggcggtggcgcggacccgcgcggcgctggtcttcctcagctccaccgtcgtctacggcgaggtgttccgcgcgtgcccgcgcccggacgagagcgtcacgccgcgccccgacacgatctcgggccggaccaagaacgcctgcgagtacatcctgcgcgacgtgctggcgaatgcccggatcaagcatctcgtgctgcggccgtcgaactacatcggggccgggcagagcgagaccttcgtggtcgcctccttcgccggtcagatcgcccgcatcgagcgggggctggcgccgccgagcctggaggtcggcgacctctcggcggggcgcgatttcttcgacgtggccgacttcaccgcggcgtgcctgcgcgtgatcgcccggatcgacgacctgccggacggcggcatcttcaacgtgggatcgggtgtcgtcacaccggtctccgacatcctggagacgctgcgcggcctgacggacgcgcggttcgacctgcgcgtcgcgcccggccgggtccgcccggcgggcgtgcgcagcgagggctgcgaccccgcggccttcgggaccgccaccggatgggccccgaccatcccgctcgcgcggagcctagcgacgatcctggcggaggcacgggcgcgcctcgggtga

SEQ ID NO: 6141 - DNA, 213 bp, Methylobacterium sp.
gtgctcctggtcgaggaggagcgcccccgctggttcggccgcggctccggcaagccgcgctggcgcaacgccaagctcctggatttcgccgagcccgagctgcggccgctcatggcgatggagaagcagcatcgcgccggcggcgtgaccggccaggtccggacgctccgcccggtcccgtccgcgccggcggcgcgcgccgcgaacggctga

SEQ ID NO: 6142 - DNA, 195 bp, Methylobacterium sp.
atgtccgagacccgccccccgtacgatcccgagagctacgccgcggccgcggcggccctcctcggcctcaccctggaccccgcgtggatcgccccggtgaccgcgaatctgcgcgtcctggccgcggcggccgagctggtggaggccttcccgctcgccgacgagatcgacgcagccccgaggttcgaagcgtga

SEQ ID NO: 6143 - DNA, 462 bp, Methylobacterium sp.
gtggacgtgaccgcggaccagaccctcgcgcaggacttgctgaaggatctgcgcgaggcccaagccaagctggacgcggcgcgcgcggaagcggcctcgctcaaggtgctgctcgcgctgcgcacgcatcagcacgaccaggcctggcaggaggggcagcgcctcgccgcggcgctcgcggaggcgcagacccgcgcggagtcggccacgaccgcgcgggcggagacgcaggcgaacgcggccgcgtccgaagccgccgcgatggccgacgagcgcaccgaggcggtccggaccgtcctgggcgcggtcctcgccagcatcgggcctcgcgccctcgaccggcggcgcttccaggacctgatcgcccgggccggccgcgaggcaccggatcagggtccgggcgcggcccggcacgccgtgctgctgaccgaggcgcgacgggtgctggggatcgcccagtag

SEQ ID NO: 6144 - DNA, 687 bp, Methylobacterium sp.
gtgactgaatccggtcccgcggcacccgtccggccgcgcgccgggcaggccctgcgctggctctgcgcccaggcgctgctgcaggccggcgccgtcgtcgccggcttcgcctgcttcgtgctgctgttccagacggatctgtggtccggcgtgacgatcctgttctaccgcggactgatcctgctcgcggtcgcattcctgctgaccctgacgattacggcggcgctgaccgggctcggccgggcctggggattgcgccggcgggacgccctcggcgcctgcgtcctgtcgctgtccctgaacctcagcgccttcgtgatcctgccggtgacggtcgaccggtcgatcagcgtgttcctgctcggccagatggctgcccatcccggggagcgcttcacgcctgagcgggcgcgggcggtgttcgagcgggtctatctcggcgagttccggcagatggagcggcgcctcgccgagcagcaggcctccggcaacgtcgcgcgagcgggcgacggctacgtcatcaccccgcagggcagcgccttcatccgcttctgcggcctggtcgcccgggcgttccggaccgacacccggatgatcgccgccgcaccgtccccgcccggcggggacgacgcggaagcgcccgccggggcccctgaacccggtcccgcgggcgcggtgcggcggtag

SEQ ID NO: 6145 - DNA, 237 bp, Methylobacterium sp.
atgcctggacgcccgcggcgacgccacacgaccttcctcgtctccgtcaccgcggagggcgccggcgcggcgcccggcgccacggtctacgcggtgatgaagcccagtgccgaggaggcgctggaggccgtccgcgccctcgccgatccgtcggccagcctcgcgatcgtggggagcctgtccacccggatcgccaaggccctcaagctgaagcccgacacgccgcgggtggtctga

SEQ ID NO: 6146 - DNA, 693 bp, Methylobacterium sp.
ttggactttgcgggcggcggcagcgcctcggcggcggagctgcgcaggccgcgctcgctcgccgagaccgcctacgacgccatcgagcagatgattatcagccgccgtctcgcgcccggcgcgatggtctccgagggcgaactcggcgcggagctgggcctcggccggaccccggtccgcgaggccctggcgcggctgaagacgatcgggttcgtggaggtccacccgcgccgcggcgtcctcgtcacccaggtcgacatcatcaggcacctcgagctgctggaggtgcggcggcccctcgacgagaccgtggcccgctgcgccatcgcgcggggaaccgagaacgacatggctcggctgctggaccgcgttggcgggctgcgccgcaccgcggaggcccgtgaccgggaagcttatttccgacacaagcgcgccctgcacgaagggctggtcggcgccgcctacaacccgacgctcgccggcaccatggcggcgctgcacgcgcagtcgcgacggttctggtacacctacgagccgaccgcgagcttcccggactgcgcggcgatccacgcggcaatcgtgtcgggcatcgcggcgcgcgacgcgggggcggcccttgccgggatcgggacgctgttcgactttctcgaccggatgacacgccgggccctcgaccggcgcccgctggtctga

SEQ ID NO: 6147 - DNA, 519 bp, Methylobacterium sp.
atgaacgcgacgttctgggcccagctcgacgcccgcatcgcgcgtgagcgcggagaaccgacggagccggctccggggatcgccgacggcccccgcatggccgacgcgccgagcccggcggcgcgttccgaagcgtcccccgaaatcgacccggagacgccgtcgcggccggtggcggactggagccagatcctcgacacgctgtcggccgcgagcgtcgcgaagcaggcgcaggatcagcgcctgcgccagcaatcgaccgcctgcgagacgctggccgcggatctggaggccgcccagcagaagatccggaccctgagggcgctcctggaggaggcgcgggcgcaggcggcacggcaggtccacgaacgcgaggcggaagccgaccggcgcgtccgggaggccgaggcgcgggccgaggccgcgaccctgcgggcggcggcggccgaggactggctcaaacggatcgagcaggcgagccgggatctgctgccagacgggcggcacgcggccgcctga

SEQ ID NO: 6148 - DNA, 552 bp, Methylobacterium sp.
atggaacagacgaagcaccccaaggccgaggcgctggaccagatcgatgccgtcgcgcgcgacgcccgcgagccgacgacccggatccgcaccggcaacctcgtcctgctcgccgccgacgagcgcgtctcggcgcaggggcgcaaccagaacccgtcgccggtcgagcggtggcccgacctgctggagcgagtgcagggcgcggcgcgctacatccgggacgtcgaggaccgggcgcaggagcaggagacgcacgtccaggacctgctgcggcaggtgcgcgccgacatggacgcggcccgcgcccaggtgctggcggccgagcgggagacccacgaggtccacgcgcaggcgatcaagctgatccaggccgccgaggaccgggccgcggccgccgaggagcgggccgcggcggcggagcagatgctccagcgcatcgccgagacgatcgacgcggaattcgtgatgcagccgggcggacaggtggccggacaggcgggcagcacccaggacgcccgcgcccgggcttccgcgacgcgggcggcttcgtga

SEQ ID NO: 6149 - DNA, 996 bp, Methylobacterium sp.
atgtccacgaacccgcgatcgtcgctgcgcgactggcagccgccgcccgcctacaacgtcgccgccaccctgctggcgctggcggcggccgtgggcctcgcctacctcgccttcctctactacgcctacacgccctggacccgggacgggcgcgtgcgcgtctacaccgtgcaggtggcgcccgaggtctccggcacggtggtggcggtccgcgtccgcgacaaccagttcgtccgcaagggcgacgtgctgttcacgatcgaccccggcacgttcaggaacgccgtgacccaggccgagggcgccctcgccagcgcccgggcgcgggccgggtacctcgcggggatcgcacagcgcaccgccgatctcgacgacctcgccaccacgccgcagcagaagcagacgaccagcggccaagcgcaggccgcccaggccgacgtggtccaggcggagggcgcgctggcgcaggcgcggctcaacctggagcgcacgaccctgcgggcaaccgtgaacggctgggtcaccaacctgctgctgcaggagggcgggttcgccgccacggggcagccggcgctgacgctggtcaacggcgacagcttctggatcgagggctatttcgaggagacgcagctcccgcgcatcggcgcgggcgacgccgcgcgcgtgtcgctgatggcgtggccggaccgtccgatccgggggcgcgtcaccggcctcggccgcgggatcagcgtcgccgacgccgccccgggcgtccaggggctgccgacggtcaacccgatcttcacctgggtccggctggcgcagcgggttccgatccggatcgacctcgacgacgtgccctgcccgatcgtgctggcggccgggatgacggcgaacgtcgcgatcctggccgagaaggccgggtcgccggacgccctgccgcccgaccggcgcacgggcgcggccgccggccagcgctgcgacggggcgccggtcgtggagtcgcggcgctga

SEQ ID NO: 6150 - DNA, 168 bp, Methylobacterium sp.
atgccccgctggctcttcatcctcctcgcgaccgccctcgccctctcggtcctcggcagcgtcctgatcgtgctgcgcagcccgaacagcacgccgcccctgcggggcgccgccgccggcgccccggtgccgggcccgcaggcgcggcccgacagccggagcccgtga

SEQ ID NO: 6151 - DNA, 408 bp, Methylobacterium sp.
atgatcgccgaacgggtagcgctcgctggtgcgctcctcctgctgagcatcacgcccgcggtcccccagctgcgccgtccgatgacgtgtacggtggaggcgtcgaccagtctcgatgtcgcagcacccgaaggcgccaaaccgcaatcccagaaggcccgcacattctcgctggtctccagcggcggcctgctgaccgtgatctcggccgggcgctccgactattacgagtgccagacggcctcgccgcggctgaacgagcgcacgccgcgcaacgcgatcaagtgtcagaacggcgtctacttccttctgatcgacctcaacaagatgaacttcgtcgaggcgcagctcaatcccgaggagcgcaacgacgtcaaggtcagctacgggaattgtcggaccctgtag

SEQ ID NO: 6152 - DNA, 138 bp, Methylobacterium sp.
gtgaccctcagcctcgtcctcagcacgtcccttccgctcctcaccggggcggtggccctgctgtgggcggggttcgtcgctccggagcgggaggagcgtccggacgtgcccggcgcccgcgacctgcgcacgtggtga

SEQ ID NO: 6153 - DNA, 498 bp, Methylobacterium sp.
atgagcgccgcccgcgcgtgggccgagccggcggcgccccatcccctgtccgacccggccctgccgcgcgacggccacgccgacccgatcgaccgggtcgtggcgctgttctccggcgccgcggccgcatcccccgcgcccgcctccccggcggccgaggatgactggtcgacctccctgaccgccgtgcgcggcgccgcggcgcgggtccgcgccctgcaggcgagcgcccgcgactccgtccgggaggctcagagttccgtgcgggcggccgagacggcactccgcgcggcggaggagcgggcccgccacgccgaggcgctcctgcaggcggcgctcgcccgggccgagcgggccgaggcgcaggcccgcgcgtcggacgagcgggccgaacgggcggaggcccagcgggccgaggcgcgggcgtggctgcgccggatgcacgaatgcatggtcaacgagttcggcgccctgtccggagcggcggatcagccctga

SEQ ID NO: 6154 - DNA, 354 bp, Methylobacterium sp.
atggttgttctgcaggagatcgcgatggccgggaaccgcatggacgaggcctggaggccggccttcaagaccggacagatcttcttcgggcacccgcaggaatgctgtgactgcctgatctgggagctcaggacatccggcgcgcggatcgaggtccagccggaggctgtgccaccgcacgccgtccggctcgtctcgatcgccctgctgctgaaccaggcctgcgaggtcgtcgcgcgcgagggtcggacgatcgaactgaggttctctccccgtccggagcccgcgggcggtgcgcccggcgcgacgcggcccgtgctcggccgcacgcggttcccgccgcaccggccataa

SEQ ID NO: 6155 - DNA, 480 bp, Methylobacterium sp.
atgaacgagtcagtcacgctccggcgcggtgcgcccgcggacgcggacgtgatccgggcgctggtggagacggcctacaccaagtggatcccggtgatcggccgcctgccgatccccatgcgggcggactacgcgcaggctctgcgggaccaccgcttcgacctgctgctggccggcccggatctcgccggcctgatcgagacgcggaccgaggccgatcacctgctggtcgtcaacgtcgcggtgcacccggccttccagggccggggcttcggcagccggctgatgggacgggccgacgcggtcgcggccgagaccggactggcgcgactgcgcctctacaccaacaggaagtacacggcgaacctgcgcctctacggggcactcggctaccgtgtggagcgggaggagccctacgacggaccgggccggacccgcgacgacgacgtcaccgtgcacatggtgaaggacctggtttga

SEQ ID NO: 6156 - DNA, 459 bp, Methylobacterium sp.
atgcacatcgtcatcgagtcgaattgccgattcgacgtcggtgaggacgtgcggctgtcgatggccaacatctatatcggccccggctcggtgctgcgcatcggcgaccggaccggcttcaccggcctcgtacatctcaaccccgtcgagggaaaggtgatcgagatcggcacggactgctcgatcgcgtctggcgtctggatgacgacgagtgacttccactctattgtcacccgggacagcggcgcgcggctcaacccagccaaacccgtccgggtcggcaaccacgtctggattgccaatcaggccacgctcctcaagggcacggtcatcggcgacaacgcgatcgtcggcgcgcacgccgtcgtcaccgggacggtgccggcccactgcgtggccgccggcaaccccgcgcggatcatgcgggagaacgtgacgtggcggtccgacctgatctga

SEQ ID NO: 6157 - DNA, 1005 bp, Methylobacterium sp.
gtgagcggcgccgccgacgggacgcccgggccggggctcgcgggcgcccgctgcctcgtgctgggcggcggcgggttcctcgggctgaacctgtgcaaccgccttgcggcggcgggcgccgaggtcacgtgcttcagccgcagccacccgcaggccgaggtcctggaccggcgcgtcgcccgggtgtccggtcagttctccgaccgcctcgccctcgccaacgcggtggagcggcaggacgtcgtcttccacctgatcgccggctcgatccccgagagttccaaccgcgacccgtcggcggagctctcggcggcgccgatcgccacgctgcacctcttggagatctgccgttcggcccggatcgggaagctcgtgttcgcgtcctccgggggcgcgatttacgggatcccggccgccatcccgatccccgagcaagcgccgaccaacccgatctcggcctacggcatcagcaagctgatgatcgagaagtcgctccacctctaccggcaccttcacgggatcgactaccagatcctgcggatcgccaacccgtacggccgcttccagctcggcaccaagcaccagggcctgatcggcagctacatccaccgcgtcctcaccgaccagccgctggaggtctggggaaccggcgcggcggtgcgcgacttcctgcatatcgacgacgtcagcgacgctttcctgggggccgtcggctaccgggggccgcacaaggtgctgaatgtcggcagcggccagggcctgagcgtcaacgaggtcatcgccgagctgaaggcggccttcggtcgggaccacctcacctgcgtgcaccggccgagccgcgccgccgacgtgccggccaacgtgctcgacaccgcgctgatccgggcggagctcggctggcagccccgcgtccccctgcaggcggggctcaccgggaccattgcgtggatgcgcgttcatctggcccagtcgtgggcggcgggcgcgccctccggcgccggctga

SEQ ID NO: 6158 - DNA, 2406 bp, Methylobacterium sp.
atgcaggacggtgcaggcgcgagcgcgccgggctcgaccacggctccgcccgcgctcgagccgtggcaggacgacttcgccaccatctacgccagcggactgttcgaccatatcggctacgcgacgcgctatcccgatgtcggcctgaccgacctgtcgcccctggagcactacgtgaagtacggtgcccggctcgggcgctggccccgggccgacttcaccgcgccgccggacgagaccttcgacggcagcttcgtcaatcccttcgtggcctggatccaggcgcgcgccgagacccagcccgcgccggcctggaaccggccagtcgtctcggtcctgtgcatcagctacaatcaggcggccttcatccggcagacgctggagagcatcctcggccaagccacggacttccccttcgagctgctggtcggcgacgaccgctccacggacgggaccgccgagatcatcgccgagtacgccgcgcgccaccccaacctcgtggcggtcctgcgcagcgagaatctcgggccgaaccggaacttcgccgacctcacggcgcgcgcccgcggcgagttcgtggcgatctgcgagggcgacgattactggaccgacccgcgcaagctccagcggcaggtcgatttcctgcgggcgcgcccggaattcaccctctgcttccaccgggtgcgcgtcgtctacgaggacatgccgggggtcgacgagctctacccgaagcagtgcagcccgcagccgtcgctgtcggatctcgtggcgcacaacttcgtccagaccaacagcgtgctctaccgctggcgctaccacggcgaggaggcgttcgtgttcgacgagggcatcgcccccggcgactggtacgtccacctgatgcacgccgaggtcgggcgcgtcggcttcctgccggaggtgatggcggtctaccgtaagcacgccgccgggatgtgggcgacctacgcgaccgagctcgcccgccacaagaagctcggcaactccgagatcgcgttcttccgcaagctgcgcggccacttcggcggccgctacgcggcgggctacgaggccgcgcagaagtcgatcttccggcggctggccgaggcctacctcgacgaggaggacgtgccgagcctcgggcgcctgatcgaggccaaccccgacatcgcccgggacgccttgagcgacttgggcctcgacgcccccgaggtgctcaccggcgaccccgacgccctgcgcgcgtggctcatggagcagctcacggtcagcgtcatcgtcacggcctacaaccaagccgccgatatcggccgctgcctcgacgcggtgctgggccagcgcgggctgttccggctgcaggtcgtgatcggcgacgacaagtccaccgacggcaccgcggagatcgtcgagcgctaccgggcgcgcgacccggagcggatcgcggtgcggccccggccgcacaatctcggcatgctgcgcaacatgcaggactgcctcgccgcctgcacgggccggtacatcgccttctgcgaggcggacgattactggctgtcggaccgcaaggtcgccatgcagatgcggatgctgcgcaacgaccgcaagctcgacatgtgcttcaactgggtgctgctccactacccggcgaccggctcctacgtcccgcacgacgagcagggccgctatccgaccggcccgatcagcttcccggtcctggccaactcgccgctcaccgcgaacttctcgtgctgcttctaccgcgccgaggccctgcgccgggtgccggaggcctactacgcgaacgcctcggcggccgactggctgatgaacctctacgtcgccgacaagggccggatcgcgttcctgcgggagctgctctcggtctacacggtccaggagaagggccagtggtcgggcctgccggaagacatcaagaacgcccggatcgcgcagtaccagaaggagttcgccgccatcttcggcgaggggcgcggcttcgagaagtacgaggtcggttgcacggtggccgagctcgacggcgagctgccggattccttcgcccgcgcgaacctggaggccccccaggaccgggtctgggccgagatccaggacgggcaggtggtgctggccggctgggtcgtctcggcgagccgcgccaaggcgacgctgatcgtggaggccgacggcgaggtccagcgcattcccgcggacgtccaccggccggacgtgatcgcggcggtgctgggcgacatgccgaccacgatggaggaggcgcgctgcggcttccgcttcaccctcccctacgcgctccatctcgaggtgctgctctccatcgaggtcgagcacgaggtcgtgccctggctctcggtgatcttcacccaccgggtgaagcgggcggccgagcggggctga

SEQ ID NO: 6159 - DNA, 1194 bp, Methylobacterium sp.
atgcaccgggccgaggtgctgatgcggctgcggcgccggctccggccgcgccacaccaccctggtcagcttcgccgccaagtaccactacgtcgagagccagcgccggctggtggcctcggccgccgccacgggcaatttcgacacgatcgagagctggtcccccgaccggctgcgcgagacgccgttctaccgggagcaccgggagatcctcgaccggtcccggggcgccggcaactgggcctggaagccctacgtcatcgccgaggcgctggagaagcgccgcgacggcgacttcgtcgtcttcagcgacaccggcatgcaggcggtcggcgacgacccgctgccgccggtggcgccgctgctcacatggctcgacggctcggagcgccgggtcgcggtcggcgtgctgcacggcaagccgcagcgggcctggaccaagcgcgactgcttcgtgctgatggagtgcgacgcggcgcgctactgggacgccgaccagatccaggcctcctggatcgccttcatggtgagccccgccacccgccggctcgtggccgagtggctgcgctacgccggcgacgcgcgggtcgtcaccgacatcccgaaccagatgggcctgccggatctcgagggcttcatcgaccaccgcttcgaccagagcatcctgtcgaacctgatctacaagctcgacctggagatcccgcacctgcgccagccgtccaagcagatccggacgctgatcgacgagatggagatggacacgctggtggcgacgcggccctccgagaacatcgcgctcggcaagacctggacggcgagctccgcctcgccctggtcgggaacaaccggcacctacggcgcgcgcaccaccggcgacccgtccttcttcttccacaccgggctcgaccggaacccctggttcgtcctcgacctcggcgcggtcgagcgggtctcggagatccggatctacaaccggtgggggcagctcagcgagcgagcgcagctgatgcgggtctggctaggtgagaccgagagcgactaccacctcgtcttcgacgccgtggatgcccactgccatcccggcctgcccctccacctgcggttcgacaacgcgcggttccgctacctcaagatcgatctcgacgaggagcagcacctgcacctcgacgggatcgaggtcttcgcggcgcgctga

SEQ ID NO: 6160 - DNA, 189 bp, Methylobacterium sp.
gtggcaaacgagtctgtcgaacaggcggcagagaagacctatttcggcctgaccctctcgcagcacgcggaccggatccggaagctcgcgaccgagcggggcctgaccggggagacgttcgaccgcgtgaccgcgcaggccgtggcgatgatcccgaccatcaaggtgaccgacgccgcccagcggtga

SEQ ID NO: 6161 - DNA, 387 bp, Methylobacterium sp.
atgaacccgaccgtcaaggccgtgctgctgaacgaacgggcctctgtgctctcggcgatcgcggcgcgtcagggcaccgtctccgacctcctcgtgcagatcaacggcgtcgagaacgatatctggcggctgcgccaccgcctcatcgatatcgaggcgtacctggtcgggcatcgcgtcgagctgccggatctcggcgaagggcagacggagactgcggacgggacggacgttctcgttccgcgcaatgcgccgcaggccgcgacccggtcggtcgaggtgatcggcctgccgacctgcaagcccctcggcgatttcgtccgcccgaagacgtccgcgcggaaggcccaggcggccgcggggccccgccaggtcgagaccgcctga

SEQ ID NO: 6162 - DNA, 762 bp, Methylobacterium sp.
gtgatcgccctgtcggccatcgagaagcgcttcggcgacaacccggtcctgcggggcgtcgacctcgcggtgccggaggggcgggtcacggcgctgatcggcccgtcgggctcgggcaagtcgacgctcctgcgctgcgcgaacctgctggaggtcccgcaggccgggtcgctgaccctcggcgagatccgcctcaccttccggcccggcagcccgccggcgcggcgggacgtgctcgccgtgcgccggcagaccggcatggtgttccagaacttccagctcttcccccaccgcaccgtgatggagaacgtcaccgaggggctcgtcaccgtcggcaagtggccgcaggaccgtgcgcgggcgcgcgccctcgagctgctggagcgcgtcggcctcgcccacaaggccgcggactggcccgccagcctgtcgggcggccagcagcagcgggtggcgatcgcccgggcgctggccccctccccgcgcctgctgctctgcgacgagccgacctcggccctcgacccggaactcgccgccgaggttgtggacgtgctcgccggcctcgcgagcgagggcacgaccatgctgatggcgacccacgacctgcgcctcgcgcggcgcgtcgccgacacggtggtgttcctggaagggggacagatcgtcgagcagggcgcggccgccgacgtcttcgcccggccggccgacccgcgcacccgccggttcgtccggacgctgctcggcgaggcggccgaaggggcgtga

SEQ ID NO: 6163 - DNA, 219 bp, Methylobacterium sp.
atgccccgaccgtttgagccctacgccgacgcgctgcgcaccgcccgcgagatcgtgcgcgagcaggcggggaccgtcgtcgaggcggcggtccgcgcggattcccacgcctacgacgaggcctgccacgtcctcgtggtccggatcgcgcaggccatcgtcgatgccggcgaggccgggtcgggacacggcctcggccgcggcagcgaggccgcctga

SEQ ID NO: 6164 - DNA, 984 bp, Methylobacterium sp.
atggccttgaggaccagactcaccgacgccttcgggctgcggcaaccgatcgtgctggcccccatggacccggcctcggggggcgccctcgcggcggcggtgagcgccgccggcggcctcggcctgatcggcggcggctacggcgatcacgcgacgctcgaccgggaattcgcccgcgcgggcaatcagcgggtcggctgcggcttcatcacgtggtccatggcccgggacccgtcgctcctggacgcggcgctcgcccggtcgccggctgccctgatgctctccttcgcggatcccgcgcccttcgcggaccggatccgcgccgccggcgtgccgctgatctgccaggtgcacaccctggcgcatgcgaggcgtgccctggaggtcggcgcggccgtggtggtggcgcaggggacggaggccggcggccacggcctgaccgcccgcggcaccgcggcgttcgtgccggcggtcgccgacctgatcgcccgcgagcgccccgagacgctgctcctcgcggcaggcggcatcgcggacgggcgcggtctcgccgccgccctggcgctgggggccgacggtgtcctgatggggacgcggttctgggccagccgggaggcgctgatccacccggccgcgaagcagcgggttctcgccgccaccggcgacgacacgatccgcacgcaggtctacgacatcgcccgccagcgggcctggccggcgccctataccgggcggctcctgcgcaacaccttcatcgagacgtggcacggccgcgaggacgcgctgcgcgcggcctcgggcgatcggcgccgcgacgtggaggatgccgacgcggcgggcgactacgacgtcgccaacgtcacggtcggcgaggccgtggggctgatcgacgacctgccgggcgccggcgacctcgtcctgcgcatcgccgaggaggccgaggccgcgatccgccggatctccggcatggccgcggcgccgtga

SEQ ID NO: 6165 - DNA, 207 bp, Methylobacterium sp.
atgggtgcgacgggcgggcatctctacacggtcgaggtcaggccgagccggcatgatcccggccgcttcacctgggcgatccgcgaccgcggcaagctggtccgggggtcgtaccgcccgcacacctccgagcacgcggcgcgcgccgtcgcggaagccgaggtcgagcgcctgatcggccaggacggccggtccggcggcgcctag

SEQ ID NO: 6166 - DNA, 1287 bp, Methylobacterium sp.
atggaccgcacggtgaaccgcaccaacctcccgctctcgcgggagcggctctgggacagcctgatggagctcgcccggatcggcgcgctgcccaacggcggcaacgaccggcaggccctgaccgaccgcgacgccgaggggcgcgccctgttccagcgctggggcgaggcggcggggctcacgctcaccgtggaccgggtcggaaccatggtctttcaccggcccgggcgcgatccgggccggaagccggtcgccgtcggcagccacctcgacacccagcccaccgggggcaagttcgacgggccgctgggcgtcctcgccgggctggagatcatgcgcgccctgcaggaggccgggatcgagaccgaggcgccgctcctgctgatcaactggtgcaacgaggagggcgcgcgcttcgcgccgccgatgagcggcagcggcgtcgccatgggcatcgtcccggaggccgacatcctggcgacccgggacctcgcgggccacgccttcggcgacgagctgcggcgcatcggctgggaggggacggcggacccggccgccctgcgggagatcggcgcctatttcgagctccacatcgagcagggcaagcgcctggaggaggccggcctcgccatcggggtggtcgaccgggcgctcgcccagatctggtacgagatcaccgtgctgggcgaggaggcccatgccggcagccccatggcgggccggcgcgacgcgatgatggccgcggcggcgctgatcacgtcgctcgagggcatcgcggaggcggcggtcggcgcgggcgcggagcgcggccgcgccaccgtcggcgtgctgcgggcggagccggcgagccgcaacatcacgcccggccgggtctggttcagcctcgacacccgccacggcgacaccgcgcagctggaggcgatgggcgcgcggatccgggcccgggccgacgccctggcggcagagcgcggcgtcaccgtccaagtcgccgagttctggcgcgcgcccccgaccccgttcgacccggtcctggtggaccgcgtccaggcggcggccgaggcgcggggccatgcctggacgcggatgccgaccgcgatctaccacgacgccgtctactgcgcccgcgcggtgccggcggccctggtgttctgtccctgccacggcgggatcagccacaacgaggccgagagcatcacgccggcctgggccggggccggcctggaggttctggccgacgccgtgctggcgacggcgggcctcgccggcccccggaccgggccggaatga

SEQ ID NO: 6167 - DNA, 315 bp, Methylobacterium sp.
atggtgcgtatcggaacagtcagccgtctcggcccgacacaggtccgctccacccggcgcgcgccggtcccggacgcggacgcctcccccgagacggcgcggacggaggtccaggctctcgccctgatcgacgggggccggtccgatgagccgcccgccccccggacagcagaacgcgcggccgcggggagaccccgcgccggcttcatcgcgcagttgctgacggcgggtgatccgacgctgctgccgtcgcgcctggaacggacccggatggccgccgcgcgctacgcggaggccgcgcggcgcctcgcctga

SEQ ID NO: 6168 - DNA, 180 bp, Methylobacterium sp.
atggccgccacggacccgcgcgagaccgccaagatctacgatctgtccgcgttccgacgcgcgcgcgagaccgcccgggcggctccggaggcgaagcccgcgcccgtgccgagcttcggcgggggcgcttggtaccacgaggccgccatccgcgaggacgaacgcccgcggcggtcctga

SEQ ID NO: 6169 - DNA, 615 bp, Methylobacterium sp.
atgaaccggccgatcaacccggcgctgtatcgccggccgcgcagcgtcccggccctggtgctggtggacatgcagcaggaatacgagatcgcgggccgcccgctcgccctggcggggatcgagcccgctctgtcgaactgccggcgcgccctcgcgcatgcccgcgcgagcggcatgcaggtcgtctacgtccgctggatcggcgcgcccctgttccaggcgggcagccgcttcgtccgctggatcgaggggttcgagccgcacggctgcgacatgatcttcgaccgggaccgcccgtcctgctacgccagccccgccttcgcggacgcgatggagcggggatcgccgccgctcgtcatcgcgggcttcgccggcgagtcgtcctgcctcgcgacggcggtcgacggcttccaccgcggccaggacgtgaccttcctgtccgacgcctccgcaagccacgacctcgacggcatctccgccgacgtgatccaccgctcggtgagcgcggtgatgcgggtgttcggcgacgtcaccgacacgcaatcctggatcgcggccacggcgccgttcgagcccatgcccgcagcttcgagacccacgcacgccaatgactga

SEQ ID NO: 6170 - DNA, 216 bp, Methylobacterium sp.
atgactgaccgaagccagaatcacgggattccggacggggtcccggccggcgacgacgatgtggacctgcgcctcggccggcacgcgatcgagctgctgcaggcggcgcgcgaggccggcgagccgacgctgatcgcgcaggccgaggccatggcgatgacggtcggcttcgtgctggcgagccggctgccgggcggcacgccggagaccgcgtga

SEQ ID NO: 6171 - DNA, 180 bp, Methylobacterium sp.
atggacgccttcgatcacgccaatatcgcgcgcgatgccgacgaaaccgtcgattcgcctctcgaggatgagctcgtcgtgctgtggcgggcgctcgccgcggaccggcgcgcccaggacgagcggaccgcgcgcctgcgcgccatgcgcctcatcggcggcgaggacggcgccgactga

SEQ ID NO: 6172 - DNA, 228 bp, Methylobacterium sp.
atggcctcgaccctggaactggacggcctgaacgaactgcgcgacgcgctgatcgaggagcggcaggtcatcgtcgcgtcggtgcgcaagctgcgcgacgcgcggcggcagaagggcaccttcgtgctaggcgacggcgcggacgccggcccgcggctggtcgccgtgcaggagcagatcgtggtggtcgaatccatcatcgccgcgctgacgcgatcccgggcctga

SEQ ID NO: 6173 - DNA, 1023 bp, Methylobacterium sp.
atggcccaccggccgcccgacgacagcgcggacgcgcgacggcggaagttcctgcagagcttccagaatttcgacgcgaacagccggtttcccgcgccctacgcgcagttcgccgggaagccgctgaccgaggtgtccggtcagggctggcgctacgacgccctcgggtatcgcaacgacgcgcacgcggacgcgcggccgccctccgagacgctgcgggtcttcgtcgtcggcgacagcacgctgatcgacggccaggtcttcgccgacaccgtgcccggacggctggagaccgggctgaagcaggcgcacgggcccggcgcgcgagtctacaatttcggcgcggtctcggcctgcctcaaccagatgatcgccctgatcacgacgcggctgatggacctgcagcccgacgtcatcctggtggtcggcggcgcgaccgacatcttccagccttggagcttcgatccgcgggccggcgttccctacaatcacttcgcgaacgagagcctctacgactatttcttcgacccgaggaaatccgccgaggacgcggaggacctgtcgtatgacggcctgcaggcgatgatcttcaatcgcctcgagaacctgcgcgcgctcacgaactggcagtccgacatctgggaatgggagggggtgcggcagttcgagctggcgctcaggcgcctcgcgcggctcgcgcccgggatcggcgcgccggtgcgatttctcctgcagccgacggtcgtccgcaaggggacgctcgcgggcgcggaggccggcgccgcgtccggcgcgttcctcgcctatctcgaccgccagtacgagcgcttcgagagtgtcctcgggcggctggacacgaccgaccgggccttcgcggcgcgggacctgagccggctgttcgaggccgacacccgcgccctgttcaccgacatcgtccacgtgacttcggaggggcgccaagtgatggccgaccgtctccaggcggaggtggtcgagacggtcggggcggcgacggtcgcctga

SEQ ID NO: 6174 - DNA, 1113 bp, Methylobacterium sp.
atgccggccggaaatcgtgagaaggtccagatcctctatctacagcctgggacttccgtcttcgccggcatcgagcgagtggtcgacacgatcggcgcggaactcgcgcagaagtgcggcaccgagttcgccgtcgacgtgctgcgagtcacgcagcacgcgaactacccggcggaaccgcggcattacaggagcgtcttccggccggtcacatcgcgcctgcacctcctgcggatcttcagggatgtcagcaaaggaggccgctacgatctggtcatcgttccgcagatcgagccgaccgtcatcttctggctcgcccggttgggcatcccgcagcggatcacgatgcacctgcacggcaacccgcggcgcgaatccgccagcctgaaatcgaaggtcaaattcttcctcctgaagcattacatcctcccgcggatcgcttccgttttcggaacgtcgccgcggcagctccgcgcgttcgaggccgatttcaactgcagacggccaatgtactgggttcccaacccggtcagacatttcgaagtgtcggacgccgacatccggcccgaccccgccgtcatcaccttcgtgaatgtcggacgctacgccttccagaagggtcaggacctcctggtgcgcgcgttcgcgcgattgtacgagcggcgcaggaacgtgcggctcaacttggtcggccacgggtccgacaaagcggcgctggcggaacagattcaggcgctcggcctgtccgagatcgtccggctcgtccactgcccggacaatccgcaacgggcgctcttcgcgagtgacgtcttcgtcgcgacgtctcgatgggagggctggtcgctggcgatctgcgaagcccttcggtgcggactgcccgtcatttccaccgactgcgaattcggccccagcgacatcttggtcgaccgacgtctcgggcgcctgatcccacccgacgacgaggaagcgcttatagaatccatggagtattactgcgacaatatcgttgtagagagatcgttttcggagttcaggaagcaccacatcgaccagtacagtgccgaaaggatcgtgcacattcacgccgacgcgatccggcaatcggcatgctga

SEQ ID NO: 6175 - DNA, 1308 bp, Methylobacterium sp.
atgaggctgcttcggtcgatctacggccaggttctgctcggcatcgcgctgggcatcggcgtcggcgtggtcgcgcccgacttcgcggtgggctgcaagatcctcggcgacatgttcatcaacctgatcaagatgatcgtcgcccccgtcatcttctgcaccgtcgtggtcggcatcgcgcatgtcggcgacatgaagagcgtcggccggatgggcctgaagaccatcctgtacttcgaggtcgccacgacggtggcgctcgccgcgggcctcctgttcgtcaacctgctgcggccgggcgacggcgtgaacgccacggtcgacagcctcgacgccaagctcgtggccggcatcgccggcaaggcccacgcgcagtcgccgatggagatcgtcgccaacatcatcccgcacagcgcggtcgacgccttcgccaagggcgacctgatccaggtgatgttcttctcggtgctcgtcggcatgggtctggcgatgctaggccggcgcggcgagttccccctcaaggtggtccacgccttcggcgacgtgctgatgaaggtcgtcggcctgatcatgcacttcgcgccgatcggcgccttcggggcgatggccttcaccatcggcaagttcgggctcggcatcctcgcccagtacgggatgctgatcgtctccctctacctgaccttcatcgtgttcatcgccgtcttcctcggcggcgtgatgcgcttctacgtcggcctgagcctgtggaagctgttccgctacagccgcgaggagctgttcatcctgctcggcaccacgagctcggaatcggtgctgccgcggatcatggccaagctcaacggcctcggggtcgacaagagcgtcaccggcctcgtgatgcccgccggcctgtccttcaacatggacggctcgtgcatctacctgaccatggcgatcggcttcatcgcccaggccctcaacgtgccgctgacctgggagcaggagctcggcatcctcgccatcgcgctggtgacctcgaagggcgtcgcgggcgtggccggcgccatcctgttcgtgctcgccgcgacgctccaggcctcgcagctcctgccggtggcgggcatcgccctgatcatcggggtggaccgcatcctgaacgagctgcgctgcgtgaccaacgcggtcggcaacatggtggcgaccctcgtgatcgcccgctgggagggcaagatcgacctcgcccacgcccgggcggtgctcgacggccgcatcaccccgaacctcgacctcctcgacgacgaggacgaggtggcggacgcgatccccgcc

SEQ ID NO: 6176 - DNA, 1005 bp, Methylobacterium sp.
atgcgcagacgcgacgttctggccggggccgcggcgctcctggcgggccccgtcccggggcgggcccaggaggtcggcgccgtggcgatcgcccgccagccgagcctcggccacctgccgctgatgctgatggaggagcagggcctgctccagaaggccgcggccgcccgcggcgtggcggggctccaggcgcgctatctcaccctcgcgggcggcgcggcgatgaacgacgccctgctctccgggacgatccagttcgcggccggcggcgtgccgcccctcgtgctgctctggtcgaagaccgagggcaccgccatggcggtgaagggcgtggcggcgatgaacagcatgccgctcctgatgaacaccagcaatccgaaggtgcaccggctcgccgacttcaccgaccgggacaagatcgcgctccccgccgtgaaggtctcggtccaggcgatgttcctgcagatggccgccgagaaggaactcggcgcaggccgccgcaacgacctcgaccggctcaccgtcaccctctcgcatcccgacgggatggcggcgctcctcgggggcagcgaggtgacggcccacttcaccgccgcgccgatccaggagctggagctgcgccggcccggcatccgcacggtgctcaacagcttcgacgtgctgggcgagccctcgaccttcaacgtggtctgggcgtcctcggccttcgcgggcgccaacccccgggtcgtcgcggccttcggcgccgccctggacgacgcgctcgccgcgatcacggccgatccgtcggaggcggcgcgcgcctacgtgcggctcgcccgcgacgggagcgatgtcggcctgatcaccgagatcctgaaggacccgcaggtcaccttcacggcgacgccccgggcggtcggcaaggtcgccgacttcatggcccgcaccggcacgatccgtcgccggccggagagctggaaggacctgttcttcgcgggcgtccacgacaaggcgggcagctga

SEQ ID NO: 6177 - DNA, 540 bp, Methylobacterium sp.
ttgggcctgatccgcgcgtccgcgccggcgcggccccgcatccgccccggctcggccgcgttctcggcgctgctcgggctgctggcggcgctcccgaccttcgggatcgacatgatcctgccgagcctgtcggacacggcggccgcgctgcacgtcccggccaccgcgatgggcgcggccatgggcgtctacctgctcggcttcgggggcgcgctgctggtctacggcccggtctcggaccggctgggccgcaagccggccatcgtctgcggctgcctcctcctcgtcgtgggcagcctcggctgcggcgcggcgcggacgctgccggacttcctgctgttccgggccctccagggaatcggcgcggcgggccccggcatggcggtcctcgcgatggtgcgcgacctgttcgagggcgaggccgcgcgcgcccggatgtccttcgtcgtcctcaccatcaacgtggtgccgatggtggccccgaccgtcggcgccgggctgatggatctcggcggctggcgcctgatccacgccgcgccg

SEQ ID NO: 6178 - DNA, 705 bp, Methylobacterium sp.
gcgccggtcgccgccgccctggcggccctggtggcgatccggcacatcgacgagcccctgcggcggtccgcgggcgccgggccggcctccgggatcctgcgcggctacgggcggatcctggcgagccgggtcttcctcggccacgccctgtgcaacgccgccgccgcgggggcggtcttcgcctacatcaccggctcggcgctggtgttcatcgacgccctcgggctcagcccgctggcctacgggctggtcttcggggcgagctccctgtcgatgatggtcggcgccttcctgaacgggcggctcgcggcccggggcgccccgccgccgcgggtgatcgccgccggcctcgttctggcgaccggcgcggcttccctgctcctcgtcgcggcgctcgcccggcctcccgcggccgggccggtggtcgccgcgatggtcggcgtggccctggccttcggcctcgtctcgcccaacgccatgcacggcgcgacggagcgcagcctggacgacgcgggcgcggccagcgccgtcgcggtcttcctgcagatgctcggggcggccgtcgccagcgacctcgtcgcccggttcttcgacggccggtccgccctgtcgatggccgccgtgatgctcggctgctgcctcgcggccgccgccgcccacgcgggtctcgcccgaccggcgacccgcgccccgtcccagccccac

SEQ ID NO: 6179 - DNA, 747 bp, Methylobacterium sp.
atgaacacgatcctgatcaccggctgctcgtccggcttcggcctggagacggcgcgcaccttcctcgaacggggctggcacgtggtcgccacgatgcgcgggccgcggagcgacctgctggcgccctccgatcgtctcagcctcctgccgctcgacgtgaccgaccctgacagcatcgcccgcgcggtcgcggcggccggaccggtcgacgcactggtcaacaacgccggcgtcgggctcctgaacgcgctggagggtgtctcgatggacgccgcgcgggaggtgttcgagaccaacaccctcggcaccatcgcgatgacccgggccgtgctgccgcaattccgggcgcgccgcgcgggcgtcgtcgtcaacgtgacgtcgagcgtgacgcagcgcccgctgcacctgctgtccgtctactcggcgagcaaggcggcggtgaacgccttcaccgagtccctggcactggaactcgaaccgttcggaatccgcgcccgcctggtcattcccggacgggccccgaagaccgcgttcggcgccaacgcgcgcgcccgcatgggcatggacatccccgaggcctacgcggccgtggccgcgaaggtcttcgccggcatccagcaggcggacggggacctgacccggtcctcggatgtggcggaggcggtgtggcgcgcggtgacggacccgtcgtgccccatgcgtctgccggccggcgccgacgctgtggcgtgggccaaggcgggctga

SEQ ID NO: 6180 - DNA, 906 bp, Methylobacterium sp.
atgaccgatccgctcacccaggtggtcggcctcctccggccgagcgccccgctgtccaagctcgtcaccggctccggtcactgggcggtgcggcgcacggattccgggctgccgttctacgccgccgtgctcgagggcgggtgccgcctcgcgatcgacggcgaggccggtatcgtgctcggagagggcgacttcgtcctcatccccgcggcccacgcgttcaccaccaccagcctcgagccgccgaccctgcggcgcaccgcgcagcgtcccgtcgcggtgagccccggcgtgttccggctcggcgacgccgaggggccgccgaatgtccggatgctcgtgggccactgcgtcttcgcgtcgagcgacgcggacctgctcgtctcgcttctgccccggtacgtccatgtgcgcggcgccgcccggctggccaccctgctcggcctcctgaacgaggagacccgcgccgaccggccgggccgcgacgtggtcctggcgcgcctgctggaggtcgtgctgatcgaggcgctgcgcgccaccgccgggccggcggcgccctcgggactgctgcgcgggctcgccgacgaccggctcgccgccgcgctgcggcggatgcacgaccggccgacggcgagctggacggtggccgcgctcgcgcgcgaggcgggcctctcccggtccacgttcttcgagcggttccgccgcgccgtcggggtcgccccgatggagtacctgctggcgtggcggatggcgctggcgaaggatctgctgagccgcgaggcggtcgggatggccgaggtggccgcgcgggtgggctacagctcggcgagcacgttcagcgtcgccttcgcccggcacgtcggccggccgccgatccggtacgcccgcgagtggcaggcgcggtga

SEQ ID NO: 6181 - DNA, 204 bp, Methylobacterium sp.
atgacccaccctgccaagccgctgaccggcgccgtgcccggttccacgccggaccggcgcgccgcggccgaccattccgcgccgcacgcccttctgcacggcgccgccttcgtgctgctgtgcctctggacccgaaccgcgccggagcgtctgcgcgatcagctctccccggacgccggcgacggcgccgcgctcggcttctga

SEQ ID NO: 6182 - DNA, 231 bp, Methylobacterium sp.
atgaccgccaaggcgaaggtgaagaccggggacgacgtcacctacaaatggggcaagggcaccgtctcgggtgaggtgaccaaggtccacacgcaggacgtggagaagacgatcaagggcaacacggtgaagcgcgaagcctcgaaggccgagcccgccctcgagatcaggaccgccaagggcaagacggtgctgaaatccgcctcggaggtccgggtcaagtcggcgtaa

SEQ ID NO: 6183 - DNA, 102 bp, Methylobacterium sp.
atgcattggtcgagcctcgtcatcgccgcgtacgccgccggcttcgtggagttctggcggctctgccttcaggcgccggccgccgaggaggatccggcctga

SEQ ID NO: 6184 - DNA, 1026 bp, Methylobacterium sp.
gtgcgcagcttagaggcctcgtcccccgtcccggaggtctgcgtcatcatcgcggcccgggacgccgcggacacgatcgcgaccgccgtcgcctcggcgctccggcagccggaggtcgccgaggtcatcgtggtggacgacgcctccgcggacccgacgggcgcggccgccgcggcggccgacgacggtacgggccgcctgcgggttatccggctcgccgagaatgtcgggcccgccgaggcccggaaccgcgccatcgcggccgcccgcgccccgctgctctgcatcctcgacgccgacgactacttcctcgaaggccggctcggccggctcctctccgcgccccggacctgggatctgatcgccgacgacatcgtcatggtccgcggccgcgaggcggcctccgccgccggcctcgtcaccgggccggggcggccgcagcggctcaccctcgcggccttcgtgaccggcaacatcccccgtcccggcgcgagccggcgcgagctcggcttcctgaagccgatcatgcggcggggtttcctggaccggcaggggctgcgctacgacgcgcggctgcggctcggggaggattacgccctctacgtcgaggcgctggcggccggggcggtgttcgccgtgaccgcgccctgcggctacgtcgcggtcgagcgctcgaactcgctgagcgcgcagcacaggacggacgacctcggggcgatgctggccttcgacgacgccatgctgggccggccgggcctcgccccggaggcgcgggcggccctccgggcccaccgcgccgccacggcgcggcgctggcagcaccggcgcgtcctcgaccggcggcgcgcccagggctacgcggcggccctgcgggagctgctcggcacgcccctggcgtggcgccacatcctgtcggtgaccctggcggccaagctcgcgcgcctcgtgcccgcgtccaagccggagcgggagaccggtccgcgcctgctcctcggaccggagcgccgcctcgagccggcgcgctga

SEQ ID NO: 6185 - DNA, 306 bp, Methylobacterium sp.
atgggcagcgataattgcgatcggggggcgcgcagtgcggatgtcgcgctcgaggttctcgtccgagcctatcacgccctcgcggtcgtctacgagttgtccagtcccggtgcctacacggcgctccacggcaagatgatgccctacctgctggacagcttccgtcacggcacggcaccggacgccgtcgatccggacctggacgcgacgttctcgacggccctggagcgggtccgcagcgcgctggacgaggtccggtccgacgtggcggccgtgcgggcgcgcagggaggagcgcgaccgctga

SEQ ID NO: 6186 - DNA, 306 bp, Methylobacterium sp.
gtgtcgcccccggacgccggacattctgaggtcagcacgaccctggcgctggacatggtggggcgcgcctacctggccctggcgctcctctacgagacggcccatccgggcgagttcgtcgacgttcagcagaagatccgcgcgttcgtcgaggacaatttccgcatcatccaagagacgagccgcgacgagagcctgacaaccggtacagttgacggtgcccttcaccttgtgaacagcgtcctggtcgaggtcgagaccaagatcgccacaatgatccggccggcgcgacacctgcgcggctag

SEQ ID NO: 6187 - DNA, 222 bp, Methylobacterium sp.
ttggcggcgcgtttctacttcgagatcgcaaatgccgaggagacgatccacgaccacgtgggggtggaggccgctggcctcgaggaagccctgatcgaggcgcgtagcgtgatcgccgagatggccgacgagattacgggaaacggccgggagccgccctggaccctcctcgtgcgcaacgaggagggctggctggtcggccgcctgcccatccggaagtga

SEQ ID NO: 6188 - DNA, 981 bp, Methylobacterium sp.
atgggacgatcactcctacaattccgcgcccccgacgggcagcgcggcgtcgcgctgctcgccgacggctgggcgcggcgggtgctcggcgtcgacagcgtgctcgccctggcgcggagggccctcgcggcgggggacgatctggccgcgacggcggagcgcgcggggctcggcgcgccggtcgatctcgacgcggtccggctcctgccgcccgtcgaccacgccgatccggcacacctcctgctgagcggcaccggcctgacgcatctcggctccgccgagggccgcgacgcgatgcaccgcgcggccgcggccgacccggcgccgaccgattcgatgcgcatgttccggatgggcgtcgagggtggcaagccggcgccgggcgagaccggcgcgcagcccgagtggttctacaagggcgacggctccggcctcgtcgcctgcggcgagccgctggtctcgccggcctttgcccgcgacggtggcgaggagccggagatcgccgggatctacctgatcgacgccgacggaacgccggtacgcctcggcttcgccctggcgaacgagttctccgaccacgtgaccgagcgcggcaactacctgtggctcgcccattccaagctccgcccggccgccctcggcccggagctgtggctcggggccctgccgccggacgtgcgcggcacgagccgcatcctgcgcgacggagccgtgctctgggagaagccgttcctctccggggaggccaacatgtcccacagcatcgccaatctggagcggcaccacttcaagtacgcgccgttccggcgccccggcgacgtgcacgcccacttcttcgggaccgcgaccctgtcgttcagcgacggcgtcgcgacccggccgggcgacgtgttcgagatcgcggcggcgccgttcacgctgcccctgcgcaacccgctggcgatcgcgccggcggacgcgccgtccgtgcgggtgctctga

SEQ ID NO: 6189 - DNA, 927 bp, Methylobacterium sp.
atggcggccccgatccgcatcggcctcgtgggcgtcggcaagatcgcccgcgaccagcacctgccggccatcgccgcctcgccggactacgctctcgtggcggtggcgagccgccacggcggcctcgacggggtgccgagctacggcagcctggaggcgatgctggcggcgcacggcgacctcgacgccgtcgccctgtgccagccgccgcaggcgcggttcgcggcggccctggcggcgatcgcggccggccgccacgtcttcctcgagaagcccccgggcgcgacgctggccgaggtcgggctcctggtcgcggccgcgcgggaccggggcgtgagcctgttcgcgagctggcactcccgctatgcgccgggggtggagcccgcccgccggtggctgtcgggccgcaggatccggtcggtggcgatcgcctggctggaggatgtccggcactggcacccgggccaggactggatctgggacgcgggcgggatgggcgtgttcgatccggggatcaacgccctgtcgatcgccacccacatcctgccgccgttctacctcaccggcgcgaccctgtcggtgccggtgaaccggcaggcgccgatcgccgccgacctgcacttcgcggacgccgccggcaccccgatcggcgcccggttcgactggcgccagaccgggccgcagacctgggacatccgcgtcgagaccgacgatggccccctggtcctgtcgcggggcggggccgccctgtcgatcgccggccgcgaccagccgctcccgcccgaggcggagtaccgcggcctctacgaccgcttcgccgccctggtccgctccggcaccagcgacgtcgacctgaatccgctgatccacgccgccgacgccttcatgcgcggcgagcgccgcgcggtggaggccttcacggactga

SEQ ID NO: 6190 - DNA, 327 bp, Methylobacterium sp.
atgaccgacatccccgccccgccgccgggcccggccgacgccgcgacccgggccgcgactcaggccgccaccgaagccgccaccgaactcggcctcgggaccgactgggccgccctcggcgcgccggactgggaccgggtctgccgccgggccggcgcgatcctcgccgggcagggccaggcgccggcgcccggctgggacggggccctggcgcgggccctcggccgccccgatcccgcggccgcgcgggacgagctggcccgcgacgcggccaacaccgtgctggccgagaagggcgaggtcttcgccccggaggacgatgcctga

SEQ ID NO: 6191 - DNA, 165 bp, Methylobacterium sp.
gtggacgtcttcttcgatccggacccgcgggacgatcgttcgatgaccgaagaattgctgaccctgtggttctcgatcaaggatccgggtgcccggcaccgcatcctcgattgtgcgcgggccgcgaaggcggaggttggggcggaggcgcagccgcgcccctga

SEQ ID NO: 6192 - DNA, 201 bp, Methylobacterium sp.
gtgcaattcgagattcgagagcgtagccgatcgctgtggtcctgggtcctcgtcaacgagactgacgagcccgttctcgaatcgcgacgcagcttcccgtcccgcgcccaggccacggcggcggccctggccttctcccagctcgtctcccgcgcggggcgcagcctgggcggcggcccgcgtcaggtcgggttcctctaa

SEQ ID NO: 6193 - DNA, 168 bp, Methylobacterium sp.
atgaccctcctgttcgtgttcctgctcctgccgctcgcggtggccatcgtcctggcccgcggcgagccgatccgcaccatcagctgcctcggcgcgatgggcgttggctgcgtcatcgccgccacgagtctcgtgagcctcgtgcgccaccggattcggacgacctga

SEQ ID NO: 6194 - DNA, 981 bp, Methylobacterium sp.
ttgcggcccggtggccgccggctcgccggggcgcggctcgcgaccgcactgatgctggccacgatgaccctggccaccgtgacgctggctccggtggccgcccgcgcggacgaggtcgtcctgcgtgtcggcgaccagaagggcgggaaccggtcgctcctcgagatcgccggctacgcgaaggatctgccctaccggatcgcgtggtcggaattccccgccgccgcgccgatcctggaggcgctcaacgccggcgccctcgatgtcggctacaccggcgacctctccttcctcacagtcgtcgcggccggggcaccgatcaaggcgatcggcggcaccaagtccgatccccggacgcaggcgatcctggtccgcgcggagtctccgatccgctcggccgcggatctgaagggcaagcggctcgccggcacccgcggcggctggggccagttcctgatcagcgcgacgctggagaaggccgggatcgcgccgtccgaggccaccttcgcgccgcttaacccggtcgacgccaaggtcgcgctgatggccggctcggtggatgcctgggcggtctgggagccctacgtcgcgttcgcgacgctcaaggacaaggcccggccgatcgcggacggcgcgggcctcacgccgaccatcaccttcatcgtcgcctcggacagcgccatcgccaccaagcgggcggcgctgcaggacttcctgagccgccttaaccgggcgcggctctggtcgctggaccatctggacgcctacgcccggaacacggccgcgctgaccaagatgccggaggacgtcctgcgcgcggcctacacggcgcagcggacgcgcccgatcgcgctcgacgagggcgtcgtgaaggaggtccaggacgcctcggaccgggcgacacggtacggcatcctgtcgaagacgctcgacatcggccgggccgtggatcggagcttcacggaagcggcctcgaactga

SEQ ID NO: 6195 - DNA, 960 bp, Methylobacterium sp.
ttgaagacgagcggcaacggcgtggccgtcggacatgatggctggctgtactgggtcggacgcgcccgcgaggtcgaagccttctacggcgacaccgcgacctcgcggcggatcctgaagcgctggacgcggctcatcgggcggcgcgcgcggcgcctggacgacctcgggatccggcacgtgcacaccgtcgttcccgacaagctcgcgatctatccggatctgctcggccgccccttcccggggctcgacgacccgcccggggttcggctcgccaggcaggtcgccggcgacagcggcgccgcgatggttgacctgcaggcaccgctgctggcggcgcgggccgaggagcccgtctacctgcggacggacacgcattggacctaccgcggctacctgacggcgtaccgcgcgctctgcgaggctctggacgcgccggcggcggcgcacgtcttcgcggggaccggcgcgaccgagcgcttcaccttcgacctcggcgagaagctcgtcccgccggtcgacgaggcgtacatcgcctacgatttcccgcgctgcgcgacacggatcgacgcgaacgccctggtggccgtgcgggagtccggacgggccgtgcgaccgcgcggactgttcgtcggatcccgcgtcgtcctgaggaacgcggaggcgccggatccgcgccgggtggtgctgttcggcgattcctacatctacagcccgggcgcccggctcacggcgatgctggcggagaccttcgccgaggtgcacgcgatctggtcggcgaacatcgactggtcctacgtcgaggacgtccggcccgacatcgtcatcttcgagatcgccgagcggttcctgcggcaggttccgaacgatcggatccgcatcgatcgcttcgcggcggcgcgcgcgcggcgggccgtccgcccgacgctccgggagcgtatccggcgctggctgcgctga

SEQ ID NO: 6196 - DNA, 291 bp, Methylobacterium sp.
gtgtcccgcaacgccagcacccctgccgccgtcgcggaacgccgggcgaccgagcggagacccaccgccctgctggctttcgcccagcaacgggacggcgcgcgctatccctgccaggtcatgaacatctctgatcgcggcgcgatgctggaattcctcgggtcgcaggcggtgctgctggaggacgtgttcgacctcgtgctggcgagcgccgagatgcgctacgcggtccagctcgtctggcggaaggagcggacggtcggcgtcctgttttgcggcgaggctgtgtga

SEQ ID NO: 6197 - DNA, 1044 bp, Methylobacterium sp.
atgcgcattcgccccggcaccgccctgatggcgtgcttcgcgatcggcgttccgacggtcgcggccgccgaggcgcccggacagccgccgcgcgccgcgccggcgacggatccggcatccgcaccgcagccgtggccgccgaatttctcccgcagcgtgcaggggaccggcgtaatgggcctcgatggcggccacgtcttcctctggaaccggccccaaggcttcgatccggtctcgacgctgcgagtcgaccggcacgtgccggaggggtcgggcgaggccacccacacctacaaggcgctctgggcgctcggatccaccggcccgcacaatgccggctacgagtggacgatcacgggcgagctgcacaaccgcgccctcgccagcaccggcgcgcagaacgtcgcagttaacggcacgatcttcaaggagcccaacgggctggggccggtcgggccctcctgggccggcaatttcaactgtgtcgacatgaccgacgaggccgatccggtcgcctcctgcatcggcgccgagatcgacgtctcggcgcagtcgccgaccaccgatcgcaaccgccagcgggtcggcctgcagatctccaccggcggcgtgccgggcgcccataccggctacgggatcctgatgggcaacctcaccggctccatcaccgaccgggcgatctcgttccagggggaggggacatacggcatcggcatcgacgccgccgccgcgcgcttcaccggcgtcccgatgctgctcgcggccgggcaagcgatcgggctcgacggcgaccgcgagggcggcttctcccgcagcctcggcttcgacgggcgcgatctggtctacggcacggcggctgggccggtcatgcgcgtgagcgacaacgggcagattgtggccgcttccctccgcgagagcctgccgcggccgcccgcgagcagccgcgcgccctgcacccccggcgaccacgcctgggacgagtcctacgagtaccgctgcgtcgcgcccgaccgctggaagcgcgcggcgctcagcgactggtga

SEQ ID NO: 6198 - DNA, 342 bp, Methylobacterium sp.
atgtcgacccgcgccagcctcgccgcagccctcggattcgccgcgctgttcaccggctccgccctcgcgcaggcggtgatcgtcacgcccgacgagttcggccccgacgacgacgtggtggtgcgcgactacatcgtgcgccggccggtgggtccgggcccgatcgtcggatcgatcccgctgcggcccggcagcatcgtgccgcccgacgtgcggctcgcgcccttcacggaggccccgaacccgcgcctgcgccgcttcggctacttcgtggcgccgggcgacaagatcgtggtcgtcgatcccgacacccgcgcggtggtgcgcatcctcgaccgctga

SEQ ID NO: 6199 - DNA, 738 bp, Methylobacterium sp.
atggccgcgctgttcggcgatccgctcgcgccgcgctatctcgcctggctgctgcagggattcgggatgaccctgaccctgtcggcaaccacctgcctcgccggcaccgtgctgggcctcgcggcgtgcgggctgcgcgaggcgggcgggcgcgcggggcgcggcgtcgtggccgtctccgtcggcatcgtccgcaacacgccgctgctggttcagctcttcgtctggtacttcgcggtggccgccgccctgccggagggcgtgacggcctggctcaacgcgccgcacgtcatggacctgggatccgggatcctgcgctggcccgcctacgagagcctcgccggtttctgcgggctcacgctctacgcgggcgcctacatcgccgaggaactccgcgccggcatcggggccgtccggcccgctcagcgggcggcggccctggccctcggcctcacgcccgtccaggcgttccgccacatcatcctgccccaggccctgcgcgtcgcctggctgccgatcgtcggacagtacctcaacacgctcaagaacacgtcgctgaccatgacgatcggcctcgcggagctgtcctacgcgtcccggcaggtggagaccgagaccttccagaccttccaggcgttcggcatcgcgacgctgctctacgtcggcgcggccgctgcggcggagacgaccgggcagatcctcgagcgccgcgcccgccgaccgggccggcaccgatga

SEQ ID NO: 6200 - DNA, 696 bp, Methylobacterium sp.
atgaatccgtcagtcatcatcgacaatctcggctacctgctggtcggggcctggccggacgggccggtcggcgggctggccctgacgctgattctctccggcctgtccggtctggcctcagccgcgctcgggctcatcctcggcatcgccctggccgtgagcgcgggcgcggcccgggcagcgctcaccgccgggctcggcttcctccgcgccgtgccggtcgtgatgctgatcttctgggcctacttcctgctgccgatcctgttcggcgtgtcgatccccgagatcggtacggtcgcggcggcgctgtcgctcgtcggaggcgcctacctgtcccacggggtggcggctggcatcgcgagcgtcggccgtggtcagtgggaggccggcctcgcgctcggcctcgacccctggcgcaccctgcgattcgtcgtcctcccgcaggcgctgcgggccatggcgccgtccttcgtcaaccagtggaccacgctcatcaaggacacgtcgctcgcctacgtgatcggcgtgcccgaactcgccttcgtggcggcgcaggtgaacaaccgcgcgatggtctacccggccgagatcttcctcttcgtcggtgccgtgtacggcatcctctgcgccggtctcgacgggctggccgcccggctgacggatctcggcaaggccgcggcgcatcgcaccccgtga

SEQ ID NO: 6201 - DNA, 267 bp, Methylobacterium sp.
atgcgctacttcaccgatttcaccgacgaccgcggcctgtccctcgacgaggaggggctgtccttcgccgatcgtcacgaggcgtgcctgtcggcgaccgaggccctgatcgaggccgtgcatgaccggctccgcctccgggcggaccggccggcccccggagacgccggcctggtgctggaggcgcgggtccgcgacgcgaccggcagcacggtcttccgcgcccgcctcaccctcgacctggactggcagcccgccgacggctga

SEQ ID NO: 6202 - DNA, 372 bp, Methylobacterium sp.
atgagccgacacgccctgatccccggccgagcgatactcgcgacggctctgctgctcagcctcgccgccgccccttccgcggcgcagagccagggggacgcgctcaatgccgatgacggcaccggggcggtcaaggtctgctcgcccgtggcgatgccgcgctggcggtccatgaccccggtgccgaagacctggaccttcctggactgcatgggcttcgcgggcgagatgggcgcgacccacttccagctcggctgcctcttcgccaacgtcacgccccacgcccagaaatacgcctggggcgcgatggtgccgatcgagaagtcggccatggccaaggcgcagccgccgatcccgaattgcggctggtag

SEQ ID NO: 6203 - DNA, 345 bp, Methylobacterium sp.
atgcagagaccccctgccctccccctgagcccggtcgcctcaggcttcgggacgcccctgcggcggttcgggatcgcgagccgcgcggcccagaccctcggcatcgagtatctcgactcggttaagaaggccctcgacgatctcggggcgacctggggggcgctggcggcggcccgcagcccgaccgagatcctggcggtgcaggccgcgtacctgcagcgggccggggagcgcgccgcggtccgctcggccgccgccggcgacgcgatgctgggcctgaccggcgcgttgctgcggccgaaggcggtggcgccggccgcggcccgtcccggcccggcgcgctag

SEQ ID NO: 6204 - DNA, 342 bp, Methylobacterium sp.
atgatccgcatcatcgccgttatcctcgccggtatggcttccgtttcggcggccgtgagcacggcgcgggcggccgacctggcgcggttcgagggcgccgggccgggcccggggcgctggcatcacggggccggcggccggatcgccggcaccgtggccgcgcgggggcggccgcagtacagctattacggcgagtacggctatcccgggccgttcggctacggttacgcctacgcaccggtcccgagccgcggcttcgagtacggctacagcggtccccgctatgtctggaccgcgccggacagctattccggaccggccttcggctatcacgtgtggtga

SEQ ID NO: 6205 - DNA, 1413 bp, Methylobacterium sp.
atgacgaccgccgcgactgacgccctctggcaagccccgatcaccgagctcgcgcggcggatcgcggcgcgggagctgtcgagcgccgagctcgtcggcgccagcctcgaccggatcgcgcgcctcgacggcgccctgaacagcgtcgtccacctgtcgcccgcggccctcgacgccgcgcgcgcggccgatgccgagatcgcccggacagggccgcgcgggccgctccacggcatcccgatcgccatcaaggacaactacaccaccgccgacatgccgacccgggccggcacggcggtggaggccctgaccttcccggcggccgacagccacgccgtggcgcggctgcgggcggccggcgcggtgatcctcggcaagacgcgcatgcacgaattcgcctggggcatggtcacgccgccgacccgcaacccctgggaccccgaccgggtgcccggcggctccagcggcggctcgggcgcggcggtcgcggcccgcctctgcccggccgcgctcggctcggacacgggcggctcgatccggatcccggccgccctgtgcggaatcgtcggcctcaagccgacctacggccgggtcggccggtcggggatcgtgccgcattcctggtccctcgaccatgccgggccgctgaccctgacggtggccgattccgccctgttgctgcaggcgctcgccggcccggatgccggcgatcccgcggccagcgcggcgccggtccccgactacacggccgggctggaccggccgatccggggcctgcgggtcgcggtgatccgcaaccacttcttcgacacaatcgacgacgacgtcgccgccggcgtcgaggcggcgctccgcttcctcgaagaccggggctgcacggtgcgcgacgtcgcggtgccgtctctgcgccacggcctcggcgccatctacgccatcgagctcgcctcctcgaccgcctaccacgaccgcagcctcgcccggggccacgtggcgggcttcgcagccgacgtccgcgacctcgtggagatgggccggctcgtgaccgggccggactacctgcgggccgagcaggtgcgggccctgatcatggacgagatggccgccgtcctggccgaggccgacgtgatcgtcggcccggcctcgccgctgaccgcgtggcggacggacgagtccgcggtgtcgctcggcgggcgcgcggagagcgtgctggcggcttcctggcgcctgacctacccgttcaacctcgcgggcctgccggccatcgcgctgccctgcggcttcgaccggcgcggcctgccgatcagcctccagatcgccgcccggcccttcgccgaggccgagatcctgcgcgtcgcccaccagtacgagcgggcgcacgcgtggtggtcccgggtgccgcccctggccggctga

SEQ ID NO: 6206 - DNA, 1143 bp, Methylobacterium sp.
gtggcgatcctcggcacccgcggggtgccggcggcgcacggggggttcgagacgctggcggagcgcctcgcgctggagctcgtggcgcgcggctggcgggtcgaggtctattgccaagtgcgcgagccggcgacgccgatggtctggcgcgggatcctgctgatcccggtcgcggtccggggcgacggcgccgtctcgacgatcgtgttcgacctgaaatgcaccctgcgggcggccttccggccggccctgcccctcgtgctcggctacaacaccgcggtgttctcgctgctctaccggctgacggccaagcgcagcgtgatgaacatggacggcatcgagtggaagcgcgaccgctggtcgaagcccgccaaggcctggttctggctgaacgagcggctcggcagcctgttctcgacccacctcgtggcggaccacccggagatcgcccggcacctcgcccgcaggacctcggccgcccggatcaccaccatcgcgtacggcgccgacccggtgctggaggcctcgacggagccgctggtgaagttcggcctgcgcccgcgggattacggcctgctgatcgcccgggtggtgcccgagaacctcgtgctccagatcgtccgggcctggagcgaggtccggccgggcctgctgctgctcgtgctgggcaagctcgcggagtccgacccgtaccaccgcgccgtccgggcggcgggcgggccggacgtgatcttcgccggcgcgatctacgaggccgagcgcgtggccgcgctccgcttccacgcccgcttccacatccacggccacaccgtgggcgggaccaacccgtcgctggtcgaggcgctgggggcgggctcgccgatcctcgcccacgacaacccgttcaaccgctgggtggcggggccgcaggccctgtatttcggtgacgagaccgagctgcggaggggcatcctcggcctggtgcgggccgggccgcgccgcctcgaggtcatgggcgaggcgtcccgtcgccgccacgccgaggcgttcacgtggcgcggcatcttcgacgcctacgagcgcgtgctgcgccgccagctggcgcccaggcgccagggccgggaggcacggccggccgtccgccgggagcacgggcgcgcgtga

SEQ ID NO: 6207 - DNA, 1131 bp, Methylobacterium sp.
gtggagacagttcattccggtggccggccgctcacgcgcgccgcgctcgccggccggagacgtgcgctcgaagacgggcggacggtctcgcgcagggagctctcggccgcgggccgggacgcggccaaggccctgaacctgcgccctgccctgcgttccatcctctcggcgctctgcgccgtgtggggtgagcaggagtgggaacgcctggtggtgtggccctcgaacgagcacctgtgcgggatgaccgggctgtcggagcgcgcgctccgctacggcctgcgcgacctcgtggccctggagatcatcacgccccgggacagcgcgaacggcaagcgtttcgccatccgcgggccgggcggcgccgtcatcgacgcgtacggtttcgacctgactcccgtcgtcgcccggaagggagaatgggcgaccgcgatcatggaagcgaccgcgagggacgctcagcgtggccgcgcgttcgatctcctgaccgttcgtcgccgcgcggtgtcagaggctctcgccgccctgcgcgcccgcttcccggcgacggatgccgccgatctgctcgcggcgcaggaggccctggagcgcagcacgccgaggagacgcgcttccggcgcggaccctgacgtcgtcctcgacgcctggggagaactgcaagtcatggcggaggatcggttctatcaagccgcctctgccggcaattccagccgtcacatagaacaagacaccggatctcctaccgatccttgtgcaaaggctcccggaaaggagcctgagccgacccgtaggctcgaaccgtcactcgtcgcggccgcttgccctgtcgctgccgagttcggcgtcaccctcagaacggaagcggatgtcatcgagatcggccggctgatgcggggcgggatcggcgcgcatccgtcggcctggagcgaggcttgcaaagccctcggtccgttccaggcctcggtgctcgtgctgatcgtcgcgcaactccacgacgacgacgtgcgccggggtgagatccggatcaggaacccaggcggctacttcaggcagctcgtccgcctgtgttccgaaggtcgctacgggctcgaagccgagctcatggcgatgcggaggaggaagatgacgtga

SEQ ID NO: 6208 - DNA, 1017 bp, Methylobacterium sp.
atgaagacgatcgggttcctgtccttcgggcactggtcgccgaccggcgggtcggcgacgcgcagtgcggccgacacactcctccagtcgatcgacctcgcggtcgccgcggaggagctcgggacggacggcgcctatttccgggtccaccatttcgcgcgccagctcgcctcgcccttcccgctgctggcggcagtcggcgcccggacgaagcgcatcgagatcggcaccggcgtcatcgacatgcgctacgagaacccgttctccatggtcgagaatgccggcgcggcggacctcatcgcgggcggacgcctgcagctcgggctcagccgcggctcgcccgagcaggtcatcgacggctggcggcacttcggcttcgccccggccgagggcgagacggacgccgatatggggcgccggcacaccgaggtcttcctcgacctcctgaagggaacggggttcgccgcgcccaacccgcggccgatgttcgccaacccgccgggactcctgtgcctggagccgcattccgaggggttgcgggaccgcatctggtggggatcggcctccgacgcgaccgcgatctgggcggcgcagcagggcatgaacctgcagagctcgaccctgaaggcggaagagaccggcgagccgttccacgtccagcaggccaggcagatccgccgctaccggcaggcgtggcaggatgcggggcacgcccgcacgccgcgggtctcggtctcgcgctcgatcttcgcgctcgtgaacgacctcgaccgcgcctatttcgggcgcggcacgagcagcgaccaggtcggcatcatcgacaacatgcgcgcggtgttcggccgctcctacgccgcggagccggaccggctggtcgatgagctgcgcgccgacgcggcgatcgcggaggccgacaccctgctgctgacggtcccgaaccagctgggcgtcgcctacaacgcccacctcatcgagagcctgctcacgcacgtggcccccgcgctcgggtggcgctga

SEQ ID NO: 6209 - DNA, 198 bp, Methylobacterium sp.
atgccgagcgagacgaaccgagcgatgcagggtgccccggcgcgggagccgatcctggaactgtggcgcatcctcgccctcgcgctcatcgtcgcggccggcatgctgttcgtccatctggtcgttcccgccgaggccgacgcgtccgcggcaccgctcacgacggtccagaaaacgggcagccacaccctgcggtga

SEQ ID NO: 6210 - DNA, 213 bp, Methylobacterium sp.
atgttcgagagcgtgttctggggtgcggtactcgtcgcgctgatcggttcggccgcgctggtggcgatcggcgccagcgtccagccgcggttgggtcgcaagatggagatggacgcgcgcctcgccgatccgcgccgcaccttcgggcgcaagcggcgctgggcgcgtccgccgcggacgatgcggcgccccggcctgctccccatgcggtga

SEQ ID NO: 6211 - DNA, 258 bp, Methylobacterium sp.
atgagcgtgcgtcagatttgtgatcaggttcggatcgccgagcaggctttcaccgccgcgctcggcaacatgaaggccgcgggcctgcgcgagtcgctgacccgcgagctccaggagatggagagcgccgagatcgacgccgggcaggacgcggccgcggcgcggtcggcctcctggaagcgggtcaagatgctgcacgggctcggctacccggtggatttcggctggctccacgccgccgccagcccggtccgctga

SEQ ID NO: 6212 - DNA, 807 bp, Methylobacterium sp.
gtggagacggcgagcgacggcacgctgtcctcctccctcgccttcatgctgcccggcacgccgcgcgcggaagttgaggccgtcttcaaggccgagggtcagcccgcggaggccgtcccgattccgacgaacccgagcctcgttcggatcggctcggaggtcatcctgatcgatgccggctcgggcaactcgttccagcccacggccggcaagctcggcgagacgctggagagccggaacatctcacgtgaggcgatcacccaggtcgtgttcacgcatgcccatcccgatcatctctggggcgcggtcgacgatttcgacgacagcgaacggtttcccaacgcccgctacgtggtgccggcggaggaatgggatttctggacccgcgaggatgtcgagaccctggtgccggactggctcaagggcctctcggcaggctcgcggcggatcctacgacgccttgaggcgaaggtggagcgccgcaaacccggcgagagcattgctcccggcctctcatacgttgcgtcgccgggtcacacgcccggccacgcctccgtcctcgtcgaagccagaggggagcaggtgctgatcggcggcgatgccctgagccatgcggttctgtcgttccgtcggcctgcctgggccttcggaagcgatctcgaccgtgacctcgcggcaagtacccgcctcgcccttctggaccgcttggcgaccgagcggatgatgctcgtcggctttcatctccctggctcgggcgtcggacgtgtcgagcgcgctggtcatagctaccgcttcatacagacctga

SEQ ID NO: 6213 - DNA, 2043 bp, Methylobacterium sp.
atggcaggcggcgtcaccttcgatccagccgagttcgaggcgttcaagcagtctgccggcgctccgtcggctccggccaccagcgggttcgatccggccgagttcgcagcctacaaggcagcccagaccggcaccgacacggggcgcgaggcgggtgcgatgaacgccgccgctcgtggttttgtcgacgggatcccggtggcgggcccgtacatcctcggcggcatcgatcgcgccgacgcggccctgcggtcctaccagggcgggacagactacgggagcgaggtggcgaaggcgcagcggtacggggccgatgtgaaggccgcccacccctacgccaacaccgcgggcgaggtggccggcggcatcgccgggaccgcgcccctgatcgcagcggcgcctgccgcattcggggctggcaccggcggcttgattggtcgttcgctgatctcggcggctagtgggtcggccctcggcggtgctgatgcggcggtccggaacgatggcgatctgattgcagctcgcaatggagccatcgcaggcggcgcgttgggcgttgcggctcctgcttctggcgccgcgctcggcacggggatccggaatttctacgagatgatcggctcgcgccttgggccctcgagcgggttcggcccggccgcgacgcgcgtcctggcagaggatgcagccaactcgggcggcgtgccgcagatccgttcccgtatgggtgagctcggatccgacgccatgctgctggactcctcgccctcgttccaggggcaggcgcagggcctcgccgtccgaccggagacccgggaggccgtcacggcgccgatcgtgtcgcgcgccgccggcatgacggatcggctcgccaccgacatcaacggggcgttcggcccggccgtcagtccgcagaccgccaccagtgccttcgcctccgcgcggcagatccccaaccaggccatcggcgatgccgtgcgaggcgctggcccgatcgacacgacggacgtgctggcgaacctcgccgaccgcctccggaccgccgaggggccacagcgcgccgccctgatgcaggcgcggaacatgctgatgaccgagcacccgctgactggcgctgccatcccgcagaccagcgcggagaacctgcagaacgccaaggtcgccctgtcgggcatgatggagcacggcgcggagtcgttgggtgtcccgcgcgggtcagtggcgcagcgcgagggcgggctcggcgccacggtggccgacctcaaccgggccttgcgtgaccaggtgccgggctacggcgcggccaacgacgtgtcggcggcgctcgcgcggcgcatggaggccgtcgaggcagggtcgcagcttctacggggcgggcaaggtgccacgcccccggccgacctcgcggcgcgcttcgccggcatgtcccagggcgatcgggacgcgatggccgtcggcacccgcggggcgatcgaccaggccgtcggcacccgtcggaacgatctcacggcgatgcagaacctgctgcagggggagggcgggtggaacaccgccaatctcgcgcgggtccacgggcaggcgccggtcgaccgcatcgtgggtgcggtgaaccgggaagcggccttcgatcaggccaaccgccggatcgtcgagggctcgcagactgctcagcggacccaggcggccgaccgggtggctccgcgcacgacacttgggaacgacatcggcggtaccgtcgcgggcgcgatcggcggccctgccggctggctggcagcgcagggcggtcgggtggcgcggttcggcatcaatgccgccgggcaggccgcagacatcgctcgaaaccgccagctcgcggatgccgtgaccctgacacagggcgaccggctgaacaccctgttgaatgccatcgaggcgcgcggggcgatgcagcagcgggcggcggttctcggcaacgtcgcagggcgcggcgcgcaggcagcgctcctgtcgcagtcggagcgggcgcggccctacttaccggccgccctgccagccttctcgcggtag

SEQ ID NO: 6214 - DNA, 849 bp, Methylobacterium sp.
atggacgaccaggacaagcaatttatcacgcagcagatcctcgacgtcggccgccagctctatgccgccctcgacagcaagatcatgacggctcacgcgcagcagctggcgcagatgcaagatgtccggcgcctcgccgtggttcagctcgcaccgaagaacgacttctgcctcgtgacggatcatccgatcgcctacgagagcaacgatcacacggttccgcgtggaacaaaggatgacaatacgcgcaatcagcggttctgccacgcggtcgagagccatttcggccgaaaggtcagggccctggacctcggctgcgcggggggcggcctcgtcttcgattttctcatccgaggcaatgcggccttcgggatcgaggggagcgattactcccttcgcgcgcagcgcgccgaatggtccatcatcccggactatctgaagacatgcgatattaccaagcccttcgctctgatggatcagagatcagggacgaaagcgaaatttgacgtcatcacgatgtgggaggtcctcgagcacatcgaggaatcgctgcttcctcagctgttcgcgaacgtgaaatcccacttggcggacggcggtcttttcgtgggctccgccgcgacatacgacgatgtcgccaacggcgtgagctaccacccgacggtcaagccggagacgtggtggcgcgagcttgtccggcagcacgggctggaatttgtcccgatgaccatgttccagttcaaggatttctgccgaggctccgggaacgagaacgcgttctacgacgcggatttcagcaagaatcccgagctcggcttccacttcgtgatgaagcaccgccccgcttaa

SEQ ID NO: 6215 - DNA, 1065 bp, Methylobacterium sp.
atgatccgcgtcctctgcctcggctacagcgtcacggagctgccgggctacgtcgagcgggccaacgccctggccgaggccgaggggcgcccggtcaccttcctccgcagcggctggggcggccattccctgccctccatcgccgccctgatcgacgagatcctcgacgcgctcccctgcgaccgcgtcctcctcgagctgttcaccggcaacgtccgctacttcgacggcgcgacgatgcgggcctatctcgacgacatcctcgcggcgaccgcccggcgggacctgcccgtcgccttcctcaacctccaccagggcggcgtcgactacggggccgagcccgtcgccggcctgctggcggagtaccgcgccctctacgggatcccctatctcgacatcgccgccccggtggcggccgcgggcgcgggcgacatcacctacctgctgaaggacgcgacccacgtcacgccggcgggcgccgacctctacggcaccctggtctacagcttcctgcgcgcgccgccgccgggggacgcctatatcgaccggttccggaccctgccgggccggttcgaggtcctgccgctgcgcgccctccccggcctgacctgcgggttcaccctgcgccgcaacggcatcccgctggacttcctggagatcccggagggcacgcgcgtcgccgttcccctgggacgcccccgcgacgtgatcgggctcctcgtgacctacgggccgcaggcaggcacgctgacggtcgagaacccggcgaccgggcgggcgcggaccctcgtcgcctacgacgagttctcctactacacgcgcgcgatgttccgcagcgtgaccctgccggcggcgcgcgcgctgacgatcgcgcagtcggcggcgcgcccggacatcgttttgcgcaagggcgcgccggatccgggcccgcggatcgggcgcgtgtcgcacgtcgtctgccggcgcagactcggcctcgccccgcgcgccgtccgcgagcttcaccggctgcggcgtggcctccgccgcgtcgggttgcggctcggcctcgtccgaggcgtctga

SEQ ID NO: 6216 - DNA, 1053 bp, Methylobacterium sp.
atgacggcctcagccgccctgaaggatccgcgccgctacttcgaggcgatcggtgccgaccgcgcctccgaggccttggcgccgccggtctgcctctatctggaggtcacgaaccgctgcaacctgctgtgcgagacctgcccgcgcaccttcgagaccctggaacccccggccgacatgagctgggatctgttcacgcggatcgtcgaccaggtgccgaacgtcgcccgggtcgtgctccacggggtcggcgagcccatgctggtcaaggacctgccgcggatggtccgctacctcaaggatcgcggcacctacgtcctgttcaacaccaacggcaccctgatgcagccgaagcgcttccgggagctgatcgacaccggtctcgacgaactgcgcgtgtccctcgatgccgccgatcgggcctcttaccgcagggtgcgcggcaaggatttcttcgaccgcatcgtgcgcgacgtcggcaaattcgtcgcgttccagaaggcgagtggcgccacgacgccccgggtctcgctctggctgacgggcctcaaggagaccgtggaccagctcccggccttcgtgcgactcgccgccgagatgggcgtgaccgaggtgcacctgcagcgcctcgtcttcgacgaggccgggtacggcatggcccgcgccgacctgtcgctgttcgagagcgcgcgggccgaggagaccgcggcgatcgccgaggccgaggccctgggccgctccctgggggtgacgctcgacgcctcgggcgcgacagagcccgggatcagcctgaagcgtcaggaggaccgcgcctgggccacctgtcgtcgaccctggtccctgatgtacgtcaccgcccacggtcgggcgctgccctgctgcatcgcgccgttctcggtgcgcggctattccaactacacgctgggagacgccacgcaggccacgctccgagagatctggaacggcgcggcctatcgcgacttccggacgtcgctcctctccgacgtgccgcccgccccgtgccggaactgcggcctgcgctggagtctctga

SEQ ID NO: 6217 - DNA, 264 bp, Methylobacterium sp.
gccgagccgaggcgggccgcgggccccctgccctggaccctgcgcgtggcgggcctggtcgggatcgtcgcggtgatcggcgcctaccaactcgcgcggctgagccggcccgacgcgccgacgcccgggactgccctcgcgaccgcggcgctcccgccgatggccgagcccgagacgaccggcgccatcgcggcggcgcgatccgcccgcaccacccgcctggacccctgcgtcgcgtccgcgggcgaccgtctccgtccctga

SEQ ID NO: 6218 - DNA, 372 bp, Methylobacterium sp.
atgacacgcatcgctctgctctcggccgccgcgctgatcggcgcgggcaccctggcctccaccgccgccgaggcccgcggcggcggcgccatcgcggccggcatcatcggcggcctcgcggccggcgccctgatcggcgccgcgacccaggcccacgcggcgcccggctacggctacggcaacgcggattacggctacgccccggctcccgtggtcgtgcggccggccccggtctaccgcgtctacgaggaggacgcgccggtctacgccacccgtcggaccgtgacctacgagcgagtcccggtcggctacggtcccgcccgccactggggcggggattacgagggcggctacggctatcgcggctggtga

SEQ ID NO: 6219 - DNA, 648 bp, Methylobacterium sp.
atgactctccgccgccgcgcgctgcctctggccgccctcgccctggccctaccgctggcgaccccgctggcgaccgtggcggcgcgggcgcaggaccggctgccgaccatcccgccccaggactacacgcccgagcagaagcaggcggccgaggccttcgcgcaggcgcgcggcaagccgcccttcgggccgttcgagccgctcatgtactcgccggaggtgatgacgctcgcccggtcgatgggcgactacctccgcttcaagccgaagatcggcaccacgctctcggaactggtcatcctgatgaccgcccgccgctggacgcaggactacgagtggtacgtccacgcgccgatcgccgagaaggccggcatctccgccgacatcatcgcggcgatccgcgacggccgccggccggcgaagatgagcgacgacgagaccctcgtgtacgatttcaccgccgagctccaggacacgaaacgcgtctccgacgcgaccttcgcgcgcgccgaggcccggttcggcaagcccggcgtggtcgatctggcggcgatctcgggctactacacgttcctggcgatggagctgaacgcggcccgctacccgattcccgccgacggcaagccgctgccgcgcatgcccgagtaa

SEQ ID NO: 6220 - DNA, 1131 bp, Methylobacterium sp.
atggccgtcactgccggagacgcggcggcccgaccggaaccgcccagcacggtgacgagcccgccgcgcgacttccggcctggcgccgccccgaccacctacttcaccgatccggacatcgtcacggtcgacccggcgttcgagccctacatcgtgcccaacagcgccatccgccggctctggaccggcgccctctgggcggagggaccggcctggaacgcggtcggccgttacctcgtctggagcgacatcccgaacaaccggcagatgcgctggctggaggaggacgggcacgtctccaccttccggatgccgagcaacaactccaacggcaacagcttcgatcgccaggggcgacagcttacctgcgagcacgccaccgggcgggtcgtccgttacgagctcgacggctcggcgacggtcctggccgattcgttcgagggcaagccgctcaactcgcccaacgacgccgtccagcacccggacggcgcgtactggttctccgatccgccctacggcgcgctgctctacgagggcctgcccgacgcggccggcggcccgagcaaccggcagggccatctcgatccgcggctcggccagcccgccgggaccgtcccgcggcgacgcgtgctcccgaacgcggtctatcgcatcgacccgtccgggcgggtcgaccgggttctgaccgacgacgaggtgcccgaccccaacggcctgtgcttctcgcccgatcaccggacgctctacgtctgctccaccggcaagggtcccggggataccggacccggcggcaagggcgagatctacgccttcgacgtcggggccggggcggcgctctcgaacaagcgcctcttttcggactgcgtcgtggacggcgtgaaatgcgggcccgacgggctgcggtcggacgtcgacggcaatctctgggtgtcgagcaatgccggccgggccgtgggctacaacggcgtcaccgtctggacgccccagggcaagctcatcgggcggatccgcctgccggaagtgtgcgggaacctcaccttcggcggccccaagcgcaaccgactgttcatggcggcgagccagtcgctctacgccctgacggtgaacacccagggtgccgggccggcctag

SEQ ID NO: 6221 - DNA, 450 bp, Methylobacterium sp.
atgaccagtgtggcctccgccgagacgttgccggcacgcaaggccggcctgtgggagagcaagaccacgtcgcccgacggcaacacgaccgcgcgtcaatgcatcgacgagaagaccgatcagatcgcgcaggccgcgttcgggggcggccagaactgcgcgaagcgcaccatcgtcaagacgagcaccggctacaagggcgagaccgagtgcaagctcggcccgatctcggccgcgggcacgaccgagatcagcggcgacttcaacagcaagatccacatggaggtggatacgacgctgaccggcatgccgaacgccaaggagcccgtgcggcgccagatggtgatcgacgccacctacatcggtccctgcgcggccggacagagcccgggcgacatcatcctgccagacggcaagatcgtgaagatgccccaaccgacggcccgatag

SEQ ID NO: 6222 - DNA, 915 bp, Methylobacterium sp.
atgagctatccggcccgggtgcaggtgatcgaggtcgggccgcgcgacgggctccagaacgagcccgcgccggtgccgatcgccgccagggtggcgctgatcgaggccctggccgaggccgggctgacccgcatcgaggccggcagcttcgtgtcgccccgatgggtgccgcagatggccgagaccgcggaggtcctggcgcggctgcgcccccggcccgaggtcggctattccgttctggtcccgaacctgcagggcctggagcgggccctcgcctccggcgtccgggacatcgcggtgttcgccgccgcctccgagagcttctcccggcgcaacgtcaacggctcgatcgccgagaccctcgaccgcttcgccccggtgctggaggcggcgcgcgcgaacgacctgcgggtgcggggctacgtctcctgtgtcctgggctgcccctacgagggcgacgtcgcgccggcggcggtcgcccgcgtcgccgcgtccctccacgcgatgggctgccacgagatcgccctcggcgacacgatcgggaccgggacgccgcgcgcggcccggcggctggtcgagcgggtggccgccgacgtgccgctgcaggcgatcgccctgcacttccacgacacctacgggcaggccctggccaacatcctcgcctgcctcgaactcggcgtgtcggccgtggacgccgcggtggcgggcctcgggggctgcccctacgcgccgggggccgccggcaacgtcgccaccgaggacgtcgtctacatgctgcgcggcatgggcatcgagaccgggatcgatctcgatgccctcgccgcggccgggcggtcgatcgcgtcccagctcggccgggagccggcctcgaaggtcgcccgcgcgctggccgccgcgccgccgccgacaccctga

SEQ ID NO: 6223 - DNA, 399 bp, Methylobacterium sp.
atgtccgaaatcacggaggccgcaccggcggcggagccagactacgaccggctgctgcgcgccaacctgcggcgggtcttcaacgagcgggacgcggacgcgcgagcggccgccctggacgagttctacgtggccgagccgatcctgttcgagccggacaatgtcgtgcgcgggcgggccgcgatcggtgcggtcgccgggacgctgctggaccggttcggaccgaccttccgcttcgtgcccgtcggcaggggggtcgggcaccacggaatgggatcgctgcgctgggaagccggtccggagggcggaccggtcgcggtcaccgggacggacgtcgccgagatcgtggacggcaggatcggacgactctgggtgctgctcgacccgccggccacctga

SEQ ID NO: 6224 - DNA, 534 bp, Methylobacterium sp.
gtgttcatcggcgactcgatcaccgccgcctggggcgcggtgcgggccgagaccttcgcgcgccacggcttcgtggcccggggcgtcccgggcgagacgagcgggcagatccgggcgcgcttcctgcgggatacggccggcgcccggggggtgcacctgctctgcgggatcaacgacatcgcggagatcggcggcccggtaactgaccgggcgatcgccgggaacatcgtggccatggggcggatggccttcgcggccgggctgccgctcacgatcggcaccgtgatgccgagcgacttctggggctggcgccccgagctgcggcccgtggcgcggatccgcgccctgaacgggtggctgcgcgcctactgcgcggcgggcccggcccgcctcgtcgattacgggccgccgctcgccacggaggcgggcgcgctccggcgggacttcaccgacgacggcatccacctcaacggcgcgggctacgcggccgtggagccggcgatgctccgggccctcggcgccgtcccggaatga

SEQ ID NO: 6225 - DNA, 1161 bp, Methylobacterium sp.
gtgagcgcggccgcgcgttccggcacgctgccggccgtcttcatgcgcggcggcaccagcaaggcgctgatgctgcaccgccgggacgtgccgggggatctcgccgcctgggaaccggccttcctctccgccatggacagccccgacccgttcgggcggcagctcaacggcatgggcgggggcgtctcgtcggtctcgaagatctgcgtggtggagcgctccgcgcggccggacgccgacatcgactacaccttcgtgcaggtcgtggtccgggacggccgcatcgacctctcgggcaattgcggcaacatgctcgccgccgtggggccgttcgcggtcgacgaggggctcgtcgacgtcccggacggcccggtgcggctgcggatcttcaacaccaacacgcgcaagctgatcgtggcgggcttcgctgccgcgggcggccgcagcgtctaccgcggcgacctcgcgatccccggcgtcaccggcacgggcgcgccgatccagctcgacttcctggatccgggcggcgccacgaccggccggctgctcccgaccggcgccgtccgtcagtggctcgacgttccgggcctcggcgcgatcgaggcctcgctgatcgacgctgccaatgcctgcgtgttcgtccgcgccgccgatctcggcctcgccggcaccgagctgcccgccgccctggaggccgtgccgggcctcctcgaccggatggcgcggatccgccgggccggctccgtggcgatgggcatcgcgcccgatctcgaggcggcggcgcgcgtcgtccacgtgcccttcgtcggcctcgtggcgccgccgcaggattccggcagcctctccggcgccacgatccgcgccgccgagatcgacctgaccgcccgggtcatctccaacggcgtgccgcatcaggcgctgccgctcaccgccaccctgtgcctcgcggtcgccgcccggctcgaaggcagcctcgtccacgaggccgcgcgccccaccgaagcggccctgcgggtcggcatgccgtcgggcatcctcaccgccgacgccgccgtgacccacggggccgacggctggcgggccgagcgcggcgccttcttccgcacggcgcgcccgctgatgcgaggcgaggtgttctacgatgcgccgccgcccgtctga

SEQ ID NO: 6226 - DNA, 456 bp, Methylobacterium sp.
atgacagcgcgcaagagccatcgctggatcaccagcctcgccgcccttctcgtcctcggggtgccgctcgccacgggtcccgcgttcgctgcgggcaaggacgtcacctaccgcgcggcgctcaccggcagcagcgaggtcccggcaaccgcgtcctccggcaagggcgagatcaccgcgaccttcgatcccgccaccaagcgcctgagctggtcgggccagtacagcggcctcaccgggccggtcacggccgcccatttccacgggccggccaaggctggcgagaatgcgggcgtgctcgtgccggtgacggcggcgagcagccccttcaccggcgaggcgaccctcgatgacgccaaggccgccgatctcgaggcggggaaggtctacttcaacctccacaccgccgcgaacccgaagggcgagatccgcggccagatggagcgcgtaccctga

SEQ ID NO: 6227 - DNA, 336 bp, Methylobacterium sp.
atggcggtgctcgggctcctcgccctgataccggcgcccgtcgccgcgcaggagccgctctacatccgcatccgtccgctgccggacgccgaggtggcgcgcgtcgcccgggagatgctctgggcccaccgtcaggctcatgcccgcgcggtgatcgaatcggtctgcaccggctgcctgggcgcctggaagcccgaaccggtcccgccaccgacgcctgcgcccgcgcaggacaggattgcgaacctcaccgttccgataggggttgaactcgaccccggctccggggcatccgagcccgatcccgatccatcgaccttcgagaggcatccatga

SEQ ID NO: 6228 - DNA, 900 bp, Methylobacterium sp.
atggaactgaagtggatcgaggacttcctcagcctcgccgagacccgtagcttctcacgctcggccgaggcgcgtcacgtcacgcaatcggcgttcagccgccgcatccgctccctggaggtctggctcggcacggccttgctcgaccgaagcacctacccgatcaccctcacggcggacgggcgccacttcctcgagaccgccgaggaggtggtgcgcctcctcaccctcagccgcgccgacttccgcaaccgcagcgagcggtcgagcctgcccgtcgtcgccatcactgccctgcattcgctctgcctctccttcctgccgcgctggctcggcacgctccggggcgagctcggcgcgatgagcagccgcgtgctgccggagaacttcaacatctgcctccaggccctggtcgagggcggctacgacctcatgctgacctatcaccatccgggcatcccgatcccgctcgggcccgatcgctttccctgcctcgtcgtgggccaggacagcctcgtggccgtggcggcgccggcggatctcccccgcgaccgggaaggccgcctgccgctcctgcaatattcccgcggctccttcctgggccggctcgccgccatcgcccaggcccgggagggcgcgcccgcgacctatccggtccacacgaacgagaactcgatggccgaggccctgcggtcgatggcgctcgcgggacacggggtcgcgtggctgccgaggagcctcgtggccggcgagatcgcggcgggcgcgctcgccatcgtcagccccgagatgtcgatggagatccggctgtaccgcagcgcggagcgggcccggccgttcctagaggccgtctggtcggccgccgccgcggattcgaagaactattccggttcggaatag

SEQ ID NO: 6229 - DNA, 531 bp, Methylobacterium sp.
atgcaggagacgggcgcacacctgtcccgccgcggcttcctgggcgccgcgggctcgacgctgctcgcggtcgcggtcatgccggacggcagcgtgaccgggcgggcctgggcgcagatgccgaaggcgacgaagcccgagaccttcgcctcgctcgtgcagatgtcgcgcgactgctacccgcacgaccgcgtcgccgacaggtactacgccgccgcggtgcagatcctcgacgacgcggcgcggaccgctccaggagaactgacgctcctcgaggacgggatggccgcgctcaaccgggcggccgtcgagaggcaccgcctgccctacgccaaggttccgcaggatacggaccgggcagccctcctcgagaccatcgagccgaccccgttcttccagaaggtgcgggccaacctcatcgtcggtctctacaaccagaaggagctgtggccgatcttcggctacgagggcgcctccttcgacaagggcggctacctggagcgcggcttcgacgacatcgactggctctga

SEQ ID NO: 6230 - DNA, 594 bp, Methylobacterium sp.
atgactgagcatccggtggccgggcccgccttggccgttgacgtgaccgtcgaccctctagcaaccccttacttcgactacatcctagatggcgtgcgccttgatctagcgcaccttgagccacggggactgacattctttgtcaaaaatctcgggcgggaccttacagtcgacgtgaagttctccaaccattgcttcaccgtggatttcgatcccgccgttcacaaccctgcgcatgtgatcatggatcataagcggcggcgcgcatacgaccctgagcggcacgcactctcgcgtgggctccccgacatgatcgcggcgttgccgagcgcggcggtgtacctaacgccatcggacaggaactacgtctacgttgcccgcctcgtgacgcccgccggtatggtctacccgatgtatttccacctgcggcgcgccaaggacacggctccgcgcaacctgcaaatggtggtcgagagcgcctacccggtggaagacgcgagggccgtgctggcaggcacgacgaaaatcagcttcgccgttctgtgcgccaaggtgttcaggggcgagcgcatacgtccgcaggcccggcgctag

SEQ ID NO: 6231 - DNA, 483 bp, Methylobacterium sp.
gtgcgcctgcgcgccgtcgcgctctccaggtctgtctcaatgacactcgctcgtgaccctgatgcccatctctccagcacaactgacgcggccaaactctcgctgccgctgtcctggtggcgcgtcttcgcccctgaggcgctcgatatggcggcgcagtgccgcctgtccgctgccctgaatgccgtgcagcccctgccgtcccccgactggtccgctgcttgccggggcgattcggcggctgcgatccatatcgccctcaacgtcctcgccgaggctatcgcctttcctgggcgcctcgatccggcgatgtcggcgatctgcctctgtgccgtacgaggtgacggctcctgcatcgacctgctcgtgcacgtgctcgggcggcgcgctcgacgccgggctgatctcaaggtgctctgcctcgcccatgcttggtgctccgttccgcgccgcggttccgaccgcgtcggcgtcgcccgctga

SEQ ID NO: 6232 - DNA, 276 bp, Methylobacterium sp.
atgcgccccctcatcgccacgctcaccgccgcgagcctcggtctggccgcggccgccgtgacacccgccctggcccaggtgcagcagaacaatccgaacgctgctaaccaatccatggagaccagcggtcaggtccgcgctctgcgacaggagcagacgacccagagcaatacgctccggatggacatccagaggaaccaagccgcgacgcccgctccgaataccgggccgaacgctatcggcccgaccgggggcaccggcgtcatcggccgttga

SEQ ID NO: 6233 - DNA, 729 bp, Methylobacterium sp.
atggacgtcgtcgcacgccgccggggccggccccgcaaggcgccggtcgtcccggtcgcgcagctgccgcggaccgggctgcacgagcaggcggcgggccggctcagggacatgatcgtgcgcggcgtgctgccggccggcgcgtccctcgtggagacggacctgtccgtcgccctcggggtcagccggacaccgttgcgggaagcgctcaagctcctggccgcggaggggctggtcgaactgcaccagaaccgcagcgcccgcgtcccggactggacgccggaggagatcctcgaactgttcgaggcgctcgccgggatcgagcggctgaccgcggaactcgcggcgccgcggatctccgaaaccctgatggacgcgctgcgcggcaagcaggcgcagctcgaccggatgcaccgggaccaagtgctcgacgcctatttcgccctgaaccaggagatccaccggacgatcgtcgaggccgcccggaaccgtccgctggcggaggcccacgcggcgctccaggcccgagcccagtgggcgcgcctgcgcgcgctctccagcggcagccgctgggaggaatcggcccgcgagcaccgggatctgttcgaggcgctcgccgcgcgggacgccgccgcggccgggaccgtcgcccaccgccacgtgctgcggaccggcgtggtgattgccgagacgctccaggcccggcgcacggaccccgcggcgccgtaa

SEQ ID NO: 6234 - DNA, 216 bp, Methylobacterium sp.
atgcggaagggcaggcgagttccggcttggctggcgaggcggacctacttcaagcggatcgagcgctgggcgaagcccggcaaggcgcgcaaggcggcgcagccccctgagacagaggccgccgcgatgccctccaacgtcgtgccgttcccgatccggatgaatcggccggatcgccccgccttcgaggacctgcggggcgtcggcacggcctag

SEQ ID NO: 6235 - DNA, 189 bp, Methylobacterium sp.
atgagcgacgccgcgatcgaggcccgccgcctcacgttgatccgcttcgagcacgcggccggcgccgccttcggctgcgacgacgatgcggccggcgtgccgcccgcccgcgcgctggtgaacgccaccacgatcaccttggcgaccttcgcgaccgcggtcgcggcgacgatcacctacctagtctga

SEQ ID NO: 6236 - DNA, 984 bp, Methylobacterium sp.
atggaggacgccgtgatggaactcgtgaccaagcccctgcgggacgagggtcctctgccgctcctggtcacgccgccggagggcgccgcgggcacggcgctcgcggacgcgctgccggcgatccgggccgcggccgaggcgcacctccacgccgcgggcggcctgctgctccgcggcttcagcctcgacgggcccgacgcgttccgcagcttcgcggcgggcttcggccacgacctcctgagctacgagttcggctcgacgccgcgcagccccgtgacccagggggtctacacctcgaccgagtacccgccccaccagcacatcccgctgcacaacgagcaggcctacgcccgcgactggccgatgaagatctggttctactgccagcaggcggcgcccgaggggggcgagacgccgctcgccgacagccgcgcgatctaccgcgccgtgcccgagccgatccgcgcgcgcttcgccgagcagggcctgatgtacgtgcgcaactacggcaacgggctcgacgtggcctgggagcaggtgttcggcacacaggaccggggggcggtcgaggcgtactgcgccggccacgggatcacctgcgagtggaagccggacggcgacctccgcacccggcaggtctgccagggcaccgcccgccaccccgagaccggcgagccggtgtggttcaaccaggcccacctgttccacgtctcgaacctcgagccggaggtgcgcgcgaccctcctcgacctcgtcgacgagccggacctgccgcgcaacgtctactacggcgacggcagcccgatccccgacgcggatctcgacgcgatccgcgccgtgctcgccgagcacaccgtcgtctttccctggcagtccggcgacgtggtgatgctggacaacatgctgaccgcccacgcgcggactcccttcaagggcccgcgcaaggtcgtggtggcgatggcgcaagccggccgcgcgcagtga

SEQ ID NO: 6237 - DNA, 99 bp, Methylobacterium sp.
atgcgcaagatcctgatcgctttcctgcttcccaaggtcgtgtcctacctgcgccgccgctacggcggcccgcacgccaaccgcaatcgcgccttctga

SEQ ID NO: 6238 - DNA, 267 bp, Methylobacterium sp.
atgatcgtcgacggtctagcgttcctcctcgtggcgatcgccctcgcggcggtcgtcgccggctacgagcggaacctgccggatccgtccgcgtcacccgcgctggtcgccgcaagcgcccccgtctggaccgaccccgagacgacgggctcgatcgcgccggccgcgggcccggtcgcccgctgggcggacgcgcggcccccgttcgcggcgccggagtcggatcgcgccgccggcggaacctgggtgagcccgccccgccgctga

SEQ ID NO: 6239 - DNA, 420 bp, Methylobacterium sp.
ttggtcacgctggtgggcgagatcgtcgccgcctacgtctcgaacaattccgttccgccgacggccctgcccgagctgatggcgagcgtgcacgcggcccttgcatccctcgacgggcaggcgccggcggcctcggtcgagccggccgtggagcggccgacgccggcccagatccgcaagtcggtccaggaggacgggatcgtcagcttcatcgacggccggacctacaagaccctgaagcgccatctcaccgcccacggcctgacgccggagcggtaccgcgagcgctacggtctgccggacgattacccgatgacggcgccgggctacgccgcgcagcgctccgcgctggcgaaggcgatcggcctcggcgtgcctggcgggcgcgtcgatcagcgcaggacgggcaccggcggctga

SEQ ID NO: 6240 - DNA, 852 bp, Methylobacterium sp.
atgctcgccttcgccgaggaggcggcccccctggccctcgccatgcgggcgggaggcctcgcgatgagcaacaagggtccggatctcggccaggcgctgaccgaggccgacctcgccgtcagccggttgatgcacgcgcggttcggccccgacctgatcgaggaggagaccgccgaggatctcggacaggcggcggcccgggcgctgctcgcccgcgacgcctggaccttcgtgggcgacccgatcgacgggacccggcccttcgcgggcggcctgtcgggctggggcgtgatggtggcggcctgccgcggtggctggccccgggcctgcgtcatgagcctgccggcctggaacgagaaccgctccgcgccggccgggagcgtgccggcggaggccacggagggtgtcctgctggcggcgagcgagggccgcgcctactgggccccgacccgcggcggccgcatgacgacggcgctgcgcccgctcgagcgcccggagcgccggaccggccatgtcggctggctgtcggtcacggcgcagcgctacaccctggattacggccgcggctggttcccctggagcgagggcggggcgatctcggacgccgcgctcctggccaccgggcgcctcgacgcgaccctgagcaacaaccgattgtgggacctgggcccgatcctcccgctgttcgaggcgctgggcttccgcctgttccactggcccgatctcggggatccgccggcggccttcgtggacctgttcgacgccgagctgtcggcccacgacgacctctggctggtgtgccgggatcgcgcgcaggccgccgatctggcgacggccatccgccccgcctag

SEQ ID NO: 6241 - DNA, 576 bp, Methylobacterium sp.
atggtcgagaccccgcccgccctgccgctggaggtgatccaccgcggctggaacaccttcggcatcgccacgctgacgctgcaggacggcagcaccgtgcggcgggcgctggaggaccacgggcaggcggcctgcgtgctgccctacgatcccgagcggcgcgtggcgctgctcgtccgtcaggcgcgggtcgggcccgccttctggggtgagtcggccgagttcgacgaagccccggcgggcggcctcgacgggggcgcccccgaggcgacggcgatccgggaggcgatggaggaggcgggcgtccgactgacccgactggagccggtcgcccacgcctacagcatgccgagcgtgtcctcggagcgcctctggctctacctcgcgccctacgccgcggccgaccgggtcggtcccggcggaggcctgcacgcggagggcgagcaggtggtggccgtggagatgccgctggccgcgctggcggaacaggcccgggccggccgcctgcccgatctcaagaccctggttctcgtccaggccctgatgctccgaagccccgaactgttcgccgcatga

SEQ ID NO: 6242 - DNA, 243 bp, Methylobacterium sp.
atgatgtacggggaggttggccgcctggcggatgagagcctgcggctgggcctgagacaggccgagaacgccgtcctgctcgcgatggcggcgcagtatgcgtgggcggatctgtggttcgaggggtaccgcgcggcgatgaccgccctcagcaccgcgcgcgatcagcgggcgcggacgcggcgcctgatccgtcgcggcgtggaaccgtcggtggccgcgcaggaattgcacgtcgtctga

SEQ ID NO: 6243 - DNA, 183 bp, Methylobacterium sp.
atgtctcgatcgatcctgctggccctcgctctcgtcgtctgcggggccgccgtgacgctgttcgccttcctgcgcgccccccagtcgagggagttcgccgggtgggatgccgccttcatgggcggcatcggggccgtcgcgctgggctttctcaccaccctcgtcgaggtcgtgaccgagtag

SEQ ID NO: 6244 - DNA, 426 bp, Methylobacterium sp.
atgcgacgctcaacagctctgaccggcccgctcgcggcggcgctcctgctgctcgtcgccgccggaccggcaggggcgcaaaccgcgccgcccccgcccgcgggatccgccgcggcgacggccgacaacgccgtgctgctgacggtcttcctgcgccacgaccagtcccgcccgctggcggagctgaacgcgcagctcgccaagcagggcttctacaaggccttcccgccgccgggcatcgaggtcgtctcgtggaacgtcgtcatggggatcgggcagatcatcgtcctgcggctgccggcctcccgcctgcgcgaggtcaaccgcgtcatggaggacaccgcctggggcgcgtaccggaccgagttcttcccgacctacgattacagggccgtgggcctcgcggagcacgagaaggcgcgctga

SEQ ID NO: 6245 - DNA, 270 bp, Methylobacterium sp.
atgaagaagcttctgatcgcgaccctcgccctcgcgccgctggcctacgcgggcgccgcggaggcccagggtacggcgcgcggcgcccagcgcggcgtcgaggacggcacggccgcggccggccccgtgggcggcgtcgtcggcggcgcggtcggcgcggcgaccggaacggtcggcggcgtgctcggcaccgatcccgacccggcccgccgcgcccgcgagaaccgccgcgaggagcggatggagcgccaggagcgcctcggccgctga

SEQ ID NO: 6246 - DNA, 375 bp, Methylobacterium sp.
atgcgttccgccgatccgacaccgcgcctgttcgcggccgcggccgccctcaccggcaccggaatcctgatgtgccggaccgagccgtcctgggacgggatcctgatcggcctgttctgcctcgggctctgggccctcggcaccttcggcaccctcacggcacggcctggccgtccggtgcgttccgcgccgcggatgcggcccatcgtgctggaggcggtggtcgtcgagacgccccggttcccgccggagctgctgcccgcgccccggccccccgcggcccgggaccgtgccctggcgggtccctcccgccagccggagctcccgtcgcaccggcagcgcgtggtcgagcgctacacccgcaggcgcggttga

SEQ ID NO: 6247 - DNA, 180 bp, Methylobacterium sp.
atgagcatcgcgatcctgattgccttcgtcgccggcgcgctctgcctcgggatcctgtccgcggtcatcccgttcgggcggcgcgaggtcgaggagctggacgaggcgctcccgtacgaggacgagttcttcgacgtcggcggccctgtgatcgatctggagccgcgccacctcacctga

SEQ ID NO: 6248 - DNA, 252 bp, Methylobacterium sp.
atggcgcccgacgcttccgcggaaccggcccgggaccgcgcgccgtcaccgggggcggcgcgcacgagcgacgccctgagccgcatcgccggcatcctcgacgtgccggtggcgagcttctacccggatgccgaccggcccgacgcggccatgacccaggcggccgacctcgtctcggccttcgtggcgatcgacagtccggcggcgcgccggacctgcctggccttcgtgcgcgcgatggcgagttcctga

SEQ ID NO: 6249 - DNA, 147 bp, Methylobacterium sp.
atgatcctcttcacctcctcgacccagaacatcgccgctccggtctccggcggctggagcctcaaggccatcgtccgcgagatgctgaactcctggctcgcccaccaccagcgcctcgccgacagcggcatcggcggcgacctctga

SEQ ID NO: 6250 - DNA, 171 bp, Methylobacterium sp.
atgcaggccctgatcggctgcggtctcgtgctcgccggcatgctgatcgagagcgcggcgagccggcactggcggtcgggcgtccgcgcggaccgtctggatgcccgggccgccctcgcgctcggcctgcccgccctggggctcgccgtgatggccgccccgatcgcgtga

SEQ ID NO: 6251 - DNA, 1011 bp, Methylobacterium sp.
atgcagctccggatccccacacggccccaggcgcggttccggggacgggtccgggcggggacttgcgtcgcagcgcgggccgcggcgctcgtcgccccgcttttcgccgggtccctggccgttcccccggccgcgccggcccgggccgcggatgcgcccgcgcccctgtggccggagcccgacgggaccctgatcctggcgcgccccttcggccggtccgagatcagcctgcgcctgtcccggcgggtcgccggggcggtggacacgctgacctgggacggcgtcaccttcctcgccgacaccgagcccggcgacgccctgcaggcgcgggcggagatcggctccggcgccgcctgccgccgggcgagcgaggccggcaccccgcaggacgggtccggcgcgcccgccgcccaccggctccgcgccctgcgcgccggccggagctgggccgagaccgagacccgcatggcctgggacggccccgccgacccggccgacgagccgccctcggactgcccgaccgcctccgcgagccccgcgatcccggccccgctcctgcgcaagcgggtcgccctcggcctgccgggcctcggcaacgccgtggaggtgcaggcgagcttcaacctgattgagcccgcggcggcgctgcgtctcgaacccctcgccgccgcggtgccggcggagttctccgcggcctggcgcttcgacccgtcgaccggcgggctcgcgcccctcggccccggagcgggggagcggccggacccggtgatcctggcgacgccggagggctcgcacgccctcgcggtctgggccccgggtccgccggagcaggagcccgacgcgccgcggcccggcttcgcggtcgcgcccgaggccggggcgaaccgcctgagctgccgcttccggctggcgaacgccgccgccggcgcgcacgatttcgcctgctacgccctggtcggcaccctcgccgacgtccgggccgccctgcggagcctgaccgctccgccgtga

SEQ ID NO: 6252 - DNA, 225 bp, Methylobacterium sp.
atgatcctctcgttcctgaaatctgcccggaagagccgcatcgcggcgcgaaatcttcgcattctctcggccctcgacgacgagatgctgagcgacatcggcctcgatcggcgcacactccgcacgttctgcgagaacggctgcgcgcacgtgccgccgccgagccaggccgaggcgccccgggccctgctgatgcccggtgggctcgggatcgccttccgctga

SEQ ID NO: 6253 - DNA, 543 bp, Methylobacterium sp.
gtgcgggtgccgaataatcaggtcggcggcttccggccagcggccgcgctcgctatggcgtcgcacgaggatgcgcgcgggccggtccgcggccggcgcgacggtgatcgggcggaacgccccgtcgtcggacgggagacggcgccccgggaggccttgatgagggatgcgtccgcgcaggagcttctgctgctcagcgcgctccaggaatgccggattcagctcgacgcggcgcgcaaggacgaggcggcccgcgccgccgtccgggaggagctcgaggccgcgctccaccgcgaggccgctctcgcggcggcgatcgcggaggagcgcgagcggaccgaggccgtccgcctcgtgcttcaggcgctgctgatgagcgtccgccggttcggtctgcgccggcgcctgttcggggcgcgcatcgcccggctcggccgcgagacgccggattccggtccgcaggcggcccgccatcccgtgctgctcgccgaggcgcgacgggtgctgggcaagccgtcgcccgaaccgccggccgggcggtga

SEQ ID NO: 6254 - DNA, 201 bp, Methylobacterium sp.
atgaagattgtcgcagccaaccacgccgattcgctccgccgccccggttcgcgggattcggcggaatccgccgttctcgacacggtccgggaagggctgctcagtgtctacggcacggcggatcgcgacctgccggcggaattggcggcgctggcgcggcagctcgaccgtccgggtcccgcgggctgcggcccgacctag

SEQ ID NO: 6255 - DNA, 822 bp, Methylobacterium sp.
ctgacgcgcgacggaggccggctcgcccatatcgaggccgggccgctcacccccgaggggcagccgctgctgctgatcaacggctggaccggcgaccacggcatcttcacgccgcagatccggcacttctcgaggacgcgccgcgtcgtggcggtcgacctgcgcggccacggcgccagcgacgcgccggagcgcgactacacggtcgcgggcttcgccgaggacgtcgcgtggcagagccggacgctgggcctcgtgaagccgatcgtgatcggccacagcttcggcggcgcggtggcgctggagctgtgcggccgccatcccgacctcgccgccggcctcgtcatgatcgactcgatcgtcctgccgtcggcggacagggcgggcggcgccgcgatcgagaggctgctggcgggcgtcggcggcccggattaccggtccgtcgtgcgggagatggcctgggcgatcggcggcgactacgaccatccggcccggcggaaggcgatcttcgagaccttcatcctcggcccctgccaacggacgccgcagcacgtggcctacgcggcgctgcgcgacttggtgctggcccacgatcccgtcccggccgcgcgcgcctgccggatcccgatggcctacatctcggcggacgtaccgctggtggcggaggcccgcgacctcgaccggctgcgggagctctgcccgcagctcgtcaccgcccagacgctgctggcgggccacttcaacacgatcgaggtggccgagcaggtcaacgcgatgatcgagcgcttcctggcggtcggcctgaggccgcgcgcgcggtag

SEQ ID NO: 6256 - DNA, 186 bp, Methylobacterium sp.
gtggatcccgaaaccgccaagaccctggtctccgccgccctggtcgcgtcgatcaccctgttcagcctcgtgtcgctccaggcgttcgtcgcccagatcctggccgacctccgcgacgccgggtccgccccgaagcccgtgccggtgccggtgcgcgtcgaccgccgggatccgccgcaggcctga

SEQ ID NO: 6257 - DNA, 1944 bp, Methylobacterium sp.
atgcaagcggtcgcgcgatcggaatcccttgcggcggcgccctgcgccggccccgcggaccgggccggccgccgcggcggatggcgtgaccggtggcgcgcgccgcggctgcgcgtcgtgctggccctgggtttcggcacgctcggcttcctgacgaccctgacgctcgccgccctggtgagccgcgaggcgacccgacggctcgaggcggaggtcggcggccagctcgccgagatcgccggtcagatggcccggagcctcgatatcgggatgttcgagcgctggcgcgacatccagatcgccgccgcctcggacagtctgcgcgatcccgggaccggaacggccgccaagcgcgccgtgttggagcggctccaggcgacctacccggcctactcgatcatcgggctgatcgacgccgacgggcgcttctccgtcaccagcaccggcgccctggagggcgccgacgtctccggccgcgactatttccgcggcggccgcgcgggcccctacctgggcgacgtgcatccggccaagctcctcgaggcgctgatgcccccggacgaggccgccgcgcgcgcggcgtcgcgcgagcccctgcggctcctcgacgtcgcggcgccggtgcgggcgccggacggccgcgtcctcggggtgctggccgcccatctcgactggacctgggcgcgcgacatggcccgcatcctcgaggctggcctccggggccaccgccagggcgccgagatcctgatcctgtcccgcgacggcaccgtgctcctcgggccgcccgccctgcagggcgcccccctgccccgctcggtgctggcgggcggccggcccctcgatccggagggcacgagccgggtcggcccctggccggacggcgccgcgtatctcagcgcccgcgcgtccacggccggccaccgcgactatccgggcctcggctggcaggtggtggtgcggcagacggccgaccgggccctgacctcggtggcggccctgcgcgggggcatcctggcggcgggcagcgcggtggccctcgcggcggcgctgctcgcgtggctgctcgccggcctgatcgcccgccccctgctggacttggcggccgcggccgagaccctgggccgcgaccagcccctgccgccgctgccgcgctccttcgtgcgcgagggcgcgacgatcgccgacgccctggcggcggcggcggacgagcgcgcccggcgcgccgagacgcaccggctgctgatcgacgaactcaatcaccgggtgaagaataccctcgccaccgtgcaggcgatggcggcgcagagcctgaagaatctgggcgccggcgcggcggccgggcgcgacgccttcgaggcgcggctcctcgccctgtcgcgcgcccacgacatcctgacccgcgagagctgggcgagcgcggatctgcgcggcatcgccgcccaggcggtgcgacccttcctgggtccggaccccgcgggcgacgatccgtcgaaccgcgattcttccggtcgggagacttcggaccgtgacgctgcgggtggggacactgcggaccgggacactctgggtgcgaacaccccgcgcatcaccctggacggccccgacctgcggctgccgcccgagggcgccctcgcgctcacgatgatcctgcacgaattgtgcaccaacgcggtcaagcacggcgccctgtcggttccaggcgggcgggccgcactggcctggacggtggaggcgggtccggacaccgagaccctgcggctgacctggcgtgagtgcggcggcccgccggtcgtctcgccgtcgcggaaggggttcggcacccgcctgctcgagcggggcctcgccgggggcaggaccgccagcctcacctacgaggccggcggcctcgtctacgtggcggccaatcccctgcccgcggcgcgtctccacaccggacgggcctga

SEQ ID NO: 6258 - DNA, 336 bp, Methylobacterium sp.
atgcgtcccggtcccgccccgatcctcgccgtcctcctgtcgacgctcctcttgccgacgctcctcctgccgacggccctgctgctggccgccccggccgaggcccgccggcaggccgcgccccccgccgggcgaccgcatcaccgcgcggcctccgacatggacctgaccctcgcccgcatggcggcgcgcgaccgtccgctctggcgggtctggcagcggccccggcccctcgcccgcacggtcgcgccggcgacgcgcgagcgggtcgcggcgccgccgctcacgggctggggctacggtggcaccgtcccgggtgccgcgcccggcttctga

SEQ ID NO: 6259 - DNA, 267 bp, Methylobacterium sp.
atgccgcacttcggcgggagcctgctcatgcggtacgcacgcaccatccggctcaccctcctgctgctcggtgccggcccgctcctcgacccggccgtcgcggcggattggccgcgcgacccgcatccgccgcgcagcgttcgataccggagcccggtccggtccgttcccgccgtccccccgcccgtcctggtgcggggctacctgccgcgcaaccacaacgtcccgatgtacaacgagccgccccgccgcgagccggcctggtga

SEQ ID NO: 6260 - DNA, 675 bp, Methylobacterium sp.
atggagctgtccggccgcgtcgtcgccgtcaccggggccgcgaggggcatcggccgggcgctcgcggtcgcggccagggcccggggcgcgacgatcgtggccctcgaccgcgacggggccggggcggaggccgtggcggcggaactcggcggccgggccttcgcgctcgacgtgggcgacgcggcggcggtcgccgcggttctggcgcgcatcgaggccgagaccgggccgatcgcgctctactgttccaacgccggcatcctggagcgcgaccccgatccggatctcgccacctccgccgacatagagagctgggcgcgcgccttcgcggtgaacgtgatgggccatgtccacgcggcgcgggtgctggtcccgctctggcgcgcccggggcgggggcgcgttcctcggcacggtctcggcggcggggctcttgagccagatcggcagcgccacctactcggccaccaagcacgcggcgctggccttcctggagcacctcgccatcgcccacgccgaggacgggatccgggtcgccgccctgtgcccgcagggcgtcgacaccgccatgctgggggccgccagcgccgcgtcgcgcgacggcgtgctggcgccggaggacgtggccgaggccgccctcgacgggctggcggcggggcgcttcctgatcctgccg

SEQ ID NO: 6261 - DNA, 1446 bp, Methylobacterium sp.
acaggaccgagcaggcgcgggatcctcgcgggcggcggcgccgcggcggccgccgcgctgctgccgcgggccgcccgggccgcgccgcggatcatcctcaacgacgcgagcggcctcaacccgaccccggtgacgcgccacgccgtgctcccgacgggctcgaccgacgccctgatcgaggccgtgcgcgccgagatccgggaggccgccgccgccggccggccggtcgccgtcggcgtcgcccgccattccatgggcggccagagcctcgcccgcgacgggacggctgtgaccctggacggcggcccgatcgagcccgacagagccgccggcctctaccgggtcggggccggcgcgcgctggtcgcaggtcatccggcagctcgaccggatcggctactcgccgacggtcatgcagtcgaacagcgattttggggtcggctcgaccttctgcgtcaacgcccatggctggcccgcgccgcacggcccgttcggctccaccgtccgcgccctccgcctcgtcctggccgacggcagcctcgtgacctgctcccgcgacgagaacgccgagctgttcgggctggcgatgggcggctacggcctgttcggaatcgtggtcgacctcgtggtcgagatggtgccgaaccgcctcctgacgccgaccttcgcggtgatgccggccgcggatttcgcgccggccttcgcggcggcggtggcgcgcgacgcgcgcctgcgcatggcctacggccggctctcggtcgcgcaggccggcttcttcgacgaggcgatcctcgtcacctacgcggaggccgagcacccgccgcaggtcctgcccgcggcggccgcgcagggggcgttctcggcggtctcgcgggagatctaccgggcccaggtcggcagcgagttcggcaagcgcgcccgctggatcgccgagacccggctcaacccggccctggatcccggcctcgccacccgcaacagcctgatgaacgagccggtggccaacctcgcctcgcgcgaccgcagccgcaccgacatcctgcacgagtacttcgtcccgcccgagcgcttcgacgcgttcctcgccgcctgccgcgagaccatcccgcgctcgggctgcgactgcctcaacgtcaccctgcgctacgtggcggcggacccggactcgacgctggcctacgcgccgggcccgcggatcggcgcggtgatgtcgttctcgcaggggctcaccccgggcgacgaggccgcgatgatgcgcatgaccgaggccctgatcgagcgcgtcgtggcgatcggcggggcctattacctgccctaccgcctgcacgcccggcgcgaccagatggcccgggcctatccgaagctcgacgccttcgtggcggccaagcgccgctacgatccggggctgctgttccggaacgccctgtggtcgacctacatggcctga

SEQ ID NO: 6262 - DNA, 261 bp, Methylobacterium sp.
gtgctcgccggcctcgtcctcctcggcctgtcgggcggcgccgtcgcccggccgttcccggagcccgacgaccggaacctcgaccgccacggccattaccgcagccgggacgggtccgacgtccaccggccggccaagagcctcgacggccggaagcccgcgggcgccacggccaagtgccgggacggcacgtggagcttcagccacacgcatcgcggcacctgctcgcgccacggcggcgtggcgcactgggaaggctga

SEQ ID NO: 6263 - DNA, 234 bp, Methylobacterium sp.
gtgccctacacggtcgagatcaccacgccgccggtgcggatcgacggcgcagaacaggcctcgcggatgtatcagctgccggacccgttcagcacgctggccgaggccaaggaagcggcgatcgcgcatatcgggggcctcggcctggatccggccggcatcctctacaccgtcttcgatcgcgagggtttcacggtcgcctccaacgcggatcagcgcgcgggggccggatag

SEQ ID NO: 6264 - DNA, 366 bp, Methylobacterium sp.
atgaaggcgctgctggcggctgccatggtcttcgggtcgactgtcggcgcgctggcggccgactcgtacgcggattaccgtgactacttcgacgcgaagcccgtcgccacagatcgcgcgccgcgcggtgcttccaagcgggcttacggcgtcgatacgcgccgccccggcgatgagcgcgcggcgaaatcaacggccaacttccggcccggctactggaaccaggccggcggctacgttccgccggactatgccctgcatccgcggggcgcgtcgcaggacggcttctggaccccgaacgacgcgtccgccgccaattggggcgggccgcgggcgttcaccggcacgctcggcacccgccgctga

SEQ ID NO: 6265 - DNA, 141 bp, Methylobacterium sp.
atggcgtccgtcaagatccgcgcgaccgacgacgggaccttcgtggtctaccgcaacggcgccgccgtcgcgtcgggattgacccgcgagcaggccgagcgctgcgccacggtcctgggctggatcgcacaggggcgctga

SEQ ID NO: 6266 - DNA, 231 bp, Methylobacterium sp.
atggccttcgacgttcgagctgtcgcgcgcctgcgcgagatcgcagccgtcattggctgtccggtcgaggccttctacggaccgggtggcgaggccgtcgacctgggcatgacgcacgagctcttccgcctctggcacgcgatacaggatccgaaagcgcgtcagcgcgtcctgaacagcgcgcggcgtgaggctctcggcgacgcggtccacgggacggccgccgaatag

SEQ ID NO: 6267 - DNA, 342 bp, Methylobacterium sp.
atgatcaggttcctcgcggcctcggccgcctgcctggtcctgtgcggcgccgcggcggcgcaggacatgcccggcctcgcgaccctgagcccgcccgacccggtgcagccgctgggggcgagccccgcgctcccggcaccggacggcgcggtcgcgccgggatcgcgagcggaggccggccgggtgcccctcggcaacctcaccctccgcggcaccgccgccgatcccgcgcagacgaccgccagcctgaaggtcccggcgaccggctccggcgcgtccaagccctggtgcgcgcaggagcgccggatcggcaccggtcagggcttctgcctggtcaactga

SEQ ID NO: 6268 - DNA, 819 bp, Methylobacterium sp.
atgcggacgagcctgcggcgcgatctcgactggttcagcttccacggcgcggtgctgctgctggccgggctctgcctcgtcctgctggcggcacccaccgtgatcgtcgtggtggtgtcgttcaccagcggcttctccctgcgcttcccgccgccgggctactccctgcgctggtacgcggcgctcgcggaggccgagcagctccgggccgccgcctggaacagcctcgtggtggcgggctggacgaccctgctgtcggtggcgctgggcaccgcggcggcgctcgccatcgcccggtcgccgcggctctccgcgcggctcctcgacagcctgttcctgtcgcccctcgtcctgccggccctggccttcgggctcgccgccctgatgctgttcagcctcgccggcatcccggtctcgccgctcaccctcgtgctgggccacaccgtggtctgcgtgccctacgtggtccgcaccaccgtggcggccctgtcgcagatggacccggtgctcctcgagagctcgacctccctcggcgcctcgcgcctctacacgttccgccgggtgaccctgccgctgatccggcccgggatcctggccggcggcttcatcgccttcatggcgagcttcgacaacgtcccggtctcgctgttcctgcgcgacgccgccaccgacatgctgccgatccgcatgtggcaggacctggagggccgcctcgacgtcacggtggcggcggcctccagcctgctgatcctcgtgaccgtggtgctcgccgccgtgatggagcgggccgccggcctgtcccgccggatggcaggctga

SEQ ID NO: 6269 - DNA, 903 bp, Methylobacterium sp.
gtgagcgccggcccggccacggcggcgggcccggtcgcggcgcccctccgcccgggccgcgcctggacagcggcctacgacatccgcctcgcgctgccgctcggggcgttcttcctcgtcttcttcctggcgccgctggcgctgctgctgctcgtgagcttctacgccgatccggccatgacccggttcggcctcgaccagtacgcccggttcctgctcgacccgttctccctgcgggtgctcggcgcgaccctgtggctcggcgtcgaggtcacggcgctgaccctcctgctcggcctgccgctggcgctgctcctgacctgggcgcccggccggctgcgcggcctgctgaccctgatcgtgctgctgccgctgctcacgagcgtggtggtgcggaccttcgcgtggatcgtgatcctggggcgccagggcatcgtcaacgccgcgctcctcggcctcggcctcaccgacgcgcccctcaagctgctctacaccgagggcggcctcgtcctggcgctggcgcaggtgcagctgccgctgatggtcttgcccctggtcaccgccctgtcgcggatcgacccgaacctcgccgacgcctcggcggcgctcggggcgggggcgtggcgcaccttcctccgggtgacgctgccgctctgcctgcccggcatcgtggcgggctgcctgctgaccttcgcggcggcgatcaccgccttcatcacacagtcgctgatcggcggcgggcagatgctgttcatgcccatgtacctgtaccagcaggcgtcctcgctcaacaactggccgttcgcggcggcgatcgcgatcgtcttcctcgtggcggtgctcgcctgcgtcacgctcctcaacctcgcgggccgcctgtcgggcggccgcgcgcgggcctga

SEQ ID NO: 6270 - DNA, 1044 bp, Methylobacterium sp.
atgcccctgcaccgccgcagcctcctcgccggcgccctgaccctcggtgccgcgcaggccttcccgggcctgtcccgcgcccaggcgcgcaagctcgtcttcgcgaccttcacgggcagctgggaggaggcgcaccgggccgtgctcgtgccggccttccgcaagagctcgggcggcgacgtcatcctcgacccgatgctgtcagtggaccagatcgccaaggtccaggcggcccgcgccaacccgccgatcgacgtgatgctgcacgatccgggccccgccctcacggccatagcccaggacctcgtcgagccatacccggtggcccagtccgcccattacggcgacctgatcgcggacgcgcaggagccgatgggcccggcgccgttcttccagatcgtcggcctgacctacaatcccgagaaggtgaagacgccgccgacctcctgggccgacctgtggaagcccgagtacaggggccgggtcggcatcaccaacctgaactcgacgctgggcaccggcttcctcgtggagatcgcccgcatgcacggcggctcggagaccgacgtcgagccgggcttcaaggcgctggaggcgctcaagccgaacctcgccgccgtcgcggccaatccgggcgccctggcggccctctaccagcaggagcaggtcgacatcgggccgggcaatttcaacgcgatccagatcctgaaggcccggggcgttccggtggagttcgcggcgcccaaggagggcatcatcgccttcaagacgacgatccacatcgtcaagaacacgccgtcgaaagagctggccttcaagctgatcgaggccgcgctgtcgccggaggtgcaggccaagctgatgcagagcccctacctgatcgtgccgaccaaccggaaggtcgccatcgacggcgaggtcgcgaaagtcctggcgaaggacgcggacgagctgaagcgcaagtcggtgttccaggactgggccgcgatcaaccgcggccggccggcctggatcgagcgcttcaaccgcgagatccgggtgtga

SEQ ID NO: 6271 - DNA, 1023 bp, Methylobacterium sp.
gtgacgatcgcccgatacggcgcagccctggcgctgctctgcggcttcggtttcctgtcgcccctgagggccgacgagtgccccaaccgcggccagctcgacgacgcctactgcgacgccaacaaggacctcgtcgccgacgtcccggccaagacccgcgacccgagcgtcatcgtcttcgcctacacgccggtggaggatcccgcggtctacgagaactcgttcaagccgttcacgacctacctgagccagtgcaccggcaagcgcgtcgtctactacccggtccagtcgaactccgccgagatcgaagcgatgcgctccggccggctcacggtggcgggcttctcgaccgggcccctcggcttcgcggtgaacatggccggcgcgatcccgttcgccgccaagggcaccgagaagggcgccgagggctacaacctgatcgtcgtggtgaaggcgagcagcccgtacaagacgctggccgacctcaagggcaagcgcgtggcccacacggcgccgtcgtcgaattccggcaacctcgcgcccaaggcgctgttccccgagcaggggctgaagcccggcgaggactacaagctcatctactcgggcggccacgacaagtcggcgctgggcgtcggcaccggcgactacgacgccgccccggtggcctcggacgtgttctaccggatggtcgcccgcggcacgatcaagggcgacgattaccgggtgatctacacgagcgagaagttcccgacctcgggcttcgcctacgcccacgatctcaagccggaattggccgagaagctgaagcagtgcttctacgacttccgcttcccgcccgacatggtgaaggatttcgagggcgacgaccggttcgcgccgatcacctacctcaaggactgggcgatcgtccgcaaggtcgcggaggaatcgggcacgccgtacaacaaggtcgcttacgagcgcgaggccgcccgcgaggccgaggccgcccgcaagaaggccgcgggcgcgcccaagccgtga

SEQ ID NO: 6272 - DNA, 858 bp, Methylobacterium sp.
gtgacgcaggccgtgaagcaggccgtgacgcaggccgtgacggcggggagcgcggcgcgcgcggtggcggccggacccgagggcgatccccgggcggaggatccgcgcgcgctggttatccgcgggctgaccaaggcgtaccgggccggccagccggtcctgaagggtatcgacctcgtggtgccgggcaccgggctcacggcgatcatcgggccgtccggcaccggcaagagcaccctgatccgctgcatcaaccggctcgtccagccgacctcgggggagatcctgttccgcggcgaggacctcgcccggctctccggtcccgccctgcgccgggcgcggcgccggatcgggatggtgttccaggagtacaacctggtcgagcgcctctcggtgatggagaacctgctctgcggccgcctcggctacgtgccggcctggcgcgcgtggctgcggcgcttccccgaggcggacatcgcccgggccttcgacctcctcgacgcggtcggcctgtcgggcttcgccacccgccgggccgacgccctgtcgggcgggcagcgccagcgcgtcggcatcgcccgggcgatcatgcaggagcccgagatcgtgctcgccgacgagccgacctcgtccctcgacccgaagagctccgtcgagatcatggagatcctgtcccggctcgcggccgagcgcggcgtgccggtggtggtcaacatccacaacgtggcgctcgcccagcgcttcgccgcgcggatcgtcggcatgtcgggcgggcacgtggtctatgacggtccgccggaccggctgagcgaggccgacctgcgcggcatctacggcggcgagaactggctcgaatga

SEQ ID NO: 6273 - DNA, 783 bp, Methylobacterium sp.
tcccccgacgccgccgaccgcgtcgcgttccggcccaactggaccgcccgcgccggctgggcgctcctcgccgtctacgcggtctacgcggcgacccagctcggcttctcgcccgagcgcttcgccggcggcctcgcccacgggcagcagttcctggcccggatgttcccgccgaacttctcccgctgggagctgatccagtcggggatcctcgagagcctgcagatcgccgtgatcgccacggtggtcggcatcgcggtcgccctgccgatcggcttcctggcggcccgcaacctgatgccgccctgggtgacgtggccgacccggatcctgatcgcgctctgccggtcgttccacccgatcatcgtggcgatcctgttcgtgaaggcgatcggcttcggggcgctcgccggcgtcatggcgctgatcgtcgcctcggtgggcttcatcgccaagctgttcgccgaggcgatcgaggagatctccctgaagcaggtcgaggcggtgcgggcgaccggcgccggcttcctgtcgaccctgatcatgggcgtgcagccgcaggtgctgccgcgcttcatcggcttcgccacctaccagctcgattccaacctgcggaactcgaccatggtgggcatcgtcggcggcggcggcatcggcgcgacgctgttcaccgcctaccagcgcttcgacttcgacgtggtgctggcgatcctgatcgtcatcgtcgccctgatcatggtggccgagatcgtctccggctgggcccgcaaggtgttccagtga

SEQ ID NO: 6274 - DNA, 1230 bp, Methylobacterium sp.
atgttcgggtcgcggcgccggcgggacgaggcgtacgacaacgagaaggcgcaggcgctgatccgggccgtcgtcatcggcctcgcctgcctgtatctcctgccccagatctacggcgggatcgccccgccggaggcccggttcgtcgcctatctggtgacgtgccactgggtcttcgccgtggcgctgtacggctggatcagccgcaaccccggcagcaacacgccgcgccgtgtcgtcaccttcctcctcgacctcggcgggatgacctacacgatggcggtgggcggcgcgccgttcctgccgctctacgcgatcgtcatccggctgatcgtcggcaacggcctgcgctacggcgtcaccgccctgaaggcgtccacggcggcggccctggtctcgatcgcggtcaccacgtacttcaacgcgtactggcgcgcgaacccgttcctcgtcctgacgctgacggccatcaccgtcctcgtgccgacctacatctacagcctgctggagcgcctgcgcggcgcctacgagcgcgagcaggaggcgagcctgtccaagtcgcgcttcctggcgcaggcgagccacgatctgcgccagccgatccacgccatcagcctgttcaccgcctgcctgcgcggcgcccggctggggccggaggagctgcagatggtcgagaacatcgaccggtcgctgcagagcgtctcgcgcctgttcaagtcgctcctggacatctcgaccctcgacagcggccgggtggagccccggcccgagcccgtcgcgatcaacgacatcctcgaggatgtccggcgccagaactccgaggccgcccagatcgccgggacggccctgcgcagccgcgcctgcgcggtcgtggtgcgcaccgaccgggccctgctcacgaccatggtccagaacatcgtcaacaacgcgatcaagtacgcgcccggccggccgatcctgatcgcctgccgccggcggggcgaccggctcgccatccaggtctacgatcgcggccccggaattccggtcgcgcatcaggagcgggtcttcgacgagttctaccaagtccgccgccgcggcgaccgggatgtcgagggggtgggcctcggcctgccgatcgtccggcggctcggcgcgctcctggacctgacggtgacgctgcgctcggtgccggggcgcgggacctgcgtgacgatcggtaacctgcccctcgcccgggccccggagccc

SEQ ID NO: 6275 - DNA, 150 bp, Methylobacterium sp.
atgaagcgcctcaccctcatcggcatcttcatcgtcctgctgctcgccatcgtggcgatcgcggccacgtggtcgaaggtcacgcccgtcaatccggcggtcgcgccggacacgtccgcgacgcccaaccccaccggcgagcggaaatga

SEQ ID NO: 6276 - DNA, 225 bp, Methylobacterium sp.
atgggacaggatgtcgacgccgcgcgggaagccctgggaacggtcccgccgggccggccggcagccccggagaagcgccccgatccggcggccggcggcagcggtccccacgccccgggtcccgttgagcccggcaccgacgcggcgccggagagcggcggctacgacacccggccgcccgcgccgcagccggacaatcggaagggcggatacggcgccggctga

SEQ ID NO: 6277 - DNA, 141 bp, Methylobacterium sp.
gccacgatcctgccggggctcgacacgcggcccgccccgatggcgccgctgcacccgcccgccgccatcaacgacaatcccctccaggccctccacgacgccgtcgagcgggacctgcgcgccagcggccacctgcgctga

SEQ ID NO: 6278 - DNA, 189 bp, Methylobacterium sp.
atggccgagcctgagaccttcgacatgcggccggatgccgagggctggacggtctacaacgtgcgcaccgataagcctgcccgggtcaaaggcgtgccgcagaccggcctggagatggaaaaggcggacgacctcgtggacctgctcaaccgtctggcgcatcggacgggcgaaagcttctcgctctga

SEQ ID NO: 6279 - DNA, 474 bp, Methylobacterium sp.
atgtctgacccgatcaccctcgacacggtcgcggccgggcgcctgcgcgatgccggccacctgaactacggcaagcgcggcggcggcacgatctggcagcacacgacgatcgcccgcctgtccgcgatcgaccggccaacgctgagcgccgaggagaccaagcggctcggcgtgtcgcgcctccgcgagtggtgcgtcgacggggtcgcggtcggcagcctcgagacggcgatcgccgcgctggccgtgcctccggtgctcaccgaggaggagaccgccatcctggcgcgcgtgcctgccgactgggtcgagctgcacgcctttcgcgaggcgctcggcgcggagtggggcgcgccggttggagcgacgctcatcatgctccggcagaagggcgcgatccagaacgagcggcggccgggcgagacgcgcccgcagccctggatccgccggacgccggaggccggccatgggtga

SEQ ID NO: 6280 - DNA, 405 bp, Methylobacterium sp.
atggtgagttctaacgacccgccccgcgccgaacgcgtcgaggtgatcacctccgtccagcggcgtcggcattggaccacgcaggagaaggtgcgcctcgtcgaggagacctatctgcccggtcagtccgtctcgctcgtcgcccgccgccacgggctgaacgccaaccagctgttcacgtggcgtcggctgatggagcgcggcgcgttcacggccgccggtgccggtgaagaggtggtgccagcctccgagctgcgggctgcccagcagcagatccgcgaactgcagcggctcctgggcaagaagacgctcgagaccgagatcctgcgcgaggcgatggagcgggtcgtcgcccccaaaaagttgccctcgcgcgtgacctcgtggccggaggacggccggtga

SEQ ID NO: 6281 - DNA, 294 bp, Methylobacterium sp.
atgtcatccgatccgaccgccccgccggtgcacggcgagatcctgtccggcgttcagcgtcgacggcgctggtccaccactgagaagatccgcctcgtcgaggagagccagcagcccggctcgtccgtgtcgttcgtcgctcgccgctacggcatctcgcccagcctgccgttctcgtggaagcggcgcatgctggagggcggccatcaggctgtgcacgccgacgaggaggtcgtcggcaccagccgggttcgcgagctggagcggcgcgtgcgcgacctcgaacgcctgctc

SEQ ID NO: 6282 - DNA, 753 bp, Methylobacterium sp.
atgtactgcttcgggatctccctgccccggttccgcgaacggcacgcctacctgtcccggcacctcgccgaggtgtgggggccgcgctgcgagatcaccggctatgaaggcccggtcccggatccgaacgccccgttccaacccgacctgacggccggtcagatcgggtgcgcgctgtcccacatgagcgcctacgagcggatgatcgcgctcgacctgccccacgcgctcatcgtcgagggcgacgtcatcctgccgcctcagatccatcagatcgtggccggcatcgaggccgccttgcggccgggcgacgtcgtcctgctcttcaattgggccgagatggtcgggccgttcagctcagtcgacaccgtgaccgtcggcgaataccggttgtgcctgcccatggacatgagcagcctcggcacggccgcagcctacgtgatcacccggtcggcggccgaggggatcctgcgggccaaccgcccggtcgcggtgacgtcggacaactgggcctacttcttcgagcgcggcgccctgacatgcggtcgcgcgctcgtcccgaacgccgtctcgcggaaaccattcgagtcgaccatcttcacgtcccgctccaggatcgcggccttcctgaagggcagcccgatcctcaagcccctcttcaccgcgcgccgccgggtcctggcggagcgggtcgccgccaagctgacgttcgtcgacgagacctcacccctcgccggacacgcgccgcgctga

SEQ ID NO: 6283 - DNA, 414 bp, Methylobacterium sp.
atgaccgccccctcgaccgaggccgccctgacggtggtctacgacggcgaatgcccgttctgctccaactacgtgcacctcatggccctgcgccggtcggtcggcaccgttgccctggtggacgcccggagcgggggtcccctggtcgacgagatcgcgcggcgcgggtacgacctcgacgagggcatggtcgtccggcacggcccggacctctattacggcgcggacgcgctcgtcctgctgtcgcgcctcagcgacgaccggggcgcggccagccggctcctggcgcggctgctgcgcagccccggccgcgcgcggcttctctatccggcgatgaagctcgggcggcgcgtcacgctccggatgctcggccggacgcgcctcgcgcggcccggcggcgcgccggcccgctga

SEQ ID NO: 6284 - DNA, 885 bp, Methylobacterium sp.
atgccgagcgccacgacggacgacgggatacggctccactacgaggagagcggccgggggacgccgctgatcttcgtccacgagttcgccggcgatcaccgcagctacgaggcgcagctgcgccatttcggccggcgctatcgcgcggtcgcgttcaacgcccggggatacccgccctccgacgtgccggaggccgtctcggcctacgcgcaggcgcgcgccgccgacgacatcctggccgtcctcgaccatctcggcgcgccgaaggcccacgtcgccggcatctccatgggcgccttcgcgaccctgcatttcggcctgcggcaccccggccgcgcgctgtcgctgtgtctcggcggctgcggctacggcgcggagcccgagcggcaggccctgttccgcgccgaggcggacgccaccgccgcgatgctgctccgcgacggcatggcggccttcgcggagcgctacgccgtcgggccgacgcgggtgcagttcgagaccaaggacccgcgcggacacgccgagttcaagcggatgctggccgagcactcggccctcggctcggccaacacccaggccggcgtgcagaaggggcggccgtcgctctacgatctcacggacgagctggggcgcatgaccgtcccgaccctgatcgtcgccggcgacgaggactggccctgcctcgcccccagcctgatgctcaagcgggtcattccctccgcggccctcgccgtgctgcccaataccggccacgccctctcggtcgaggagcccgacgcctacaaccgcctgctggacgacttcctggcgcaggtggagagcggccgctggccgatgcgcgacccccgggcgatctcggcgacgatcaccggcatcaggggctga

SEQ ID NO: 6285 - DNA, 552 bp, Methylobacterium sp.
atggcccgcgctctgccggacgttacctccatcgaagagggtgttgggctcctccggacccagctcctgtcgatctccgacgcgatcgcgcgcacgcgtcaggagatcgcagacctccggcaggaacaggagacgagccgcgcgcgcgatgagctcctcgccgtggtgcagggcaccgaagacgccaccaacgcgatcctgacggcttcggagaaggtggatacgctcgcgcgcggcatcgtgagacggtcgggcgaggacgccaaccgggccgacgcccgggccattcagatcgagatgcagacgatcttcgaatcctgcaatttccaggacctcaccggccagcggatctcgaaggtcgtgcgcacgatcgtcctcgtcgaggagcggatcggcgagatgctgcgcgtctggtccgggcccggcgacgcgccgtcacggccgaatccgacgaccgacacgcgcagcgaggaggcggccctgctcaacggccccgtcctgcccggcgacgcctcggtatcgcaggacacggtcgacgcgatgttcccgtaa

SEQ ID NO: 6286 - DNA, 585 bp, Methylobacterium sp.
ttggggctggtcctgctcgctgcagtcgcgggcgccgtgcatgcgcaagcggccggggcgccgaagagcgagccgctgatgaccgtcgcgccggcgccgtccggtccggccggcctcgcatcggccgatccgcccgccttgcgctacggtgtcctgtacgccgacgacaagggccacagccatgtccagtactgcgacctgaagaacttcatcttcaagagctacgcgcctccggcggcgccgcaatatgtcgggttcccgccgggtgaggtgacgtcgatcaagtacgcggttcttccagtgggctatgtcggcacgtggcacacggcgccgggtccccagtgggtgatcaccctgtcgggccgctggtcggtggaggccacggacgggtccgtgctggagcaggggcccggcgaggtggaattcaacgccgacatgggatcgacgccgcaggggcctgagggccatgtcggacacctgacccggcaggtcggcgacgtgccgaacgtgcagctcatcgtctcgctgaagccgcaggccggaaaggcccgctccaccgatccgtgccagccgtcccagccctga

SEQ ID NO: 6287 - DNA, 465 bp, Methylobacterium sp.
atggtcctcggcgagcgcgagcaggcgaccgacgccctggcccgggcgcgcacggccctcgcgggcgacccgcagggtctcgcccaggtcgagcagggcgcccgcgccgtgggtctcggcgccgagggcgcggcgcccgcgccggccgaatcgggccggacgggaccgagcgcccaggccgagaaggaggccgcgatggcggccgtgcgcgccatgccgcaggcggagcagcaggcggcgattcgcgggatggtcgagggactcgaccggcgcctcgccgcgcggggcggcacgccggacgagtggatgcggctcgtgcgctcctacagcgcgctgggcgagcgcgaccaggcggtgaaggcgctcgaccgcgcccggatggcgctggccgccaacagcgaggcggtggcgcggctcgacggtctcgcccgggagctggagcttcctagcaagccgaacccctga

SEQ ID NO: 6288 - DNA, 327 bp, Methylobacterium sp.
atgatcgtcgagatgcgcgtctactactgcgccccgacccgattgccggccctgctggagcggttccgctccacgacactcggcttcttccagaaatacggcatcgagcagatcggattctggaccacgctcgtcgggcccgacaaccacgcgctcacctacctgctcaagtgggacgacatggcccagcgcgaggcgcgctggaacgccttccaggccgatccggactggatcgccgcccgcgccgagaccgagaaggaccggccgatcgtcgcccggatcgagaacactttcctcgcccccacggacttctccgccctgcgctga

SEQ ID NO: 6289 - DNA, 282 bp, Methylobacterium sp.
atgacgcgcatgatcggaccgtggagcgcgcccgccgcgtggcctgtccgcgcgctcgcggtctgcgccgtccttgccggatcggggccggccctcgcgctggagaatccggcctcggccttctgcgcgacgatgggcgggcagacgatcctcgcgaagctgcccgatggcggcacgatcgggctctgcgcccttccggggcggaagatcgtcgaggaatggacgctgtaccggatgctccacggcgtgaagccggcacccgacgccgacccgttccgctag

SEQ ID NO: 6290 - DNA, 315 bp, Methylobacterium sp.
atgcggaacggctcaccagaggacgaaggcaccacgagacgccgcgcgagaccggtcgcgctggccgaaggaccgcgcggcgcggcggcggcggacggccgcgaccggattgccgggagccagccggagcgcgcggacgcggagccgacggccacgctcggcgatctcggcgacgccctgctcgcggcctatcggctggccgagcaggatggcgacgcgctgaccgtgtcgctgctcggacaggcgctgctgcggaccggccggcgcctggcgcgcgggatgtcgcccgccgatgtcgggatcgcctgccactga

SEQ ID NO: 6291 - DNA, 222 bp, Methylobacterium sp.
atgcagcgtgttcgccgaatcggtcgtgccatcgagaacgggatcgtcggagccgtcaccggaacggtcgcccgcgtcagtcggacgatcgacgggctgatcgggctggtgggccgcctgtccgaccgcctcgacgccaagttggcgtcgctcgccgacgagtcccgggcgcgccaccggcgcgagggccgccggcagatcgacccgatctcgctggagtag

SEQ ID NO: 6292 - DNA, 195 bp, Methylobacterium sp.
atgccgcgcactttccccgcccggcgcgtcccgcgccaccacctcgcgctgcaccgctctccactgcggcacgaccgcggcggcgctcagcccctgcggacctccgacctcatcctggcgctcctcggcgtcgtgatgctcggcggcttcgccctgctggccgcctacgcgctgaccctcggcgccgggggctga

SEQ ID NO: 6293 - DNA, 141 bp, Methylobacterium sp.
atgccgatcgtccgttacatcctcgccgagtgcagggccgaccgcgtctacgcgctgatggtcgtcgcgctcggcgggtggtccgccgtgtccctcgcgctgctcgcgctgaacgtcttcgaacccctgcgggtccagtga

SEQ ID NO: 6294 - DNA, 1422 bp, Methylobacterium sp.
atgccgtccttccgcaacaacgccgtcgacccgcagcagatctccagcgcgttcgacagcatcgccaacgccttcaaggtcacgccccaggagatcctggccggcgcgaagtcgcgcgagacgatgcagaaggtccagtacctcgccgacgcctacaagctcgcccaggacccgaacagcgaccagggccagctcgaccgcctcgcctcgatcgcgggcgcctacgcgccgagccagagcctgacggcggtggaccgaaacaacgccacctcgctccggacgaacgcggccgacaacgcccgcgcgctccaggttgcccgcgaggggcaggccggcgagacgacccgcaccctcctgtcgccggtcggggaggggcagacccgcttcatcccgccgtccgtcgcgagcctgtacgggctgccggcgcagcagatcggcgccgtgaaggcgaacgaggggcagacggtggcgctgcccggcggcgggacggtcgaggggcgcgagaagcccctgacggaggacgccgtcaaggcgcgggtgctggccggcatggagccggcggcgcagcgcgcggccgccttcggcaacacgcccgtcgagaccgtaatgaccccgcagggcccgcgcatctcctcgcgtctggacgcgatcggacaggccccggcgccggacacccagaaggctcagttcttcaactacgacaccccggacgggaagtccggcaccgcccgcacggacggctcgggcaagctcgtcgacacccagaccggggccgagctgccgccgggctcgcgcacctacacggcccagctcacaggcaacaagacggacacggggctcggcgcgagcgcgaagtccaacatcgagacgcagctcctggatctgtcgaacctggagcagagcgtcaacgcgctcgacaagatcgccacgagcaatccgcagtcgatcggcctcaccgggcaggttctgggcatcggccaggacgccatggcgacgatgaaggaagctgcgaccatgttcgggcccaaggcccaggactatctcaagcaggtcgaggacggttctctgcctccggagatgtcgcgatacttcaacccgaacatcccccaggcgacgttgcttgagaacaccatcctggcgcagtacgccaagatgcaggacccgaacggccggctcagcaatcagcagatggagatcgccgccaaggcgctcgggatcgacggcatgctcaagtcggctgacaagacgaaggccgtcatcgccggcatccggcagcagattgcgcagaagcgcgccatgctcggcggcgccgcgccggccgccaacgcgatccggccgccggacgctgctggtgggcccgccccggcgccggccggtgcgcctgttcgtcggaagtggaccgccagcggggagctacagtga

SEQ ID NO: 6295 - DNA, 807 bp, Methylobacterium sp.
atggaacgggaccggcggcacaaggccttcatgcgccgcggggagatcctgccggagccgggcgtcgaagcgccggtcgagggcgaggccgaggcccagccggaggccaagcccgccgaaagcccgcgggagaagcaccagcgagaacgtcgtgagcgagaggccgagcgcgtcgcggcccgccgggcggagtacgacctgcccgagggcaagcagtgggcgatggtcgaggcctgcgtcggccggaccggcgagctgtgcgagaagctgacccaggcgaagatcccgcacttccgccctcgcgacgagatcgaccaggtcctcagctcgggccggatccgcaagatgcaggtgccgctgttcgaccgcaccgtgttcgtcggcctgaaggatcgaggccagctcgaggagctcgccgccgagcatccctggctgatggagcggcgagtctacggggacatgccgtggctacgtcgggacaagacatgggcctgggacgtcgagcacgttgagcgctgcgtgctgggtcaggacaaggacggccacccggtgatcgcggcggccaccatcccggacaaacagatgcgcgagttcgccgagaccctgatcggctcgatgccggtgttcgacgtcgaggaggtgttcagcatcggcgagagcgtgcgcgtcgccgacggcccgttcgccagcttctccggcgtcgtcgaggagttcgatgcaggccgcggcatggtgaaggtcgaggtctcgatcttcggccgccccacgcccgtcgagctcgaactgcaccaggtcgagcggcagtga

SEQ ID NO: 6296 - DNA, 240 bp, Methylobacterium sp.
gtgcagcccgatccgagaccgctccccgacagcctgacgcgcctgctcgccgtgccggagcagcgcccggtccgggcgcgtccggcgctctcgcggacggccggcgcgccacgggcgccgaagccgcgctccgcgcacgccgcgctcgagacggcgatcatccgcgggttcgtgttcggtctcgcggggctcgtctggctcgtcgtgctggcactgtcggtccggcacatcgcgcactga

SEQ ID NO: 6297 - DNA, 1290 bp, Methylobacterium sp.
atgtccgacgaccgctaccaccggaaggcgctcggcaaccgcccgctccgtcccgagacgctgatgctcggctacggctacgacccggccctgtccgagggcgcggtgaagccgccggtcttcctgacatcgaccttcgtcttcacctcggccgagcacggcaaagccttcttcgactacgtctccggacggcgcgaaccgccggtcggcgaggcggcggggctggtctactcgcgcttcaatcacccgaacagcgagatcgtcgaggatcggctggccgtcttcgaggaggccgaggccgcgctggtcttctcctccggcatgtcggcgatcgccaccacgatcctggccttcgcgcggcccggcgacgcgatcctgcactcgcagcccctgtacggcggcaccgagaccctgatcgccaagaccctggccggattcggcatcgcgccgttcgggttctccgacggcaccgatccggcgagcgtgcgcgccgcggctgacagcgcggccgacgcaggacgcgtcagcgtcgtcatggtcgagaccccctcgaacccgctcaacaccctcgtcgacctcggcctcgtccgggcggtcgccgaggagatcggcgcccggcagggtggcgaggcgccggtcgtcgtctgcgacaacaccctgctcgggcccctcttccagcacccgctgcgcgaaggtgccgacatctcggtctactccctgacgaagtatgtcggcggccattcggacctgatcgccggcgccgccctcggctcggcggcgcggatgaagccggtgcggctgctgcgctcggcgatcgggaccggactcgacccgcattcctgctggatgctggggcgctcgctcgagaccctgtcgctgcggatgaatgccgccaaccgcaacggcgagatcgtcggccggatgctggcggcgcacccgaaggtggcgcgcctccaccatctcgcgcatctcgagcccggatcgcggcaggcgcaggtctacgccaagcagtgcgcggcgccgggctcgacgttctcgttcgacatcgtcggcggcgaggccgaggcgttccgggttctcaacggcctccagctgttcaagctcgccgtcagcctgggcggaacggagtcgctcgccagccacccggcctccacgacccattcgggcgtgccgaagacggtgcgcgaccgactcgggatcacggacgcgaccatccgggtgtcgatcgggatcgagcacccggacgatctggtcgcggacctcgcggcggctctgtccgtcctgggctag

SEQ ID NO: 6298 - DNA, 2118 bp, Methylobacterium sp.
atggcccccagcgccacccacgatctcgggacgagcctcttccggccggaaagggtcgcggttgtcggcgcatccgacgacgcgagcaagacgaccgcccggccgctgcgcttcctgcgccggtccgggttcggcggcaccgtctacccggtcaatccccaccgggagaccgtcctcggcgagcgggcgtggccctccatcgagagcctgccggagacgccggaccatgccttcgtcctggcgccgaccgaaggcgtcctcgaggccgtcgccgcctgcgccgcccggggcgttcccctcgtcagcgtcctggcggggggcttcggcgaggcggggaaggccgggcgcgcgcgtgaggccgaactcactgccatcctcgccggaagccgaacccggctcctcggcccgaacagcatcggcatcgtcaacgtcaacaccggcctcgtgctgaccgccaacgccgccttcgcggagcccacgctgccggcgggcggactgttcgtcgcctcccattccggcagcatgatcggggcgatcctgtcccgggggctcgccaaggggatcggcttcgcgggcttcgtctcgacgggggccgagctcgatctgtccctcggtgagatctgcgcggcgaccctcgacgatccgctgatcgacacctatgcgctctttctggagagcatcgcacacggcagtgcgatccgggccttcgcgctcgccgccgccgcccggggcaagcccgtcattgcctacaaacttgggcgctcggcgcagggggctgagctgtcgcaatcccataccggggcgatcgccggcgaggatgggatcgccgacgcattcctgaaggattgcggcatcgtccgcgtcgagacgctggaaggtctgatcgaaggcgcggcgatgctgcggcgggtcggccggtccgggcgcagcgtcgccgccaagccacaggtggcagtcgtgacgacgaccgggggtggcgcggcgatggtggtcgaccagctcggcctgcgcgacgtcgcggtcgtgtcgcccagcgtggagacgatggccgctctcgccgcacggggcgtggctgcggcgcccggtcggatcgtggacttgacgctcgcgggcacccgaccggccgtgatgaaggccgccctcgacacgctcctcgccgcccccgaattcgacgtcgtggtcgcggtcgccggctcctcggcacggttccagcccgagctcttggtgccgggcatcgtcgaggccgcgtcgggagcgacgaagccgctcgttgccttcgtcgctcccgaggcccccgaggccttggcgcgcttggccggggccggcatcccgtgcttccggactccggaagcctgcggtgacgtcgtggccgccgtgctcgggcgccgcccggccaagcccatggtcccgaccaagcccgtgaccgatgccgaggccgccctcgcgcggcccgcgtcccctcaccagctcgacgaggccgagggctacgcggtgctggcccgcctcggtgtccccgtcgccccgcacgcggccgtaacgcccgacgcgacggcatccccggtcggctatccggcggcggtcaagctgctctcggcggaggtgctgcacaagacggaactcgggggcgtcgtcctcaacgtccgggacgatgccggcctgcgggatgccctcatccgcatcgtccggaacgtgccgcgtgcggccccggaagtcgcggtggagcggctgctcgtccaggcgatggcccagggcgtcggcgaggtgcttctcagcctgcggcaggatccggatgccgggcccgtggtgatgctcgcggccggcggcgtcctggcggagatccaccgggaccgcagcctgcgcctcgcccccgtcgaccgggacgaggcgctggcgatgatcggcgaggtccgggccttgaaggccctcgcgggctaccggagccgcccgaagggcgatctcgatgccctcgcggatgccgtcgtggcgatctcccgggcagggccggagatccttgaggccgagatcaacccgctgatcgtgcgggacgaggggcagggcgtcgtggcggtcgatgcggtcgtccgcctcgcggctacgcaggaaggatctgcagcatga

SEQ ID NO: 6299 - DNA, 279 bp, Methylobacterium sp.
atggtcgacaccgttgctcccgtgacgctggattatgccgagcaggtcgcccgcgtcctgcgctccaatgcggagacggaaaagttcgtggccgagcagcggaagctgatcgaccagcagaccaagcttcaggccgaggcggcgaagctgcacgccgagacgctcaagctcggtcgagaccgtgtcctggccccgctctccatcggtttcgccagcatggcagccgcggccgcattcttcggcgcgggcgccgcgttcgtcaaactcctgagcccctga

SEQ ID NO: 6300 - DNA, 492 bp, Methylobacterium sp.
atgtcctcccacgtcccgacgctgcacctcgtgtgcggcaagatcgccgccggcaaatcgactctgaccgaccgcctggggcagagccccggcaccatcgtggtcgcggaggatccgtggctcgcgcggctctatcccggtgagcagacctccctggccgactacgcgcgcaacgcggcgcgtctgcgcgacgcgatggcgccgcacctcgtggcgctgctgcgcctcggcctgtcggtcgtgctggacttcccggccaacaccgtcgccagccgggcctggatgcggaccctgttcgaggcggccggcgtcgcccaccggctccacgtcctcgacgtgcccgacgcggtctgcaaggcccgcctccgcctgcggaacgccgagggtgcccatcccttcacggtgacggacgcggagttcgacctgctcggacgctccttcgtgccgccggcgccggaggaaggcgtcaccctcgtcgttcatcgggcgtga

SEQ ID NO: 6301 - DNA, 588 bp, Methylobacterium sp.
atgatggccgacgcaatccagggtccccgccctcggccggtcgacctctcggccgccctcgacgcctccgggatcatcggcgcgtggtcatggtcgccgcgcgccgagcggtgcgtcctcgatgccggcgccgccgaggtactggccggggatcccgggctcgccggacgccctctcccgctctcggtcgccaaggcctgcgtccatcccgaggatcggccggccgtggtgcggcagttcaaggccttgcgcgagcgcggcggcctgttcgtggccgagtaccggacgctgtcaccctcggggcaggtccgccggatcctcgatcgcggccggatccccccgggcgcgtcgagccggcgcctcgggcacggtgtcatcatcgacgtgaccgacgagcagccggcgacgcgcgcgatggccgagcccgcggacgcgctcacccaggcggtcgaccgcgctctcgaatgccgcgacgccctggagggggtggcggattccgagcttcaactcctcatcgacatgctgctgctgcacctcggacggcgcatcgccaaggccgccacgaccggcgcgcgccgcggccactga

SEQ ID NO: 6302 - DNA, 1434 bp, Methylobacterium sp.
atgaacggatccggttcggacgaggccgccgcgacgacgcggacctggaccgaggcccatcaggccgccttcgcgcgggcgaccggcgacgtgaacccgatgcacatggacgcgcggatggcccggcggacgctcgccggcgagcgcgccgtccacggcgtccacgccgccctctggaccctcgatgcctgcgcggacgcccatcccctcgaccggctcgcgacgctgcagatgcggttcgagcggttcgtgctggtcggggaccgcaccatcctgacggtccacgaggcggacgcgcgacagctgcgcctgtccctggcggtggacggcgtccgcaccctgaccatccaggcgaccttcgcggcggaccgggcaccggcccaaccggtcgaggcgacgccgaccgcgatccccgcggagccggtcgcttgcgatccggcggcgctgccgggcctcgccggggccttcgcactgccggacccggcggcgatcgccgcgctggcgcctcgcctcgcccgcgccctcggcccgggccgggtcgcggccctgggcggcctctcgacgctcgtcggcatgttcgtgcccggtctccactcgatcctctcgaagatcgacgtgaccgtcacagagggtggcaccggctcgagcctcggctacgcggtgaagcggttccagccaatgctgcaatcggtgacgctggacgccgtcggccccggcctcgtcgcccgggtcgaaggcttcgtccgcccgcggccggtggagcaggagagcctgcgggacctcgcggcgctggtggagccgggcgccttcgcggcggtgtcggcgctgatcgtcggcgggtcgcggggcctcggcgccgcgaccgccaagctggtcgccgccggcggcggggcggtctgcatcacatacgcatccggcgccgacgaggcggaagcgatcgcccgggagatccgcgacgccggcggccgctgccaggtcctccgctacgacgccgccgagccggccgccccgcagctcgcggcgctggcgatgcgcccgtcgcagctctaccatttcgcgacgccccgcatcttccgccagaagcgcgcccccttcgagccggcctgcctggacgagatgatgcgcgtctacaacaccgccttctacgagctgagccagttctgcctggagcgcggcgacgccgtggcggccttctacccgtcgaccagcgccatcgacgaggcgccccgcgacaccctggaatacgtgatggccaagatcgccggcgagacgctcgccgcgaccctggcgcgcacgctcccgaacctgcagaccgttatcgagcggctgccccgggtgaagaccgaccagacggccacaatcttccccgtgccggccgccgcgccgagcgcgctgatgctgccaatcatccggcggatgtcggcggccgcctga

SEQ ID NO: 6303 - DNA, 318 bp, Methylobacterium sp.
atgacaccccctacatccacatcgtcgcggagtgaccgcggcgccgtcgaggcggctgcccgcgcgaccttcgcgcggctcgtcgagacctgggggcgcccggacctggagaatcccgggcccgaggacgacgtctacgagcggctcgattccttcgcggtggtcgagctcctcctcgagacggaatccgagatcgagcggacggtcggccgctacgtgccgctcgccaacgagagcatcctcgacagcacgaagtcgccgctccgccgcttccagggctggatcgactacgtcgccgagacggtcgagcatggctga

SEQ ID NO: 6304 - DNA, 228 bp, Methylobacterium sp.
atgaccgagggcgcattcctggacgagctcggcacgatcctcgaccagccggggccgctcgcccgcgggcagagcctcggggcgatcgagaccttcgactcgctcggcatcctcaacatcatggcgctctacgacacgctgggcctcgaggtggatccgcagcggatcgccggggcggcgaccaccgacgacctgatcgcgctggccggcgcgaagctgcaggcctga

SEQ ID NO: 6305 - DNA, 738 bp, Methylobacterium sp.
atgtcggagccgatgtcggagccgggagggcacgtcctcgtcgtcggggccagcagcggcatcggtcgcgccgtcgccgagcgcctccgcgcgggcggggcgcggatcaccgccctcgcccggcgggcggaccggctcgccgagctggaggccctcggttgcgccgccgtcgcggccgacgtcaccgatctgccggcgatcggcggcgtgctgcaggcggcggtggccgagcgggggctcctgaccggactcgtgtactgcgcgggcgtccaggtcatcaagccgatgcgcagcctcggcgtggaggaggtcgagcgcctctaccgcaccaacctcgtcgcgccgaccctgttcgccgccgccttcggcagcgcccgcgtctcgacccgcgacgcggtgttctgcgcggtctcgtccgtcgcggcgcagaggcccgagccggcgatcgtgccctacgccgcctccaaggcggggctcgacgccctgatcaagggcctcgcccgggaactcgccccccggcgcgcggtcggcgtcgcccccggctggctcgacaccgagatgacccaggcccatgcccgcctgtacggcgcggagttcaaggaggcgctggagaagcgcagccccgcgggcgccgcgaccgtcgagtccgtggtcgacgccatcgcgttcctgatgtcgccgcaggcccggcacgtcaccggcgagatcctgcgggtcgacggcggggccgtgctgtga

SEQ ID NO: 6306 - DNA, 651 bp, Methylobacterium sp.
gtgaccgggacggcgcagcggctcgcgctgatcggcggtggcggcttctccaaggagatcgccgagatcgcccgcgccctcggccacacggtcgaggatacctactcgaccgctccggaggtccaggtcggccgctaccgcggctatctcgacgcgctgctcgccgaccgggcggagtatgacggcgtcgtgctggccgtcggcggcgtgagccggcgcgcgatccgggcgcgggccgagctgatcgcgtggctcgaccggcacgccctcccctgccccgccctcgtctcgccccgcgcgatcgtgagcccggacgtcgcggtcggcgccggcgccttcgtggcgcacggggtgatcgtcaacgccgatgcccggctcgggcgcttctgcgtgctgaactcggcggccatcgtcggccacgacacggtcgtcggcgacaacaccacgatctcgccgggtgccttcgtcggcggccgctgcacgatcggtgccgacagcctcgtcgggccgctcgccaagatcctccagggactcaccctcggtcaggccgtcacggtcggcatgggctgcaatgtcctgcgcgccctgcccgacaacgccacgatctggccccgggcggacttcgtcgccccggcgccgaaaccggcctga

SEQ ID NO: 6307 - DNA, 1869 bp, Methylobacterium sp.
atgtcacacttcctgcacctgattagagatcatcgcggtgaccaggccgacctgatcgcgcagctcggcgcgctggcggtcgaccccgaggcggcggggaccaatcccgccacgatgattcgccatctcgacgccctggcgttccggctggacggcggcggcgcacccggcctggcggcgcagacctttgacctcgcggccaccctggcgggccgggacggcagccgctgggccctggccgccgcggaggcgcgcctgcgcgacctctgcgctcgcggacgcttcgccgaggcggatccggtcgtcgcgcgcctgcgcgccgcggacgcgaaccggttgcgcccgcggatcatggaggatctgatcgaccgggcctggctgctggagctgcgcggcgaggccgaggcgagcgtccagtgctaccgcttggccctggatctcaacggcggcgcgcccggcctcgcgtcgcgggacggggatctgctcgccaagaagatcaagaacctgcgccggctccagctcgacgcgctgatcgaggccggcgaattcgacgcagccgtcgcgctgcacgagacgacccgccggctgatcggcgccggccccctggcctgctacgacatggtcgccgccgcgtccctggccggccggccgggcatcgactacgccgagcttcggccgtccaggccgatccaggcgccggagctcaagttcaccgaaccgccgccgcccctcacctcggaaccgggggacctggaagcgccgagccagtacctcgcgttcgtcgacggctgccacgccttcccgcgcagcaacctcgtggtgaaggacggccacctgatctacgacctcgctgcccatccccggcggcgggacgtgctactccaagacggggtcaacccggaccagatcgtgatggcggccttcggggaaaggcgggccctcgtcgaggttccggaggacagcctgtcgatcgaggccggcctgtcgatgttcgggctccagagccggaattacggccactggttctgcgagttcgtgccgcgcatgctggcctataacgacccgcgctgcccggacggcatcccgctctgcatcgacgaccacatgccggcgacccacgaggaggtggtccgactcctcgacacgcgcgaccgcccgatcatcaagctgccaccccggccggtggcgttcggccggctcggcctcgcgccggtgcccgccttcttcccgttcgagatgcggccggggcagcgggtctacgacacgatctggcccgccgacatcctggtagatctgcgcacccgcatcctcgacagcgcccgcgcgcgcggggccctgagcggccgcaccggccgtcggctgttcatctcgcggaaggccttcgcgcagcgccagctcgtcaacgaggtcgagatcgccgaggcgctccggccgcacggcttcgaggtcatcaccccggagacgatgacgttcctcgaacaggtcgaggcgttccacgccgccgacatcatcgtcggctcctcgagttcggcgctcaccaacggactgttctgccgcccggattgccggatcctcggcctgatccacgccaacctgagcttcaatttccggggttataccagtttcatcgaggccggcggcgcgcagatcacgttcctgcgcggggcgaccacgaatgaggacggtcacgctttccacgccagctaccacgtcgcaccgagcacggtggtcgcggccctcggatctctggcgcagccggcttccgtcttatcgccgctgcagccacctcaccggccactcagcgcccgctcggtcgtcggtcgactgctcggcgcactccccttcgcgcgtcggatcgagggacaataa

SEQ ID NO: 6308 - DNA, 417 bp, Methylobacterium sp.
ttgggcgaggacttagaggcgctgcgggcggagcttgccgagacccaggcgcggctcaaggaggcgcagggcgagctggcccggctggtgcgcctcgccgaggcggatcttcagcgccggcgccccggcgagcagtcgagcgtcgtcgcctcgtcggtgcgccgccccgccgccaaggaggtcgcggctcggatcgcccgctttgcccacctctatcgggaagccgccgaggccaccccggaccgcgccccggtcgtgcccgagcagacgatgctcgcatggctcgagacatccggcctgttcgaccgccagttctacctcgcctgcaacgacgacgtcgccaatgccggggccgatccgatgatgcactactacaatcacgggtcggaggaggctcgcctgccctcgacgctgtaa

SEQ ID NO: 6309 - DNA, 1659 bp, Methylobacterium sp.
atgagcacgccgatgcaggacaagccgctgttcccgttcgggcccttcctattcctgggcgattcggtgacagccggatggacggcacagaacccgcccctgttctccggaccgcaggccgtgggccgcggcatcgccggccagtcggtccgggacacggcgcgccggctccgctcggagatcgccctctacggcgccaagggcctgcacctgctctgcggtcgcgacgacatcctcgacggcgcgcgcacgcccacgctggacggcatcgtggccgatatcgccgcgatgctgcgggacacaagcgacctgtacgtgcggacctgggtcggctcgatcgcgccggtcgatccgaccgcgcccggagcggccgggcggccgattgcgctgatcggcgcggtgaacgcgtggctgcgcgaccacgtgcaggaatacggggcccacttcatcgactacgatcccgtcctggccacggagacgggcgcgctgcggcccgactacagcgacgacgggatcggcctcaacgccgccggccgcgcggcgctcgaggcggcgacgctggcggttctgacggttccggatctggagccgatctggccgccgcccgagagcgaggatgcggcgcgacggcgcaagttcctgcaccatttcggctatctcgactcgaacacgcgctatccgagcccgttcatccagttcgccggcaagccgggggcgagccattacggcgtcccgttcgacgccgacggcttcctgaacgccgccccgatcgtcgagcgcaagccggagggcgagacccggatcctggtcgtgggcgactcgaccacgatcgacggcggcgacatcgccaacaccctgccgggccgcatcgagcggatcctgcgggccgacggcttggagagcgcgaaggtctacaatttcggggtgatgtcgagctgcctcacgcagatgacgcacctgatctggtcgcggctcgtgacctacggccccgacgggatcctcgtgctcagcggcagcaccgacctgttccagccctggacctacgatccccggccgggccacccctacaacgccttcatcacccagcggctctacgaccacttcttcgacacgcacgatccgcgggcccgcgaggacggcctgtcctacgaggcgctgatcacgctgatctacgaggagctgaagcggctgcgggccgaggtgggctggcagagccccgggtgggaggacgcgatcgtccaccactacgaactggcggcgcaccggctgaccaagctgtcccacgaccacggggtgccgatcgtcagcgtcctgcaaccgacgatcctgcgcaagcgccacctcaccgaggtggagagcggcgtcgcctcgggggcgttcctggcctatctcgaccgtcagtacgccaagctggaggcattcaccgcggagctcgcggcgcggcgcccgtaccggcgcaccttcacggccgtcgacctcagcgggatcttccgcgaccgggaagaggggaccttctacgacatcgtccactacgacgatcccgcccgcgagatcgtcgcgacgcggctcgccgccgagatccgcggggccctggaccgggcccgcgcccgcacaccgctggcccgggtgcggcacctgctcggcggtcggcggcgatag

SEQ ID NO: 6310 - DNA, 1344 bp, Methylobacterium sp.
atgaacggcgacctgatcgatgcggcgttcggccggccctggcaccgcgcggacgccgcggccggcgcgaccgatcacccggccggcacaccgggtttccaggtcgatctcggcttccgctgcccgatccgccgcgtcgagatcgcggccatctcggcttcgccgccgcgcctcgccctctccgacgacgggcaggcctggcgcgcggccgacctcgacgcggcccggagcgggcccgcgagcctggtgctcgccaccggggagggcgcctgggcgcgccacgtccgcgtcacctcggacggcccagccggaggggcgccgccggaggcgcgggtgctgtgcgaccgggcggatttcgacctcatcgccctgcggcgcgtgctggacgtgcccttcgacatggccgacgagcggcccggcgcgaacgtttacgtctcctaccgcctcgtcggcgccgagcggccgcgctcccgcgccctggtcgggctcgcgctctacgagtgcggcgccttcggcaactgcctgatccagctgctgctcgccatcggcatcgcccgcaacctgaacctgaaatacatcaagctcccggccgccgaccggagcgaggtgatcggcctgaccggcccgctgacatgcggcggcctcaccttcatccccggctcggagccgctgccggagtcgggcgccttcctgtcggggatgtacttcgacctcgggatccagcagctcgccggcaccctcggccccgacgagacccgggacatcgtgcggacctgcatccggccgctgtttaaccgtctgccggcggagatccccgccaagcccgacgacgagttgctgatccacatccgctcgggggacatcttcagcacctgggtggcgccgacctacccgcagccgccgctcgccttctaccagatggtgatccggcggctcctggcggagggctgcatcgcccggatcaagatggtgttcgagaaccggctcaacccggtgatcccggttctggaagcgtggatctccgagatcggcgtgccgctgacgacccagagcggctccctcatcgacgacgtcgcggcgctgattaacgggcgctacctcgtcttcgggctcggcacgttcgggccgggggtttgccagctctccgagcacgtcgagcaggtcttctatttcgcctcaggctggccgcagcatttcaagagtatcccgaccatcgggcaggtcgtcgaggtgctggacgtcgccggcggctacacgaaggtcggcgagtgggacaactcgcccgagcgccgcgcgctgatgctcgcgtatccggccgagaacctcgccttcgacgacgcctga

SEQ ID NO: 6311 - DNA, 369 bp, Methylobacterium sp.
atgaggtcgatcatcatgcgcctgttcatgctcgccgccgccctgctggcgctgcccgcccccgcctcggcgctgtgccgctgcacctgcatccggggcgagatgaaggcgatctgccaggagaccgacctcacggtcccgatctgccaggggatttgcgagaccagcatccggccggagcgggtcatcgttccgctggccggcggccgtcaggccttcgagccggcacagtcgacgaacccctcgcccggtggcctcgcgacgcaggatcccaaccttgacaccaatccgaatggcaccgtgctcggcaccccgagccagctctccggcagcgtcgggtcgagcctgtcctcaggcagcggtcgctaa

SEQ ID NO: 6312 - DNA, 387 bp, Methylobacterium sp.
atgggcgccgcggcaccgcgtgctgagcccgatatcgatccgctccccgtcgtcattcccggcactctgaagctcacggacgcgcagattggccagaacggcgtgaaccctctggcggttctcgattcctcgatgcgcaaccgcatgagctggaagagtctccgtccggagaatttgacgaagccgccgatctattccggcctgtcccgcatgtcgaacggtgccggcgtcggagaaacctcagccacacagaaagacaacattcccgggttcgataaggatctcgccaccaagaggatcatgtcggagtacaatcgcgaagcggcgatggcggcgctcctgaagggcggacgcggcgccgcgaagagcgtatgctcaggatgctga

SEQ ID NO: 6313 - DNA, 1284 bp, Methylobacterium sp.
atgtcgctcaacgtcctctgcatctcgtggggcaccaccggcaatctcagccccgtgctcacggcggcccggcagctgcgccgggcggggcaccgcccgcgcgtcatggccgacccggcgatgtgcggggaggtcgaggcggcgggcttcccgttcgtcgggtggcgccgcgccccgaccggcctcgacgccgacccggccgatttctcggatctcgcggactggctgcggcagacgatgttctccccggcgggcgcctacgccgccgacacgctcgacgagatccgccgcctcccgaccgatgccgtcctgagcctcgacctcctgcccggctgcgccctggcggccgaggcggccgacctgccgcacgcggtcctgtcgccgcatgtcagcatccgcccgctccccggcattccgcccgccgcgagcggcctgacgccgccgcggaccgaggcggagcgggacgcggtggacgcggcgacggccgcgatcgtgtcggcgatggagcggggccggccggccctcaacgccgcgcggcgcgccttcgggctgccgccggtcgccagcgccttcgcccatttcgatcgcgccgaccgcgtcctgctggccgtcagccgcgccttcgacttcgacacgcaggcgctgcccgccaattaccgctacatcggcccgctgctcgacgagccgggctggtcccgcgggacgggacaggcgtggtccggttcgggacggcggcggatcctcgtcgccggcagcaccggcgcccagaaccagaccgacctgctgcggcgcgtcgcgcacgccgtcggcgcggtcgaggccgagaccatcgtgacgaccggaccgaatgtcgggcccgcggacctggccgcccccgccgccgtgcgggtcgtggcggccgcctcccacgacgccctcatggcgcaggccgacctggtggtgtgccagggcggtcacgggacggtcagccgcgccctgctgcacggcgcgccgctgctggtgatccccctggcccgcgaccaggccgacaacgccgcccgcgtcgccctgcgcggggccggcctgcgtctgcccaccgacgcgggcgaggccgagatcgccgcggcggtgcgccggctcctgacggagccgggcttccgcagggccgcggcgattctcggggcggccgtgcgggcggatctcgacgcgggcggtctcgtccgcgagatcgacgcgatggtggcggcgcgccgggcctccgcggaccgggggggcgcccggggcggagaccggctttgggcctga

SEQ ID NO: 6314 - DNA, 1029 bp, Methylobacterium sp.
atgacccggttccggcccggccgatggcgcgtcgcggtcgcggcgctcctcggcagcgccgcggcgctcgtcgccgcggccgcccacgagaggccggccgcccacgacaggccagccgacaccgcgctctccgccgaggcggcggatgcgctgggggtgatcaccccggtgccggacaccctggaggcggacccggcccgggccgccatcggccgcctgctcttcaccgacacgcggctgtcgcgcgggggcgaccgggcctgcatcacctgccacgacatccgcaccagcggcgcgagcgcggtgccccggaacctgaccgccgatggaacgccggttccgcgcaacacgccgacggccttcaacgcggcgctcagcttccggctgggctgggccggcgacatcccgagcctgcgcgagcaggccgaactcgccctgacacggtccgagttcctgggcggttcctggccccggatcctcgacacggtccgcggcgacccggtgctcgtcccgatgttccaggccgcctacgggcgcgcggccgaccgggagacggtgatcgacgcgatcaacagcttcgagcgcacgctcctcacaccggacagccgcttcgaccgctggctgcgcggcgacgcccacgccatcaccggcgcggagcaggcgggctacgacctgttccgccggatcggctgcgcgtcctgccaccagggcgtcaatgtcggcggcaacctgttcgagaaggtcggcatcttcgtcacgatccccaacaaggtggccgaggtgctgcgggtgcccagcctgcgcaacgtcgccgtcacggcgccctacttcgacgacggcgggatcgccacgctccccgaggcggtgcggctcatggcgcgggcgcagctcggccgggaactcacccccgcgcagatcgacgggatcgtcgccttcctcgggacgctgaccggcacctacgagggccggcccctgaccgcgccgccagcgcccggcgcagcctctcaggacggcaagccgcagctatga

SEQ ID NO: 6315 - DNA, 2463 bp, Methylobacterium sp.
atgagactgaccctgcaggccgtcacgctcggcgcgctgctcgcggcgctgctgacgtggctgctgatcaacggaaacggcgggatggaggccgcctaccaggcgacccagcggaccgtcgacgccctggcgctggccgagtcgcgcatgcagcgcgacgtgctgcgggcccggaccggcctgctgcgcaactacgacccgatcgtcgcgcacctgcgcgcgatgcaggaggccgtggccgacctgcaggcgagcaatgccggggatgccgacgtccaggcgctggccgaggcggtggagcgggaggccgagatggtcgaacggttcaagaccggcaacgccctggtgcagaactcgatcgcctacttcgactcgctcagcgaccggctgtccgagtccgacatcgcccccggcctcgcgcgcgcggtggccgcgctccagatccgcatctcggaactcgtgcgcgactcgacgcccgcgcgcctcgccgacatccgcacccgtctcgagacgttgcacgccgccgacgtggcggccgcccgggtcggcgacgtcgacgccgtcatcctgcacgggcgccagctcctggaactgctgccgcacgtcgacgcggtcacgcgctcgctgccggcctcgtcgagcgaggcggcccgcgaggcgctcctggaatctcggcgcagcctccgcgaccggcgccaggcccgggcggacggattccgcctcgcgctctacgccgtcgccctcgcgctcctcgccctcgtggtccgcgtgggggtgctgatgcgcgccgggacccggatcctgcgccggaccgtggatttccagaccgtcgtggcgcaggcggccaatcgcttcctggcgatccagcccgacgagaccgccacgcgcatcgtggacgtcctcgccatggtgggcgaagggctcgacacggatcacggctacgtcctcatgctcgacggcaccggcgcggtgcatctctggaaccggcccggcctcgcgccgccgagcggctggccggcggcgcagcaggccctcgttcacgacgtcgcggccgccgccagcgacctcatcttcgtcgaggtggcggacgagaccgggccgccggcgctgcgccgctcgctggccgagcgcggcgtcgtctcgtgggccggcgcgcggctgcgccggggcgatcggatcgtcggcctgctctgcttcgagcgcaccacctccggcctgccgccgtggctgcggcactcgcgcggcctgctgcaggtcgtcgccgacagcttcgcggccgccctggagcggcagcacgtctgggccgagcgccgggagatcgaggcggccctgcgccgcgcccagcggctcgaggccaccgggaccttcgccagcggggtcgcccacaacatcaacaacgtcctcaacgtcatgctgggccacgccgagatcgccggtgacgccctgccggcccatccggggcgggcggccgagcatatcgggctgctggtccaggccggcggccgcgcgcgcgagatcgccggccagatcctcgatttcggccgccccgcgcgctccgcgcagtgcaccagcgcggcggacgcggtgatccacgagaccgtggcgcagatccgggcctccacggccgggccagccacgatcgcgctcgcgggcaccgcggagggcgcccgcgtcggcggcgagccggcacagctgcagcaggtcgtccacaacctgatccgcaacgccgtccaggcctccgcgccgggcgcggccgtcgacgtgcgactcgaccacgtcgccctgccgcggatgagcaccctgacccacggaaccctgcgggccggcgcctacgtccggatccgcgtgtccgacaccggccgcggcatggacgaggccacgctcgcgcggatcttcgagccgttcttcaccacccgaccggccgggaccggcctcggtctcgccaccgccttcgagttcgttcaggagcacgacggcgccttcgacgtgcgcagcgcgccgggcagcggcagcaccttcgcggtgtggctgcccgtgatcccgcaggccgcggccggcgcggcggccggcgggactgtgatgctggtcgggcgcacgcgccgctcggtccaggacgacgaggagacgctggcggcgctcggctacgagccggtcggctacgcggaccccgaggcggccctggccgtcctgcggcgggagccgggacggttcgatctgctgatcgtcgacaaccgtctcgccgatctctcgggcctcgccttcgcgcaccgcgccgcgcggatctccgggcggccgatcgtgctctcgctgtcggcgaccgacgcggtgcagccggaactcctcgcggcggttcccgtggccgacatcgtccggcggccttggcgctcgaacgccctggcgctgacgctgcggcgccatctcgcatccgccgacccggcgcgtcgcccggccgccgtctcctga

SEQ ID NO: 6316 - DNA, 549 bp, Methylobacterium sp.
gtgatcctgcctcctctccgccggaccgcggccgacgcgcggacggtggccaccgtcgcccacgacggccaggtcgacaaggccggcaggccgtatatcgagcatgcggcgcgcgtggctgccggcgtgctcgggctgtcggaggggtgcccgttctggtccgacctggagcgggacgaggcgctgcaggccgcgtggctgcacgatgtggtcgaggacacccgctacgggttcggcgacttggccaaggagggcttcagcgacaacgtgctgacctcggtcgccatgctcacgaagcccggaggtcgtgtcacctacgcggcctggatcaacaacatcgcgaaagtgggcaccctccgggcgacactcgtcaagctcgccgacctcgaggacaattcggatcccgggcgtctggcgctcctgcccgcggaaacccgcgagcggcttcatctcaagtacgagccggccaaggcaatcctgcgcgcggcggcggcggcgaagggctggctcggttcaaccacgacggtcgaaggcagcgggccgcgttag

SEQ ID NO: 6317 - DNA, 198 bp, Methylobacterium sp.
atgccccggaagcggcggccccgccgcctcatcaaccgttacgcccagagccggctctacgacgtcgagacccgcacctatgtctccctcgaacgcctgcgggaatggcgcggcgagggtttcgacgtggtggtccgcgaggtcgagaccgggcgcttcgtcagcgacgaggtgctccccaccggcttcgacgcatga

SEQ ID NO: 6318 - DNA, 276 bp, Methylobacterium sp.
atgagcagcacccgcaagacggcgcttcgtggcgccctcctcggcctcgccctcgcaggcccggcgctggccgacgacacgccgacgacggcgggcgcggtcgaccggctcaagggcctcgccaacgaggcggtcggcggcgccaagcgcggcgtcggcaacctgacggacgacgaggcgctgaaggccgaggggcgcgaccagaagctccggggccaggcccagcaggagcgcggcaaggccaaggacgccgtcgagaacgccctcgacaagtag

SEQ ID NO: 6319 - DNA, 372 bp, Methylobacterium sp.
atgagcagcgaccaggccgcccggttggcggcgaccatcgaggtgttgagcggcgcggtcggcttcctgatagccgagcgggtcgcggcgcagccggccccgattcaggacgacctgctctgcgtgctgcagcgcgccctgtcccgggcgccgggcgcgggcggggacccggtcggccgctggatcccggtggtcgccgccgcgatgatcggcgaggtccggcgccagatcggccacccggccggggacgccgccggcccgatgatctcgggaccggacgcgatctgggcgtcagaagtggctgaaggctccggccgcgaacacgcgctcggcgccatcgcgcatttcgaagcgcggcgggccgtcgcctga

SEQ ID NO: 6320 - DNA, 867 bp, Methylobacterium sp.
atgacgatctggtccggcccgggccgccgcctctgcgtggcggcgacgcttctcctacaggcctatcccgcgagcgcgggcgaaaccgccacgccgccggccgcggcccaggccggctctcccgccgcggcccaggctgcccaggctgcccagggcggctcatccttcgtggagctcttcagcaccctgaacgaacgccgctggtacgtctcggacggctgggtcaacggcgactggcagggctgcacgtggtcgaagcaccgcgcccggatcgcgacgcccggcgaactctcgctgtccctgacggacatcacctacaaggagcgccccttcagctgcgccgagatccagacccgcgagcgctacggctacggcacctacgaggttcggatgcgggctgggaccgggtccggcatggtctcggcgttcttcacctataacggccccgacaacggcgaccggcggacgaacgacgagatcgacttcgagtggctcggcaaggacacgagcaaggtccagctcaactacttcgtcggcggcgtcggcgagcacgtcagcctcgacgccctcggcttcgacgccgcgacgaccaccgcggactacgccttcgagtggctgcccgaccgcctgcgctggtacgtcaacggacgcctgctgcgcgaggtcgtcggcacgcccgaccggccgatcccctcgcatccgagcaagatcatgctgagcgtctggtcgggacagggcccggacttcgcgtcgtggctcggaccgacggagtattcgggacagccggtcaccgcgctgttcgagcgggtcgcgttcacccggatgggcgatccgtgcggcttcaaggaatcgatcgtctgccgctag

SEQ ID NO: 6321 - DNA, 1482 bp, Methylobacterium sp.
gtgcgctctgtcatctgcgccctcgctggcatcacgctcgttctcatcgcgccggtcggccgtgccttggccgaaccggccgcggatccgctggcgacggccgcgcgggtcgccgcggagggcctcgccatcggttcaccctccggcgcaggcggcgatccgcagacctcggtcgctcagcccgtgttctcggccggtcgcgcggcggaggtcacgacctcgttccagcccctcctcggggccgccggcgatcccggcgggtaccgcgccttcctggagagccgcgggatcaccttcggcctgatcagtgtggccgagacctaccgcaacctgcgcggcggcctgcggcggggctccacgggcctgacgctgctcgatctcgacgtcgatgtcgatctcgacacgctcgccgggtggaagggggcgacggcccacgccaccgtctaccagatccagggcagcggagcctcccgcagccgcgtcggcaacctcatgacgatcagcgagatcgaggccctgccggcttcgcggctctcggagctgtggctggagcagagcctgttcgacgacaggctgtccgtccgtgtcggccagctctccgccgacaccgagtacatggtgagccagaccagcatcctgttcaccaacggtaccttcggctggccggagatcttcgccgcgaacatggtggacggagggccggcctatccgctctcggcgccgaccgtccgcctgaagtacgtcccgacgcccgatctctcgttccaggcgagcgtgatcgacggcacacccggcggcggccgtccccgctcgggcgtagacccgcagcgccgcaatccgaacggtatccgcttccccgtctccgaccccccgctcgtcatcgccgaggtcgcctacgcctacaacacccgtccgagttccgaaggccggccgggcaccgtcacgctgggcggctggcaccgcttcggccgcgtcgatgccctcacgccggatccggtgagtggcctcgatcggagggtttcgggcaattcgggcctctacgggctcatcgaccagacgatctaccaggagccggacgatcccaacgacggcgccagcgtcttcctgcgtgcgtccgtctcgccgggggaccgcaatctcgtggacctctacatcgacggcggcatcgcctatcgcggcctgatccccggacggtcggacgacacgctgggcctcgccgtcggcatcacccgcatctccccggcggcacgccggctcgatgtgatcgccgcgctccagagcacgacacccgcaccgcgccggagcgccgagatcttgctcgaagcgacctatcaggccgtgctcgcgcccggcatcgccctgcagccgaccgtgcagtacgtcgcccatccgggtggcgggatcgccaatccgcgcgatcctgacggcaagcgggtgcgcggcgccgcggtgttcggcctgcgtgccatcacccgctactga

SEQ ID NO: 6322 - DNA, 861 bp, Methylobacterium sp.
atggaatggagtgacgtcagggtctttctcgctgtcgcgcgatccggcacgctcggcggcgccgcgcgttcccttcagacaagccatccgaccgtcggcaggcgtctgcgcgcgcttgagcaggcgatcggtcacacgctctttcagcggactgcggacggtctggtcctgaccgaagagggccacgggatcatcgcgctggcggagcagatggaggaaggcgcgctggccatggagcgccggctcgcggggcaggagcagaacctcaagggcagtctgcgcatctcatcggcggactggtttggggcgtatgtcctgcctcccatcctggcggatttctcaagggcctaccccaatgtcgacgttgaaatcctgaccggcacgcgcctgttcaacctcgcacagcgggaggcggacgtcgcttttcgtatcgtgccgttcaacactgccgatgtcgtacagcggcggctcttcaggctcgaatacggcgtctacatcgccgaggaggcgccagaccccggatacggcgatgggacgggtttccggctgatcacccatgagacatcgacgggtcacttcccggacatcgcgtggctcatcgagagttttcccaacgcaagaccggtcctgcgatcgaacaaccgcaacgtccaagggcgcatgtgcaagcaaggcgtcggcatcgcggtcttgccccgcgtcgtcggcactcagatccccggtatccgcaggctggaaacgccgacgcaaccgccagcccgagatatctggatgggataccaccgagatctgcggcgtcttcggcgtcttcgtgcgttcatttcgaccgtatcggaccatctcgtgaacgcgaccgtatga

SEQ ID NO: 6323 - DNA, 531 bp, Methylobacterium sp.
atgaccgcacctgttcctcgcgggatcaatcatatcggcatcacggtgcccgacctcgaagcagcaaaatcgttcctggtagaagctttgggcggccaggtgatctatcagtccttcggaccgcaggattcgccgcggcaggggtccgaattcgagcgggccgtcggcgcattccctgggacagttgtgcgtgggcaggcgatggtcaggatcggaaccggacccgatatcgagctcttcgagatgcacggccccgagcaggctcagccggtccgagcgagcgatttcggcatcacccacttcggtctctacaccgacgacatcgacgcctcggtcgagcgcttcgaaaaggccggtggtaccccgctcaccgcaccacgcgccattccctatgcgactgagaaaggtccgggaaacaaggtctgctactgccgcatgccctggggcacgacggtggagttcatcacgacgccggaccgcatggcctatcatgaccaaactgatctgcgcagatggcaggacgaagattga

SEQ ID NO: 6324 - DNA, 1467 bp, Methylobacterium sp.
atgagcgcgaccgagcagtcattcgagccacgtccgagcgaggagcagccagggagcgcggaggcgcgagccgcaacccggccggaacacttcgacgtgctgatcctcggcagtggccagggcggcaagctgctggcctggcatctggggcacgcggggcggcgggtcgccgtggtcgagcgccgctgggtcgggggctcgtgtcccaacatcgcctgcctgcccagcaagaacgagatctggagcgccaaggtcgcccacctcgtgcgcaacgccgcgcggttcgggaccatcaccggtccggtcacgaccgacatggaagcggtccgccaacgcaagcgcgcgatggtcgaaggtgaagtcgcgttccacctcaaggcctatggcgacgccggcgtcgacctagtcatgggcagcgggcgcttcgtcgcgccgaagacgctggaggtgcggctcaacgacggcggcacgcgcgtgctgacgggcgatcaggtgttcctcaacctgggaacgcacgcgaccatccccgccatacccgggctcgcggaggccgctccgctcacccacatcgagaccctggaactcgatgccgtgcctgcgcacctgatcgtgctgggcggcggctatatcgggctggaaatggcgcaggcgctcggccgcttcggcagccgtgtgaccatccttcagaccggccctcaactcctgagcaatgaggatgccgacgtcgccgacgagatgcagcagatcctcgctgccgaggacatcgaggtcattacgggcgccgagacgctgagcgtgacgggccgctccgggcaggctgtcagtctcgtcgtgcgcacaggcgaaggcgagcggacgatcgggggaagccacatcctcgtcgccgccgggcgtacgcctaatacgcaagggatcgggctggaggaggccggcgttgcgttgacggatcgaggcttcatccgcgtgaatgagcgcctggagaccagcgcgcccggagtatgggcgctcggcgaggcggcggggagcccgcagtttacccacgtctccgtcgacgacttccggatcatccgggacaatctcgccggcggtcggcgcagcacccaggaccgcctggtcccggccaacatgttcaccgagccgccgctcgcccgcgtcgggctgaacgagcgcgaggcgcagcgccagggcgtccccgtccgggtggcgcggctgccgatgagcgccgtgctgaggacgcagacgaccggcgagacgcagggtttcatgaaggccctggtcggtgaggatgaccgcatcctgggctttaccatgatcggctccgaggccggcgaggttgtggctgtggtgcagacggcgatgctggctggactgcctcaccagcggctgcgggatgccgtcctggcgcacccgaccatggcggaggggctcggttcgctcttcgcgggcgtgccgccccgctcctcgtag

SEQ ID NO: 6325 - DNA, 1383 bp, Methylobacterium sp.
atggacgaccactacgatgccctcgtgatcggcagcggcgagggcggcaagttcctggcgtggcacctcgccaaggccggccagagggtcgcggtgatcgagcgccgctggatcgggggctcctgccccaacaccaactgcctgccgagcaagaacgagatctggagcgccgagatcgcccaccgcgcccggcaggccgaccggtacggcatcgagaccggaccggtcgcggtggatatgggccgggtggtcgcgcgcaagcgggcgatggtccgcgacctcatcgacatgcacctcgaccgctaccgcgagagcggcgcggaactcgtcatgggaacggcccgcttcacgggccccagagcgctcacggtcgcgctgaacgcgggcggctcgcgcgcgctgacggccgagcagatcttcctgaatctcggcacccgcgcgaccatcccggacgtcccgggcctgcgcgaggccgggccgctcactcatatcgaggcactcgaactcgacgccgtgcccgcccacctcgtcgtcctcggcggcggctacgtgggcctcgaactggcccaggcctaccgccggttcggcagcgcggtgacggtgatcgagcacgggccccggatcgcgggccgcgaggatccggacgtggcgtccgccctcgcgcagctcctcgaggccgaggggttggcgatccgcaccggcacggaggtggtccgcgtgcgcggccgctcgggcgaggccgtggagatcacggtgcgcggcggcgctggtgaggcggtcatcgccgcgagccacatcctcgtcgcggcggggcgcgcgccgaacacagacggcatcggtctcgaccgcgcgggcgtggcgctcaccgagcggggcgtcatcgaggtcgacgaccacctccggacgagcgcgccgggcgtctgggccatcggcgagtgcgcgggcagcccggccttcacccacgcctccgcggacgatttccgcgtgatccgcgacacgctggcgggcatcccgcgctcgaccgcgggccggctgatgccgtcttgcctgttcaccgacccgccgctggcgcgggtcgggtcgaccgagacggaggcgcgggccgacggtcacgccgtccgggtggcgcggctgccgatggcggccgtgctgcgcacgcggacgaccgggcagaccgacggcttcatgaaggccgtcatcggcccggacgaccgcatcctcggattcacgatgctcggcgcggaggccggcgaggtcatggccgcggtccaggtcgccatgctcgccggcctgccctacacggcgttgcgcgacgcgatcctcgcccatccgactaccgcggaggggctgaacagcctgttcgcggccgtccccgcccgctga

SEQ ID NO: 6326 - DNA, 1290 bp, Methylobacterium sp.
gtggagcaggacagcggcgaggatgacgggcagcctgccgctcaggtgcggacgcccatctccagacctctcgacctcctgaacttcctgctgatcgatgtgaacggggcgatcaagccctacctcaacgtctacctctacgtgcatcgcggatgggacgacgcctcggtcgggcttgttggcaccgtgtcgggcatcgtcggcatcgtggcgcagacgcccatcgggacggccatcgacgcggtgcgggacaagcgcgtgatcctgctcggcgccctggtcgcgctctctcttgccacgctcctcgtcgcgctcttcccgcaattctggcccgtgctcgcagcctcctgcgtgctggccgccgttggaggcatgctgagcccggccatcgcgacgctcacgctcggcctattcccggccgacaagctcgcccagcgcttcggccgcaacgccgccctggagcggaccgggaacgtcgccatcgccgtgctgatcggactggtcggctggctgttcccggaccgggcggtctttctcctggtcccggcctgcgccatcgtctcggccgcggcgctctactccatcccgcggggtgccatcgatgcgcgccgggcccgcggcggcggtgaggacgacgcggagcaagccccggccgggtggcggaccctgctgacctgccggccgctcatgatcttcgcggcctgcgtggggcttttccatttcgccaacgcgccgctgctgaccctcgtcgcccaggagatcgggcaggcgcgccctgactggtcgtcggtcatcgtctccgtctgcatcgtcggagcacagacggtgatggtgccgatggggctcatcgtcggccgccgggccgagcgctggggccgcaagcccctcctcgtgatcggcttcgccgcgctgcccgcccgggccctgctctatctggtctggcgcgacccgtactggctgatcgcggtgcagtgcctcgacggcgtgggcgccgggctgctcagtgcggtgaagcccctggtgatagccgacatcacccgcgggaccggccgctacaacgccgcccacggcctgatcgggaccgtgcagggcgcgggcgcttccctgtcattcgtcatcgccggaaccttggtccaccatgtggggttcgatgcggcctatctcgcgtgcgccgccgtggcggcggtcgcgctgggggtgctcgtggtgctgctgccggagaccgcccccgggaagcctcgggtcggcctgccggcgcggctgcgggcgttgcgacccggcaaggcatga

SEQ ID NO: 6327 - DNA, 837 bp, Methylobacterium sp.
gtgcgtagccaagcccgtccggcgcgcctgagcccgcgatcgttcccccgatcgatcctgcgatccggcctcgtcggcgcagtctgtgcgctcggcaccgtcggcgcccgggcggcgccggattgcgccgggatccgggacagggtcgagacgctgatctgtgccgaccccgccctgacgcggctggacgaggagctcaggcgcctgttcgaccggatcgtgggcgagacgcgcggggtcgacggcgagaccggccaggcgatcgacaccttcggcgaggatcacgcgcgctggcgcgcgcgggtccgcgatgcctgcccggacacggcctgcctgacgcgggcctacaccgcgcggatcgcgcaggtccggcgcgactggagccgggcgctgccggacacgccggcgctgcggcacgtggtcaacgcccgtttcggcttctccgtcgacgtgcccgccgacttcgtcgcggagccgccgccggacaacggcgacgggcaggccttccgctcggccgacggccacctgcacctgacggtgtcgggcctgaacgacgtgctcgaccaggatctcgacgccgtcgtggccgcggatcggaagacctgcctgcggcagccgccggaatacgcggcgcgcaagcccggctggatcgtgctctcctgcacgacggcggccgggatcttgtatcggaagaccctgctggcgggcggccgcggcggcgccttcgtcaccctgcgcgtccgctaccccgcggccgagcaggcgcgctggcaggcggccgtcaccgcggccgcgacctcgctgcggctgacggaaccgggccggagcgcccgctga

SEQ ID NO: 6328 - DNA, 1608 bp, Methylobacterium sp.
gtgccggtgatcgaatccgctctagatccgcgcgcgcccgaggcccgcgccaatgccgaggccatgcgcgccctggtggcggacctgcgcgcgaccgccgaccgcgtccgcctcggcggcggggaggccgcgcgggagcgccatcgcgcccgcggcaagctcctgccccgggaccggatccgggcgctgatcgacccgttctcgcccttcctggaaatcggccaactcgccgggcacggcctctacggcggcgaggtcccctcggccgggatcgtcaccggcatcggccgcgtcgcggggcgcgagtgcgtgatcgtcgccaacgacgcgaccgtgaagggcggcacctacttcccgatgacggtgcagaagcacctccgggcgcaggagatcgcgcagcagaaccggctgccctgcctctacctcgtcgacagcggcggcgcgcatctgcccagccaggacgaggtcttcccgggccgggaccatttcggccgcatcttctacaaccaggcgacgatgtcggcgcagggcatcgcccagatcgccgtggtgatgggctcctgcaccgccggcggcgcctacgtgccggcgctgtgcgacgagtcgatcatcgtccgcggccagggcacgatcttcctcggcgggccgccgctggtgaaggccgcgaccggcgagatggtcagcgccgaggaactcgggggcgccgacgtgcacgcccggatctcgggcgtgaccgaccacatggcggagaccgacgcccacgccctcggcatcgcccgccgcatcgtggccaacctgaacgcggtgaagcgccccgcgctcgcgccgcggcagcccgagccgccgcgctacgccgccgaggagatctacgcggcggtgccggccgaccgccggacgccctacgacgtgcgcgaggtgatcgccaggctggtggacggcagcgacttcgacgagttcaagcacctctacggccagaccctggtctgcggcttcgcccatatctggggctacccggtggggatcgtcgccaacaacggcatcctgttctcggagagtgccctgaagggcgcccacttcgtcgagctctgcgcccagcgcggcgtgcccctggtgttcctccagaacatcaccggcttcatggtcggccggcgctacgaggccggcggcatcgccaaggacggggccaagatggtcaccgccgtcgcgaccgcggcggtgccgaaattcaccgtcctgatcggcggcagcttcggggccggcaattacggcatgtgcgggcgggcctacgggccgcgcttcctctggatgtggccgaacgcgaggatcggcgtgatgggcggcgagcaggccgcctcggtcctggccacggtccggcgcgacggtgtcgagggccgcggcggcacgtggtcggcggaggacgaggcggcgttcaaggcgccgatccgggcgcagtacgaggagcagggccacccctactattccagcgcccggctctgggacgacggggtgatcgacccggccgacacgcgccgcgtcctggcgctcggtctctcggcgagcctcaacgcgccgattcccgagacccgcttcggcctgttccggatgtag

SEQ ID NO: 6329 - DNA, 603 bp, Methylobacterium sp.
gtgggtcgcaccgccggatcgaacgggccgcgcacggccgccgccatccgccgggccgggcttcggctcatctatcgccacggctacgaggcgatgaccctgcgcgccctggccgccgaggtcgggatccaggcggcctcgctctacaaccacatccgcagcaagcaggatctgctgttcgacatcgtccgcgaccacatggagacgctgctggcgcggaccgacgcggcgctggcggcggcgaccggcaccccgacggaccgtctccgcgccttcgtggcgcaccacgtcacgtaccatctcgagaagaagcaggaagtcttcatcgcgaatttcgagctgcgctcgctcgacccgccgcattacgcggcgatcgtcgccctgcgccgggcctacgaagaccgattggtcgcgctgctcgagcggggatcggaggcgggggagctggacgtccgggatgcgcgggtcgccggctacgcgatcctcgggatgctcaccagcgcctgcacgtggtaccggcccgacggccggatgaccaaggcggcgatcgtcgccctgcacaccgacatggcgttgcggggttgcgtcaggcgtcagccatag

SEQ ID NO: 6330 - DNA, 114 bp, Methylobacterium sp.
gtgctgatcgaggagtttcggaaggccggcgagctgccggatgccgcggcgggctggcggatggagatccatgacgcgaacggcaccgtcctgcgcacgctgccgctctcctga

SEQ ID NO: 6331 - DNA, 1128 bp, Methylobacterium sp.
atgcttcgcatcggcatcgacgcgcacgtgctcaccggcaagccgcagggcagccggacctggctcgtgaacatcatcgggcgagccgcggcccgacacccggacgccacctacgtggtctattccggcgatccggaggcctgcgcccgcatcgtctcgggcaacaacatcgagcatcagaggctgccccgcgtgcccgcgaccgtgcggctgacgctggtctggccgtggctgttcctgcgcgaccggctggacacgctgctgaccacctacatcgccccaccgtttgtgccgggcgaccggcaggtggtggtggtccacgacatcctgttcgagacgcacccggagttcttcccgtggtcgatgcgctggcggaacaagatcctgacccggctctcggcgcggcgcgccaagctggtcctgaccatctccgactacagccgcgactccatcgccaacgtctacggcatcgcgcgggagcgcatcgccgaggtgcgctgcggctccacgccgccgcaggcggtcacggagcggacgccgctcgccgacgggcgcccctacctgctgatggtcggccggctggagccgcggaagaatctcggcctggtcctcgacgcgttcgcgcggctgccgcagggcgcggcccggctgatcgtggtcggcaagggcgacggcgagcggcccgagaccctcgaccgcctcgcccggacgccggacgcggtgcacatcgccggcatcgacgaccggggcctgtccgacctctacgcccgggccgccgccctggtcttcccgagccgcggcgagggctggggcatcccggtgctcgacagcctcgcccggggaacccccgtcatcgcctcgagcctgacggccatcccggaagccggcggcagcgccgcgagctacttcgacccggacgcccccgaccgggtcgaccgtctcgcggagctgatgggcgcggcgatcgaggggcggctgcccttcgacgcctgcgccgcgcgggcccacgcggcgcgccacgactgggacgggccggccgccaccttcgtcgacctgatgcgccgcagcttcacggcccgcacgcatctgcgcgacctgatcctggccgcgccgaacctgcgcgggtga

SEQ ID NO: 6332 - DNA, 1383 bp, Methylobacterium sp.
atgaagtggccccgcacggtcctcgtcggcgccctgtcggcgctggttctgccgatcctggccgcctgcgggccggccggcgcgcaggtgcagcagaacatcctggtcgatcccgccggcggcaccaaacccggctacaccacggtggcgcggctcgccgacgtgcccttcgccagtctcggtcccggatcgagcgtgctggtccgcggcggcagctacggcgacgtcgtgttcgtcgggtcccgcgggaccgcggcggcgcctgtgacggtggcggcagaacccggcacgcagccgcgcctgtccaactccgtggtgttcgagaacgccacctacgtcacggtgacgggcctgagcgtccagggcgcggtgaattccggcttcatcatccgccggggatcgagccacgtcacggtcgcgggctcgaccgtgtcccgctccggtctggggatctggatcggcgacggcgccggggcgggtcaccgcatcaccggcaacaccctcgccgacaaccagacccacggcgtggccgtcgacgtgatcaacgcgcccgcggaaaatccgagctacatcctcgacaacaccgtgaccggcaacggcatccacgggatggagatcaacggctccggctacgtcgtggagggcaaccgcgtctcgggcaacggcgtggggatgtcgggcacctcgggcatccacgtcttcgccaaggacgccgcccaggacgccggcgaccgcaacatcatccggtacaacatcgtcaccggccagaaggagaccaccggccaggacggcaacggcatccagatcgaccagtggtgcgacggcaacatcgtcgcgttcaacgtcgcggccgacaatgacggcgccgggatcaacctgttcgacgccggctccaacacggtggtcaacaacacgaccaccggcaacatgcgcgattccggcggcaagcacgtctatcgcggcgagatcgtgctggcctccgactacaccaagcaggtcgaccgcacgtcgaacaaccgggtgctcaacaacatcgcctacgcgacccggccgaacgtggccgcgatcgtggtcgaggcgaccaccaccgacaacaacaacgcgatcgggccgaacttcgtcggcagcgccgtcggcgccccgctctaccgctggggcacgcaggccaccggcgacggggcgagcctgccgctcaacggccagggccccgacctcaccggcacgcccgccttccgcgaccccgcgaaccccatggccggcgggctcgccctgacggcacctccggcccgcgccggcatcccgctcggcgccacccgcgacatcgccggccaggcctacgcccccggcgaggccccgaccttcggcgcctacaggagcccgtaa

SEQ ID NO: 6333 - DNA, 942 bp, Methylobacterium sp.
atgagcgatcgacccgtgctctcggtcatcatcccgacctacaaccgcgccgacacgctgcgcctgtgcctgagggccttcgaccggcaggagacggacgcgcccttcgagatcgtcgtctgcgacgacggctcgaccgaccacaccgggacggtcgtcagccgcgccgtcgccacggcccggatccccgtggtgcacctgcgccaggagaatgccggggcgaacgccgcccgcaaccgcgccatcgcggcggcgcggggcgagcgcctcctgatcgtcaacgacgacacgatcccggtcccgagcctcgtcgaggcgcaccgcctcgcccacgcccggcggggcggccgggagaccgcgatcctcggccggatgacgatcgaccccgccctgcccttctcgcccttctcggcgctccaccacgacgcctcctacgacgccctcgcgggccgcgacgaggtcggctgggacgcgttcctgacttgcaacgtcagcgtcgaccggcgcttcctggaggaggcgggcggcttcgacccgaagctgttctggcacgaggacatcgagctcggcgagcggctggcccggcgcggcatgcgcctgttctacgcgcccgaggcgctgggctaccaccaccacctcctggacgaggcggcctacctgcggatcgccgagcgcgagggcgcggcgctggtgctgtggtaccgcaagcgcccggacctcgtggcggatctcggccggctcggcctcgtcgggccgccgccgctgggcgcggcggcgcgccaccgggtcgccgacctcgccatgccgcaggcgctcctgcccggctggcagatggcggcgcgcgcgctgacgcggatcagccccgaggccggccgcagcgtgtggcgccggctgttccagcggcgcaagcgcctcgccatcgcccgggcgctcgcggcatga

SEQ ID NO: 6334 - DNA, 1458 bp, Methylobacterium sp.
ttgtcgggacaaaggcgcgccggcgggctgcgctacggcgcgaacctgctcgggcaggcggcggggcgcggcgtctacctcgcggcgggcttcgcggccttcgtgatggtcggccatttcgccggcccggcggcgctgggccgctacggcctcgccctggcgatcctcgcggtggcgctgatcgcggcggatttcggcaccacgctgaccttcggggcgcggctcggcgcggtgggaccggagatgcgggcggccgagttcggccggatgctgtcggcgcgcctcgtcctcggcctcgggacgggtgccgcactcctcggcgtcctgccgatgctgccggacgcgatccggcccgcgctggcgctcgccgccctgctgatgccgctcgcggccgcccgcttcctcgacgccctgttccaggtctgcgggcggccggcctggtccgtctggccctcgctcgcgaacgccgccctgctgatcggcgggacggcactcgcgctctggctgcggcttccggagtccgcgctcagcctcgtggcggtggccgccggcatcgcgtacggcgcggtcgggctggcgctggcgctgcgcctcgtgcccgcccgtcccgcctcgctggcgcacgcgctcgcgacgatccgggccgcggcgggggtgggcgtctcgaacgccctcggctcgctcaacggccggatcagcctgatcatgctggccgccttcgcgggcgcggccgagctcggccagttcacggccggcttccggttcttcgagctgggcgccgcggtggcgatcaccctgtgcgccccgctggtaccggtcttcgggcgcgccgtcgggcccctggtcgacggacggtcgcgcgccggcacgaccgccctgcgcgcgcgggtccgcggcgcgctggtcccgatcctcgccgcgtcctgcgccggagcggtggcgacctgcgccctcgcggagcccctggtgcgcctcgccttcggcccggatttcggcggcgccgtcccggtgctgcgcatcgccaccgggatgagcgtcctgctgatcgccgccacgatcctgttcgcgggcctcgtcccgctgggccggaccggcttcgcggtgcgcgggagcgcggcggcctgcgccacgaacctcttcgcctgcacgctgctgatcccctgggatccgctcctcggcgcgggcctcgccgcgctgctcgccgaggccgcgatgctcggcgtcctggcccaggccttctggcgggaggccggaccgcccctcgccctggccgacgtgccgatcctcgccgcgccggccctcctcaccgccctcgcctgggccgccggtcccgccgccctggcgcccgcggcggtgcccgccgcagcggtcctctcggccgccctcgcggggtggctgtgcctgcgccgcgccccgaccgatcccctcgacctcccgctcccggaagcctcctcatga

SEQ ID NO: 6335 - DNA, 522 bp, Methylobacterium sp.
gtgcgggctgccctgtccgccgaccgcgatcactggcgccgccgcggcggtggaccggcacgcctccgccggggctaccacgcggtctggctctaccgcctgtcccgctacgcccacgagcgcggctggcggatggcggcgtggctgctgtggctggtgaacggctggtggacgggcgccgacatcccgccctccagccgcatcgccggcggcctgttcctgccgcagccctacgggacggtcatcgccggcgccgtgggccgcgacgccgccttcgggatccaggcctccatcggcggcctgctgaaggagcccgaccaggacatcggcggcggccccggcctgccggtgctgggcgacgacgtcgtcctggaggccggcgccatcgtgctcggtgcggtgccgatcggtgaccgggcccggatcggcccgcggacgatcatcctcaagcccgtccaggccgacgaggaggtcatgccgcagccctggcggccgcttcccggccggggggtcgcggcgtga

SEQ ID NO: 6336 - DNA, 591 bp, Methylobacterium sp.
atgaccgaccacgtcaccctgccgggcctgcggcgcctcctggcggccgacttcgcccgcgtcctgcgccagacgacgggcggcaagccgacctcgcggctgcggcgcgcgatgcacctcacgctgccggccatgcaggtggcgatcctccaccggaccgcgcacctgctgcacggccggggctggcgccgctgcgccgccctggtggcggacctgtccctgcggctgaccggcgcctgcctgcatccgggctcgcgcctcgggcccggcctgttcgtgccgcacccggcgcgggtcgcgttctgcggcaccgggggcgccgacctgacgctcctgcccggcaccctggtcgggccgcgggactgggtcttcccgagccagccgttccccgccgacggccccagcatcggcgacggcgccgtggtcggtgcgcacgccgccgtgcagggggccgtgaccatcggcgcgggcgcgacgatcgggatcggggtctgcagcctccgggacgtcccggccggcaccgtgacgatgctggtccagcggcagctccgcagcggcgggcgcggcccggaggcgggccgtgggcgctag

SEQ ID NO: 6337 - DNA, 738 bp, Methylobacterium sp.
atggtcacggtcgaacagcgtctgttccgggagatgggagccgggggctattcccggcacgaccaccggatggagtacatcgtgcgcgtcaacgcgctgctccgctccgacatgcgggtcatggagttcggcgcggggcgcggcaagtggagcgatgacccggtcccactgcggcggcacctcggcgacttccgggggcgatgcgcccaggtcgtcgcctgcgacgtcgacgaggcggtcctcggcaaccggtcggccgacgaggtccggctgatcggtcacgacggggtgctgccatttccggacgggagcttcgacctgatctcggccttctcggtcctcgagcatatcgagcaccccgaggtcaccgcggcggaactcggccgggtgctcgccccgggcggctggctgtgcgcctggacgccgaaccgctggggctatgtcgggatcggggcgcggctcgtgccgaagcggctgcacgcccgggtgctgcgcctcgtcgagccgcggcgggtggagatcgactcgttcgtgccgctctacacgatgaacacggaggcggcgcggaagcggcttttcccaactgaccggttcgagcacttcacctacagtttcgacgggcagccgttctatcatggcgagaacatcgtcctgggcaagttctgggagctgctgttccggctcacgccgggtcccttcaagggctaccacatggtgttcatccgcaagcggccgtga

SEQ ID NO: 6338 - DNA, 1605 bp, Methylobacterium sp.
atgagcgcggcgcccgtccgcgcgctgcgggtcctgccgctcgccgggatcggcttcgcggccgcggccggggcgatcgccctgagcgcggcgccgctcaaattcgccgtcgtcggcctcgcggcggccttcggcggggtcggcgccctgatcgtcgggcggctctatcgcctcacgccgctcctgctcgtcgccctcgcggtcgggctgacggtcaagctcgacgtcagcttcctccagcatttcgaggccgtcgggcagtacctgccgagcatcggcggcggcgccggcctgacggtgagcgtcgccctgctggtggccgtggcgctgatcgtcgcaaagctcaccggcctcggggaggtcgcccccggcctgcggctcgaccggcccctcgtgctgacgcagctcggcttcctgatcgcggggctgctctcgctctccaacgccaccgacccggcctatctctggttcgacacgtggcgcttcgccggcctcctcctggtctcggtcgcggtctcgaacctgtccgagggcgacatccggaccctcgcgctggcgatctgcgccctctgcctcgtccagacggcggtggcgggcctgcaatacgtctcgggctcggaactcggcctgtcggtgctgggcgaggaacagatcgtcgaggagaacatcaacttctcggcccagcgccgcgccggcggactgaaggtccacccgaacatcctcggctactactacgagttcgtctggccgctcgccctggcgctggccctgtcgcgcggcccgctcctcctgcgcctcgcgggggcggcgggcgccgcctcggccctggtcggcgtggtcctgaccctgtcgcgcgcgtcctggctgaccttcccgatctcggccgccctcctgatcctgctggtctaccgcgaccgcctgttctcccggacgagcctgatcgtcttcgcactgctggcgatcgtcggcgccgtcgccgcgctctacgccggcccgctgatctgggagcggctcaccgccgacgacggcggctcggccgcccagcgcggcccgctgaacgccgcggccctcgccctgttcgagcagttcccgatcttcggcgtcggcctgaacaacttcggcaaccagttcgcggtcctcgacaggaccggcttgtcccggctcgccggattgttcgaccggtcgaaccacgtggtgcacaacctgcacatcctgatcctcaccgaggtcgggatcgtcggctacgcggccttcgcgctggtcttcggcatcggcatcgcccggggcttccgcgccgcccgccgcgcgccggtgggcgatccgctcgcggcgatcgcggccgcctgcgcggtcggcctgatcgcgcacctgctgcacgggctggtcgatccgggcttccgcctgaatctcggcatcgccgagctgctctacaccggcctcgggctgatcgccggggtgcgggcggcgcagcggcgcagggccgtcgcggcgtcccgggcggtcgcgtcgacgggcccgatcggcgcggcgcgcgcccgagcggagcggatccccatggcgtacgggcgtcgcccatccctcgcagcgtacggagaccgtccgtga

SEQ ID NO: 6339 - DNA, 642 bp, Methylobacterium sp.
atgatcgccgccgccatcgcgccgaagatcgatccggcgatcctggagccggccctcgtccagctcacccggcacgaggcgcgcgtgcgccgggtcggcctcaccgcggtccagcccggcgagggcgtgagcaccctcgcgcgcgaactcgccggcgcctacgcccggcggggccgcagcgccgtgctgatcgaggcgaactggtcccgcccgtcgctggctgaggcctacggcctgaccggccggccgggcttcgccgacatcgtcgccggcacggtcgccccgagccgcggcgtccacccggtcgccgacaacctcagcgtcgtgcccgcgggcagcccgtcggccatccgccaggcgaccctggacgacggccgggtggaggatttcctggcgctcgtcgacgaccgcttcgagctcgcgatcgtggattgcgagcccatcaccgagatcggcgacgccgccgcgctctcgcccttcgtggacggcttcatcgtggtgatcggcgccgagcggacccgtcgggccgtggcgcagcgcgccctcgccgatctcaaggccgccggcggggcgccgctcggcgtcgtcctgaaccgcacgcggcggccgatcccgcgatggctctaccggtggctcggatga

SEQ ID NO: 6340 - DNA, 1533 bp, Methylobacterium sp.
gtgaggcagagcgacctgaccgccgccgacgcggtcgagggcccggccttcgacctccgcgacgccctcgcggccctgttccggcacatccggccggcgctgctgatcctggtcgcggcgatcctcggcgccgggatctacctcctgctgacgccggccgagtacacggccgacgccaagctgatcatccgtctcggccgcgagaaggcgggcgccccgctccagggcggcgcgaaccagaactacatgttctcggagcgcgcgcagaacgtgaacaacgagatcgagatcctgcgcgatcccagcatcgtgcgcgacgagttcgcgacgctgaaggcgatcaccccgaccggcgacctcggaccgcccccggcggactggatggactggctgatctaccagggccgtcaggccgtgcgcggcgccaaggcggtcaagacctggatcgtcgacacggtgcggatcccgttcgaggcggtgggcctgctgcgccacctgaccccggacgagaagctctacgaggcctatctcgcggcgttcaaggtcgtcttcgtgaaggagacggacgtgatcctcacgggcttcacctggacggacccgcacttcgccgcccaggcgctgaaccggctgctcgacgcctacaagcgtcgccacgtggaggtctacgccgacgagactcccgcctcgttctaccagagcaagctggagcgcgcccgggccgacctcgccgccatcgacgcgcagctctcgacctacctcaagggcaacaacaccgcgagcttcgagatcgagcagcagaacgacctcggcaccctggccgacctcgccaagcagaaatcggcggcgcagatcgagcgcgaggtggtcgagacccggctcaagcgcacccgcgaggccggaccggaccgctggcagccgacgccgcccgacgcagacccgacggtcacggccttcgaccagcgctgggcggacctgcggacgaagcgcgccgagctggcggtgcggttccggccgaccgcccccgagttcgtgagcctcgatcgggacctcgctgccctggcccggcagaagtatcaggcgctcctcgccgccgacacggcgaagctcgccatcctcgccgagaagatccagagcatcacggggatcgagcagagccgccgccgggccgccatcggccagagcgacgccgccctggcctacggccggctgacccagcagaagggcctgctcaccgacgagatcaccgagacccagaagcggatcgacgctttgaagaccggcagcggtctcgacgcgcaggccgtcacctcctcggccctcgtggcgcgcgccgtgccgccgcggctgccctccggcccgaaccggccgctgatcctcgggctcgcggccggtctcggcctgctcgccgccctggcctacgtcgccctcgcggagatcctggcccagacctaccgcagcgcctcggaggtcgcccgctcgctgcgggtgccggtgctggccgcggtgccgctgcagacgggagccgccgcatga

SEQ ID NO: 6341 - DNA, 1155 bp, Methylobacterium sp.
atggcgtttaccctgtctgcgttcctcggcgtctcgcgccggcgtcccggccgaccatccggtgccgcggcggtcgcgctcgcactcctcgcctgcgcgccgctgctcgccggctgcaattccggccgcccgcagagcgcggcgcgctccggcctcgacgtggctcagaccggctcggtcaccgagggcctcccggccgcgctggtcgcggccgcccaggaggaggtcgggcggaccatgcgcctcggcctggcgaactaccggctcaacgtcggcgacaacctggaagtctcgttcctgatcgattccagcgtggtccagccgacctaccgcctgaacccgaacgacgagttcgacgtcgatttccgcacgcacccggaatacaaccgcacggtgatcgtccggccggacggacggatctcgctgccgggcaagaacggcatcaaggtcgcgggcctgtcgccggaggcggccgccgcgctgatcaagagcacctacgacgacgtgctgatcgacccggtcgtcaccctgatgctgcgccggttccgcaccgtcaccgacgatttccgcgacctcacccagcgggccgacatgggccgcgtgaaggtcctggcgatcgagcccgacggcaagatcaacctgccgatggtgcccccggtccaggcggcgggccggaccgtccacgaggtcatgggcagcctgaacgccgcctacaagcaccagctggcctcggtgacgaccagcgtccggctcgcgagcctcgtcccggccaacaccatggtgttcggcgaggtccgcgccccgggtcccgtcaccctgcaggggccgcggacgctggcgcaggtcctgggctcggccggcggcgtcctgccgaccgcggccggcgaggccgtgcggatcatccgcttcgacgccgaggcggccggcagcgtgcgcatcgtcgacatcggccagccgggcttggcggactcgatcgtggtgccgcccaacgccaccgtctacgtgccgccctcgctgctggccaagaccgcccgcgcggtggatctcgtggtgcgccagatcctgctcttcaacgggaccggcttcggcgtgaactacatcaccggcccgtccgccagcacctccaccagcgctaccgtgaggtccggcacgtga

SEQ ID NO: 6342 - DNA, 117 bp, Methylobacterium sp.
atggagacgacgatgacctggacgaaccgcatcaccatagccgcgaccctcatcggcggcgcgatcgcgctggtgacttacgcgcaggccctgagtctgccgacgcacttcgcctga

SEQ ID NO: 6343 - DNA, 405 bp, Methylobacterium sp.
atggcagacgccgtcgcgtcgcaacgcgctgtgctgattgtcgaggacgatcccgtgcagctcatggatgcggctgcagcccttcgcgacgtgggatacgcggtcgcggaagccgccactgtcgaagccgcccaggctcatctggcggcccgtcccgaacttgtggccatggtcgcggacgtggacttggcaggcgagcccttgagtggcttcaccctggccaaagccgtcgcggcgcgctggcccgaactggcgatcctgatcgtgtcgggtgtggcttggccggccgaggagcagatgccgatgggcgctcgctacctgcgcaaaccgttcacaccggaggggctggccggggcgctgggggctgtgctggcggcgcggggtgtagggtccgtgccacattga

SEQ ID NO: 6344 - DNA, 225 bp, Methylobacterium sp.
atgaccgcggaggaacggctggctgagctgaaggcggcggacacgcgccgtcagacacgtcgcagggaggctctgaagcagaagggcatgacccagcagaacgtgtggctgaagccgtcggtcaaagccgtcatcgaccaggcgatccagaacggtcggttcaagagccgtaccgaggcgatcgagtgggcgctcgcgtctgccttcgaggagaagtcggcatga

SEQ ID NO: 6345 - DNA, 1167 bp, Methylobacterium sp.
atgcacgaattcacggagctgcgcggccgcgaggcggccttcccggaggcggagttctccgcccggcaggcggcggcccgggccgccatcgcgggtgccggccacgacgccctcgtggtgaccggcccggagacgatctactggctgaccggccgccagacggcgggctatttcgccttccaggcgctcctcgtgcccgtggacggcgacccggccctcctggtccggcagctggaattgccgggcgcggccgccaacacgtggctcgacgacatccaggcctatccggacggcgccgacccggccgcggccctggcggccctcgtgcgcgggcgcggggtcgcccggccggccctggagcgggacggctggttcgtcgcgccggcgctcgcggcgcggatcgacgccgccctcggaagcggcccgctgcccgacggatcgggcctgctcgcgcccctgcgggcggtgaagtcggcggccgaattggcggcgatccgggccgccgcccggtacgcgcaggccgggctcgccgcggggctcgacgcctgcgcggcgggcaccgacgagaacgccgtcgccgccgccatgctggcggccgcgacggccgccgggtccgaggccgtggcgatggagccgctggtcgcgtcgggcccgcgcagcgggctgccgcacatgacgtggcggcggcgccggctcgagccgggcgacgcggtcttcctcgagctcgccggaagccacgcccgctaccacgcggcgctgatgcgcagcgtctggatcggtccgccgccggccgaggcgcagcggatgatggactgcgccctgcgcgccctcgacgcggcgctcggcgcgatccgccccggccatccctgcgccgccccgcacgcggcggcgcaggccgtgatcgacgcggcgggctacggcccggccttccgcaagcggatcggctactcgatgggcgtcgccttcgcgccggactggggggagggtgccctgctctcgctcttcaccggacaggaccggccgatcgagcccggcatggtcttccacctgccggccaccctgcgccgctacggtgcctggacggtcggcgcctcggagaccgtcatcgtcaccgcagacggggtcgagcccctgtccgacctgccgcgcaccctgtcggtgcggtaa

SEQ ID NO: 6346 - DNA, 342 bp, Methylobacterium sp.
atgggcgtcgatatcgcgcgcgtgaaggcgctcatcgcgacgttggaggcggtgacctccgccccccattttcacaggacggccttccggacgccgcgcaagaccttcgcgacgctggacgaggtgggccacgacatcaacctgatgttcgacccggacctgcgcgacttcttctgcgagcaggtgccggcggctttcagccccgttccgggcggctgggggcggatgggcgcgacgcggtgcgacctcgcgatcgtcgacgaggcgaccctgatgtcggccctgacggcggcccaccggctcgccgcgccgaagccgcgcgcgcggcgcggcggcgcctga

SEQ ID NO: 6347 - DNA, 471 bp, Methylobacterium sp.
gtggacaggatgatgctgtcgcgtaggggcgtgtccggactggccgcgctggtggctgggctcgtggcgagcagggcctcagcggacccggcggctggccccaaaacgcatcgggtcgcgatgcaggtcagttccaacgagggtggcgtgttcgacctcgccctcaacaatgccgtgaatctcgctcgcgagtacagcgatcaggccgaagagcttgaggtcgagatcgttgcctacgggccgggtctgcacatgctgcgggccgacacatcacccgtgaggttgaggatccactccatcacggagagcgtgcccggaatcgtactttcggcctgcggcaatacagtcaaagccatggagaaggctgaggggcatacggtggaattgctgcctcatgtcggcgtggtgacggcaggagcggtccgtctcgtcgcgctgcaggaggcgggatggagctatctccgagtatga

SEQ ID NO: 6348 - DNA, 1680 bp, Methylobacterium sp.
atgacctcacgccgcgacttcctgcagatcgctgccgccaccgcggcgttggtgccatcgggctggacccgcgccttcgcccagcagcgcctgacccaggacgacctcctggccttcgagccgatgggcaacgtcaccctggtccacctgaccgacatccacgcgcagttgcggcccgtgctgttccgcgagccctcgaccaatctcggggtgggcgccgcgcgcggtcaggtcccccatgtcaccggacgcgcctatctggacctctacggcatccccggcgcctctcagctggcctatgcgctcacgccggaggactacgtcgcgctggcccgcagctatggccggatgggcggcctcgaccggatcgccacggtactcgacgcgatccgcgccgagcgcggcgacaaggtgctgttcctggacggcggcgatacctggcagaacagctacacctcgatggtgagcaggggccaggacatggtcgactgcatggcgctgctgaagcccgacgccatgaccgggcactgggagttcaccctcggtaccgagcgggtcaaggagatcgtggacgggctcggctgcccgttcctgggccagaacgtccgcgacgccgaatggaacgagccggccttcgaggccacgaagatgttcgagcgcggcggcgcgaaggtcgcggtgatcgggcaggccttcccctacacgcccatcgccaaccctcgctggatgatccccggctggtccttcggcatccgcgaggaggacgtgcaggcgagcgtcgacaaggcccggaaggacggcgccgacctcgtcgtgctgctctcccacaacggcttcgacgtggaccgcaagctcgcctcgcgggtgaagggaatcgacgtcgtcctcaccggccacacgcacgacgcgctgcctcaggcggtgaaggtcggcaacaccctgctcatcgcatcgggcagccacggcaagttcctcacccgcgtcgacctcgacgtgcgggacggcgccgtgaagggctaccgctcgaagctcatcccgatcttctccgacgtgatcgcccctcagaaggcgatggcggacaagatcctggcgatccgcgcgccccacgaggcgatgctgaaggaggagctcggccggaccgaggccctgctctaccggcggggcaacttcaacggcacgctcgacgacatgatctgcgatgcgctcctgtccgagcgcgaggccgagatcgccctctcgcccggcttccgctggggcacgacgctcctgcccggccagccgatcacccgcgaggacgtctacaacgccaccgccatcacctacccggcggcttatcggatgcccatgaccggcgcccggctgaaggaggtgctggaggacgtggccgacaacctcttcaacgccgatccctactaccagcagggtggcgacatggtgcgggtgggcggcgtgtcctacgccatcgacgtcgctcgcccggccggcagccgcatctccgacctcaccctcctgcgcaccggcaaacccatcgaggcgggcaccagctacaccgtggcgggatgggcgagcgtcaacgagggcaccgaggggccgccgatctgggacgtcgtcgcctcgcacatcaaggccaagggcacggtgaacccgacgcccgcgcaggtcaccgtccgcggcgcctag

SEQ ID NO: 6349 - DNA, 576 bp, Methylobacterium sp.
atgtcgacccggcgccggttcctggcgggtgccctcgcgctcggcctgcccgccaaggccatggcccaggcgatccagggtgatgacggcctctaccgggagccctggttcctcgaaagcttcctcgaccttccggacgatctgaaggcggcgcgcgagcacggcaaacgtctggccgtcctctgggaactcaagggctgccccttctgcaagcagatccacctcgtgaacttcgcggatccggcgacgagcgccttcatccgggagcgcttcgagatcctgcaactgaacttcatcggttcgcgggaagtgaccgatttcgacggtcagatcctctccgagaaggctttcgcggagaagtacggcgttcgctccacgcccagcattcagttctttccgtcggaggatgaggcgctcgggggcaagccgcctctgcagcgcgaggttctgcggctgcgggggtatgcgccacctgaggagttccggcgaaccttcgccttcgtcgccgaacgggcctacgagcggacgaacctgcaggactacctgcgctccccgaaggcagcgcagcggggctga

SEQ ID NO: 6350 - DNA, 342 bp, Methylobacterium sp.
atggcgggggcgtgggggctcgccctgtggcccggctccgtcgaggccgccgaactgatcaagttcgagcggcgcggctgcccgtggtgcaaggcctgggacaaggagatcgggtcgatctacccgaagacggatgtcgggaagcgggcccctttgcgccgtgtcgatctcgacgcaggcatcccgcccggactcacgctcaagcgcccgatccgctacacaccgacattcgtcctcgtcgaagacgggtccgagctcgaccggatcgagggctatccgggtgaggacttcttctgggggcgggccgagcggttgctcgaacggctgcccgcttccccgtga

SEQ ID NO: 6351 - DNA, 1044 bp, Methylobacterium sp.
atgtccgacatcctgcctgcatatctcctccgggcggcgctcgggctcgttcttggagcgctgctcggcacggtcgcacggcggggtcgcttctgcacgctcggcgccattgaggatgcggtctacgcgcacgacacccgtcgcgcgcgggcgtggctgctggcaaccggtatcgccatcctcggcacccagcttctggaaaccggtggtggtctcgatctcgcccggtcgatctacacggggccgcgcctggaatggggcgcgatgatcctcggcggggcgatgttcggttttgggatggcactcgtagggacatgtagcttcggagcgctcatccggcttggcgggggagatctacgcgcgctcctcgtcctgctcgtgctcggcctctcagcctacatggcgatcagcggcgtcacggcgctcctgcgcgtgacgatgaccgagccgctgagcatcgacatcggaagccagcgcctcggggagctcctgcgcctggatcagacaggccgaattgtcgtgggcgtcgtcgcggccgccgggctttgtatcgcggcgctcgcgagccgcgccttccgggagacgaagcggcttctgttcggcgccatcgtcgtcggatgcgtggtcgtcgccggatggtggaccaacggaatcgcgggcttcgacgagttcgagacccgggcggtcggctccttcagcttcgctcggccggtcggtgatacgttgctctacgtcatgctcgcgagcggcacgaagatcgacttcggcgtggcctcggtcttcggtgtcctccttggatccttcgcgtcggcgcgccacgcgggcgaattccattgggaggcgcccgatgatgcccgggaggtgaagcgccaccttttcggggcgttcctgatgggcacgggcggcgtcacggcgctgggctgcacaatcggtcagggattgagcggtctctcgacgctgtcggtcggatcgatgctcgccctcggcgcgatcctcgtcggggctcgcgcgggtctctactacctcgtggaccggcacgcgtga

SEQ ID NO: 6352 - DNA, 222 bp, Methylobacterium sp.
atgtccgaagacatcatgcgggtgctgacagagccgaccgtggacgtggagctagcgggccgcgtcctcggcatcagccgaaagaccgcctatcgcgcccgtgagactggagagatcccgtcgatcaaaatcgggcggcagtaccgcgtcccgaccgcaaagctgcgcgaaatgctcggcttgcctccgtactcgatggagacgcagaccctcgccgcatga

SEQ ID NO: 6353 - DNA, 333 bp, Methylobacterium sp.
gtgaccggcctgtcgctccacgccgtcgacgccgccacgggccggccggccgaggggatgcgcgtgcgcgtcctgcgcgccgggggaaagcggcgggtgatcgccgagggccgcctcggggcggacgggaccctcgaccatccggtcgtgcggacgcggctcgccgccggcctctacgaggtcgtcttcgtcatcggggacttcgtcggagccgcgggcgaggggttcctggaggaggccgcgatccgcttccggctcgacgaccccgaccgccactgccacctgccgctgaagttcaccgccttcggggtggcgctgttccgcggctgctga

SEQ ID NO: 6354 - DNA, 1251 bp, Methylobacterium sp.
atgagcaacggtctgacgccgacggccgaccggatcgtcgtggccagcgaggccgactggaacgacgcctggtacctcgtctgcatgaaggtctcgacgatcggcttcgtcgtcgtcgatgcccgcgagcgggtcgccaccctcgacgcgctgcgggcggccggaatcaccgacatcgccgcccacctcgacgcgcatccggacgtggccgaccgcctgcggcacgggatggtcatcctcgacgtcaacgaggcggcggtgcggatgttcggcgcgggcggccgcgcggacatgatcgggcagcgcacgcagcgcttcttcgacccgctctgcaccgcccaggtcaattccgcccgggccttcgcggcgggcgcaacctcgttccagcagcaggcgcacagcgtccggctcgacggatcgcgcttcgagacgctgttctgcgtggtcccgcgggcggacggcgccacctccggcctgtggctcgcctccttcgtggacatcaccgagcacgtcgcgcggcagatgtcgctggaggtgctgcgcgacgaactcgcccacgtctcccggatctcgacgctgggcgagctgtcggcgtcgatcgcgcacgagctcgggcagcccctgtcgtcgatcggcatgaccgccggggcgatgctgcgcctgctcgatcgcgcggatctcgaccgcgacctgctccggcggcaatgccagcgcattgtcgatcaggtcacgcgggccggggacatcatcgatcgcacccgccgcatggccgccaagcgggacagcgtccgcgcgcccgtctccgtggcggaggtcctggccgaggccgcgcggttcgtggcgcacgacctgaaccgcacagagatcaggctcaccgtcgccccggcggacgcggccgcgcaggtcgtcgcggaccggatccagctgcagcaggtcttcgtcaacctgctgatgaacgccatccagatccatcggcaggcgcggacccccgggcccgagatcgcggtggagaccgtctgccgggacgggtcgatcacggtcgacgtcatcgataacgggcccggcctcgatcccggcaccctcgaccggctgttcgacggcttcttcacgacgcgggccgaggggctcggcctcggtctccggatctgccggaccatcgtggcggcccatggcggctcgatcgacgcgagcccccgcgacggggcgccgggcgcccgcttctcggtttgcctgccgctcgcccggtcctga

SEQ ID NO: 6355 - DNA, 183 bp, Methylobacterium sp.
atgccgaagcgccgcgacccgggccgatcgcccccgcctccgccggacgcggtgccggagaccgtgccggaccgcgacgcggtggagcgcgccctggaaacaatcctcgaccgcctgcgcccgaagccgggcggcgcgccgcggggcagccggaagccgcgcccggacggggcgggcggctga

SEQ ID NO: 6356 - DNA, 174 bp, Methylobacterium sp.
atgaccatcgcctccgtgatcggcagctgcgtcacgctcctgctcgtccgggggctcgacccgctcgtcgccctgctgctgatcccgatcggcggcagcgtggcgacggttctggtgattctgctgttccaggccgtgagcctgacgctcgcggtgcggaccggtccgcactga

SEQ ID NO: 6357 - DNA, 165 bp, Methylobacterium sp.
gtggtctacgtgctcatcatcatgctggccggctcgggctcggcgatcggatccgtcgagttcaacaccaagcaggcctgcgaggccgccgcgaagcagatcgcggaggccgaacggccctacggcggcgcctcgccggtgaccgtgtgcgcgccgaaggggtga

SEQ ID NO: 6358 - DNA, 654 bp, Methylobacterium sp.
atgcccgaccggccaagtctcggaatctccaggcgaaagcagccccggcaggcgcgctccagcgacctcgtcgcggccgttctggaggccgccgctcaggttctggcggaggtcggcgcggcgcgcttcacgacggcgcgggtcgccgagcgcgccggcgtcagcatcggctcgctctaccagtacttccccaacaaggcggcgatcctgttccagctccagagcgacgagtggcgggatacgtccgccctcctcgccggcatcctgacggatcccgcttgcgcgcccggcgagcgcctgcgcgccgccgtccacgccttcgtgcgctcggaatgcgcggaggccgcgatgcgccgggccctcgacgcggccgccccggcctatcgcgatgtgcccgaggccgcggagccgcagctggccggctcgcaggccttccgcgacttcctgcgcgcggcgcttcccgcggcgcccgagacggacctgcgggtcgcgggcgagatcatcgcgatgacgctcggcgaggtcggcgagcgcatctcggagacggtccggaccgaggcggccatggtgaccttcgcggacgccctggccgacatgctctgcgcctatctggaccgcctgggcagcggaggccgggccggcgcgccgtcctga

SEQ ID NO: 6359 - DNA, 399 bp, Methylobacterium sp.
atgtcgaagcgcgatgcagtctttccgcccggacggcaagccctctacgacaagcaccgctactcggccgcgatccggtccggcgacctgcttttcgtctccggccaagtcggcagccgcgaggatggctcgcctgaaccggatttcggtgcgcaggttcgccgtgccttcgacaggctgaactccgttctcgcggcggccggctgcagtttcgacgacgtggtggacgtgacaaccttccacaccgaccctgaaacgcagttcgacacagtgatggcggtacgcgacgtaatgatcggcgaaccgccctatccgaactggactgccgtcggcgtgacctggctcgcgggcttcgacttcgagatcaaggtcatcgcccgtcttccgaccccggtctga

SEQ ID NO: 6360 - DNA, 1785 bp, Methylobacterium sp.
atgcggctgctcgtcgcctgtgaccacctggcgctgacgggcggcctgctccggttcgagcgggtcggacgggtgctcgcgcgtcgcggtcacgcgttcgcgtacctgaccctgggcaccggcgaggacgggttcgagacgcggctgcccgtcctgcaccgcgaggacgccgcgcgcgagagctgggacgccgtcatggtgcccggcggcggattcccggatgccacgatcgagggattcgcggacctccgggccccgaatttcggcgcccggatccagcacctcctcaacgcgccggtgcggcgcgacgcctacgcgcgcgtcacgcggactctcgcgcccgacctcgtcgtggcgaacaacgagcactgggacgacgccgccctccacggcctcggcctcccgtggcggcgcctcgtcggtgcggtcgataccgggctgttcgcgccgcccgtctcgccgcccgcgcgcggcgcgcggcgccggctcggcggcatcgccaacaagcgccccgccgcgcagctcgcggcgctcgacaggctcggtgacgcgtgggccctgcactggttcggacggccggactgggggctggtgggcgcgcacgccgatctggtggcttcgggccgcctcgtcgtgcacgggccgctgcccgaggcggacctgccggcgtggtatcacgggctcgacgcgttctgcagcgcggaggcgcatgccggctggtgcaacccggccgcggaagcgatggcctgcggcacgccgctcgtcgcgaccgtgcacggcacgctggctttcgccgaggacggcgtcactgccctggtggtgccggacggtccggacgcggtgctgggcgcggccatcgcggaggccgtgggcaggatcgcgaccgatccggccggcgccgcgtcccgggccgaggcgggccgggcgcggatccgggcgctcgactgggacacctacgcggacggtctgctcgccgtcgtcgcggaggcgatcgcgctgcgggcgggccggaccactgcggcgcgcccgtccggcccgccgcgcgagaccgcgctgcgcctggccgacctcgcgagccgggatgggcccctgccggaggatttcgacgccctcggctatatccggctgcacgccgacctcgcggcgctgttcgagcacgcgtggcaggggcagctgcactacctcgagcacggccgtcgcgagggccgcatctacccctcgaacctgacgcgggcccagcagaaggccgcccaggcctcgcggatcgcgctcgcggtcgacgggctcgacggctccggcaagtcgagtatcgcacggcacgtcgccgaggcgctcggcgcgacggtgctcaacccgttcagcggtcaggtcggcgcgatcctggtccacctcgcccggacggggcagcacgcgctggccgacgacgtggcgcacgcggccgtggcagcggcgatcgccaacgccccgccgggaccggtcgtgttcgaccggcactggttcaccgcctcgcagctcctctcgcccgccttccgtccgggttgggagccgcgcccgttcaccgtcatgtgctgggccgaccgtcccaccaccatcgcccgcatggtcgcgcgcggcgtcccgaacccgtcggagcacatgaccgaagcccgtatcgccagctatcggacgctcgcggaggagctgcgggtgccgctcctcgacacctcccgcatcgcgccggaggagggggccgcgcaggtgctggcgatgctgggcgagagcggcgacacggcgcggcgcgcgtga

SEQ ID NO: 6361 - DNA, 666 bp, Methylobacterium sp.
atgcacgagctcggccccgacttcgtcggcccggcggcggagcctcggccttccgaaccctgcggtcccgagatcgccgcatccgactggccgagcgtgcggcagtggcggaaggagacccgcgccgcgctcatcgcgcggcggctcggcatgtccgcccaggaccgcgccgcccggagcgagcggatcgggcagggtctccgagccgctctaccttcgccatcgggcctatcgatcggtctctactggcccttcaggggcgagttcgatcccagatcactcctgacggagctgcgcgggagcggggcgcgactggcgcttccggtcgtcgtcgagaaggcgcgcccgctccggttccgggtctggtcgccgggcgatcgcatgatccgcggcgtctggaacatacccgttcccgcagagggcgagactgtcgacccggacgtcctgatcgcgccgctcgtcggcttcgatcaggccgggtaccgcctgggatacggcggcggcttctatgaccggaccatcgcgtccatgtcgaccaagccgcgggtcatcggcgtcggcttcgagcttgcgcggctcgcgacgatccacccgcaggcgcacgacgtccccatggacatcatcgtgacggaaggcggcgtctggccccgcacggagcgatcctga

SEQ ID NO: 6362 - DNA, 1218 bp, Methylobacterium sp.
ttggtcgcgaacatcgcggccaatgtcctgacgcgggggactctgatcggccccttcctgtacagtctcgccaacctcgccgaggtgatgttggccgtccgtctcctgcggaggacctacgagcacgacgccctgctgcaatccacgagatccgccctgcggttcctcgcgatcgcgggattgctggcaccggccgcgagcggcgtcctgggaggtttgacggcgcatctcgtcttcggcgaacccctgttgcgatcgttcggcacctgggtcgcgagcgacggcctgggactcatcgtcttcacgcccttcctgctctcgctgttccgaggcgattacgcgaacgcgctcgcggagcggagctggcgggaccggctcgaagcggccgccttgctcgtcctcgcaggctcggtcgcgtacgcgaccttcttctgcacgagccgccccttgctgttcctgatcttcccgcccctcatcctgatcgctttccggctgggccgcctgggtgtcaccgcggccgcgatggtcgtggccgtcatcggaggcgtcgcaacgatgtacggtcgcgggccgatggtcctgatcgcggccgacgccgtcacgcaggcgcaggcgttccaggtgtttctggccttcatcctgctgacctgcctgcccgtcgcggcggaggtctccgcgcgggcgcggctcacggccgagctggccgcgcacgatcgagagatgacgaggagcgccttcaccgattccctgacagggctgctcaaccgggcgggtttcgagcatcagatcgagaccatcctgcccatcagggctctgccgcccgtcagcctgatcgcgatcgacgtagatcatttcaagcagatcaacgaccgctgggggcatccggcgggcgatcgcgcgctcgagactctcggatcactgctcgcgtcgcagatccgcccgggggatctggtcgcgcgcctcggcggcgacgagttcgtgatccttctacgcgagagcgatctcgagcgcgcgcgggcggtgtgcgagcggatccgcgcgagcgcacgcgccgcggcgttctcgaccagtgccgggtccgaggcgccggtcagcctgagcatgggcctggccgtcgcgcgcgtgggcgagcgctacgaagcgctggctcagcgggccgacagcgctctgtacgaggcgaagcacgccggtcgcaacgccctccgatgggccgcctga

SEQ ID NO: 6363 - DNA, 639 bp, Methylobacterium sp.
atggctccttactccaatgcgcagctgatgcaggacctttgggtgctatatgaactccaagaaaaacgaaacggttatttcgtagagttcggcgcctgcgatggaatcagtctcagcaatacttttctccttgaaaagcgctacgcttggcagggagccctcgcggagccggctcgggcttggcacgaagcgctgcatcgcaatcgcagctgctacatttccgacaagtgcgtctacaagaccgacgggattgaggtgctgttcaacgaggtcgacatcggcgaactctccggcatggaggactttgccggtgacgattttcatgctcaattccgccaggagcgccggcaatacccggtggccaccatctcgctggaacggttcctctcggaggcaagggcgccccggcacatcgactacatgagcatcgatgtggagggcggcgagttcgacgtgctacagagcttcgatttcagccgtcacgacatcgcgctgatcagtgtcgagcataatttttcgggcagccgggagaagattgagacgctgctgagcagtcacggctaccggcgccgctttcgtcagctgtccctgttcgacgactggtatgttcgcccagatcttgtgatcgcacgagcctga

SEQ ID NO: 6364 - DNA, 231 bp, Methylobacterium sp.
atgccgcgatacttcatcgtcacatccgatcacatcacggtcaaggacgacgaaggcgtgcaactttccggtcgggacgcgctgcgcgacacccttcgccggctgctgaccgatatcctgcgcgatgagggctatcgcaccgaggtgaacgcgttcaccgctcaagcctacgacgaagcgggcaagctcgtgatgagcgcgagcgccagcttctcggcaacagatgtgtag

SEQ ID NO: 6365 - DNA, 285 bp, Methylobacterium sp.
atggatgtgcgcatgactgatcgtgagacgtgcttggacgcgctgggagcgctcatcgtccgggcggacccggccgatctcgcggccgcccaagatatcctgctgcgactcgtcctgcgtgaagacggtgcggcgcgacgggcggcggccctcgacgggctccgtgccgaactcgcgtgcgcgacgcgggcggcctcccgctcgcgcgagcaggaggcctttcacacggtcctcctcgcgatgatcgagcggacccgcgacatggccggtgccacgacggcgtga

SEQ ID NO: 6366 - DNA, 888 bp, Methylobacterium sp.
atgacgatcgttccccatcccgccgcccagcgcggcggccgacagcggttggccgcgcgtaggcagcctggatccgcgaccaccagccggatcaccgtcccgctcggcagcgccgcggccctgggctgcggccacgtccagcccgcaattcagcagatctgcgcacccgaactgatggctgcagcccaggccgcgctcgacggcgcgttccgggcgaccttcgtgcccgatcccctgctcggaccaggcttgtctcaactcggatccgtgctggcctccatggtcaaacggcacgggtccctcatcgaggcggccatcacggacgtcctggagcgaagcgggcgctacgtcgtgctccgcaacgtcgcgatgccgatcaccgttccgacccaggaactcgtccgcgccagcagcgtcgcccagctcaaccagacctcgatcgaactcacgggcgcggtcgcgcagtcggtatttctcgacctgatcgtcgtcgaccggaaagagagccgagccatcatcgcggaggtcaaaagaggctccggaaaaaatgaggccaggaaaattcaccaagtcgaatgggtactgcggtgcgcgcaggtccagggccgctcgtttctggcttcactcggctatgaggtcgcgcaaatccgcgcggtgctgatcgacgtctatggacgggccgggtacggtgatgacattacggtgagcggaccggccatagatcagctgttcgcgaccccggtcttggcagcgctcgagactgtgacggcggcgcttcaagcccgattgcacgcggctgtgccggaccttctgacgatggcgttggcgagcctcgccgttcctgagaacgtcaaacacccgcactcgcccgggccgctcgcgccctga

SEQ ID NO: 6367 - DNA, 678 bp, Methylobacterium sp.
atggtcgcggcccccacagccacgtggtcccacatcctctcgcaggtcgccgacagcctggaccgcttcgtcgaaggaccgtccgccgagatcctgaagctcaagccgtccttcgacacggtcgagggaccggccgcgctgtccgcgtcgcgcatcgagcccgtcgcgcacccgccgatcctgccggaacccgcggtcaacgacgcgggccccgcgccggacccctgcgagtccgaggcggtgtcggactggatgagcacgctcgacatcatcaccggcatggccggccgcgccgaagcgcagaagcagcgcctgcaggagcagagcatgtcgcacgaggccgccctggccgccgcgcagcgcgcgctggcggagacccggcaccgcctgcaactgtccgagatgcgcgtccgcgaggtcgaggcccgcgccgatatccggctgcagcgcgtccaggccgaggcggacgcccaggtgcaggacatccgcgcggaggccgaggcgcgcgtccggacgatccgcgcggaggccgaggcctgggttcgggccgccgaggagcaggtccgcgtcgccgacctgcgcgccgagacggcggagaagtggctcggccggatcgacgcggccgccaaggcgctccttctgggcggccatgcgagccgcgggccggcgggcgcctga

SEQ ID NO: 6368 - DNA, 315 bp, Methylobacterium sp.
atggcgcgcgacggcaaccgaccccacccgagcgccctggcgcgatatccggttccgatcgagctgatctcggccctgttccgcgccgacgacgcggagcgcgaccggctgctcgcgccgatgccggcctacggccgcgcccggatcgccgcctactgcgccgagcacgcgcggctcgaggcgctcggcctgaaggtcgcgcgctcctgcgacgaggccacgctggtcagggctgcgggcgaaacggtcggcgccgacctcttcgcgcgctcgcgggcgcccgcaccgtcgccgatccagctccaggccgcctga

SEQ ID NO: 6369 - DNA, 276 bp, Methylobacterium sp.
atgcgcgccagcaagcctgtcactgtcaccctcggcgacttgcaggaccgcgtcgaagcgcgcgtgaagtccggcagctacgccagcgtgagcgaagtcgtcagagctggattgcgggccctcgatcgcgaggaggcagccctggatgccgtcctccggcagcgggttcaggaggcgctcgacgatccgcgcccgccgatcccggcggatcaggtcttcaccgcgttgcaggcccatcacgccgcgcggatgaaggcggccaagcgtggcgcgtag

SEQ ID NO: 6370 - DNA, 1251 bp, Methylobacterium sp.
atgaatgcgaccgaagatctgacgcgacaggccggcccgcccgaagccccgaccggcgtcttgaccggcgtcccgacgctcacggtggcggagctggaggccgacccgcacggcgtctaccgcgcctggcggccgcggctgcccttcgtcggccacgaggtcgcgggcgtcctcgtcctccgcgcccgcgacgtcgagctgctgatgcgcgacccccgcgcccgggccacggagacgctctatccggaatcgcgcgcgatccccgagggggcgctgttcgacatcttcgcgcacggcatgctcacggccaacggcgcggtccaccgccggcgccgctcgcccttcacccgcaccttcgcggcgcgcctgatcgagggccttcggccccggatccgcgtcgccgcggagggcctcgtccgcgactggctgggggacggggaggtcgacctcgtcgcgcgctacaccgcgcagatcccggcccaggtcatcgccgacatcctcggcctgccgcgcgacgacatcccgcggttcacgcatctcgcctacgaggtctcccgggtgctgagcttcagcttcggaccggaggacatcccggatctggaggcggcggcgatcgcgctgcaggattacgtggccgggatcctcgccgcgcgccgctcggcgccccgcgccgatttcctgtcgcgcttcctcgcggagaccgaggcggccggcgagctcacgccgcaggaggtggtgatccagctcgtgcagatgatcatcggcggcaccgacacgacccgggtcgcgggcgccatgcaggtggcgctgctgctgcagcatcccgagcagtgggcggcggtcagccgcgatcccgacctgatcccggccgcggtggcggagtcgctccgctacgagccgagcgccggctccgccggccgggtcgcccgggaggacattcccctcgacgggcacgtcgtgccggccggaagcctgatgctgctctcgacgctgtcggcgatgcgggacgagacggtctacgcgcgtcccgacacgttcgacatccggcgcaccgacctcccgcgcctccatccggtcttcggcggcggcgcgcaccggtgcgtcggcgaggccctggcgcgggtcgagctggaggaaggactgggcgccgtgctccgcctcgccccgcgcctgcgcctgaccggcgcgatgccggtcctccgcggccacagcggcatccgccgcatcgacgcgctgcgggtcgccgcctag

SEQ ID NO: 6371 - DNA, 444 bp, Methylobacterium sp.
atgcccgcttccgccagcctagaagaacgcccgccgctggtcatcccgacgaccgacctgctttcgctgcgggagatcgtgaccgcgacccacccgtcggatccccgagccgcggtagcggcatggctggcggaggagctcgaccgcgccgcggtggtcgcgcctgaggcctttccgccgcgcgtgatcaccatgcatgcggaggtctcgtaccgggacgacgtcacggaccaggtcgggcgcatgaagctcgtctaccctggcgaggaggatgcggagggacatgccatctcggtcttgtcaccggttggtgcagccctcgtcggtttgtccgagggacagtcgatccgctggcgaacaccgtccggcgggttccgcggcctgaccgtcctccgcgtgctgttccagccgtacggcggggccggtgccagcgatggcccgtag

SEQ ID NO: 6372 - DNA, 273 bp, Methylobacterium sp.
atgcgcctcctcctcgccgccacactcctcgtcctcaacgccaccggagcgtcggccggagagccgctcctcgacggacccgtcgtcgccggctgcttcgggatgggcgggtcggactattacggtgatgtccacagccggatgccgttcaccggcgaggcaccgccgcggccggtcgggatggccgatatcgtgcgcgtccgggcagcccgcgcgcgcgccgcgaccgcctcccggcggcaggcgccgcgtcggccggcgcatcgcggctaa

SEQ ID NO: 6373 - DNA, 174 bp, Methylobacterium sp.
ttgcagcgcagcacgccgggcggaccgcccggccaggacctggatttcggcacgatgaccaccctcgcgaacttcgtcagccggctcgagggtgcggtgcggcgcgctgcggccgaacgctacgccgagcagcgcgagcggatcgcgcggaccggcggcgccggcatgatctga

SEQ ID NO: 6374 - DNA, 231 bp, Methylobacterium sp.
atgtcacgctacttcatcagcacggacgaccatgttgaggtgatggacgaagagggggtcgaggtgccgtgccgtgacgctctgcgagacctgcttcggcagacgctcacagcgatcctccgcgacgagggcgagatgacgggcgtcgatgagtttacggccaaggccttcgacgagcgcggtcgtctcgtcatgcaggcgcgggctaccttctcggtcaccgaccaatag

SEQ ID NO: 6375 - DNA, 231 bp, Methylobacterium sp.
atgccgcgctacttcatcgacaccgccgaccacgtcgccgtccgggacgacgagggcacggttctcccggaccgggccgccctgcgggacctgctgcgccggaccctgacggcgctcctgcacgacgagggcgaggagaccggggtgaacgacttcaccgcccgcgcctacgacgaggacggtcgcctcgtgatgcgggcccgggccaacttccacgtcgtggacccgtag

SEQ ID NO: 6376 - DNA, 258 bp, Methylobacterium sp.
atggcggcggtcgcgttcgacaccctgacattcgcccggaccctccgggaggaggccgagctctccccggaacaggcggagggcctggcggatgccatggcggaagcgttgcagggcgatctcgtcacgaaggcggatctacgcgccgagctggcgggcacgcggtccgaaatcgtgcgctgggtggcgggcctgatcggcttccagacgctcgctgtgatcggcgcggtcgtcgccctcgcccgggcgctgcactga

SEQ ID NO: 6377 - DNA, 852 bp, Methylobacterium sp.
gtggctgatcgcccgatcctcctgcgcgaggccgaggtccgcgcgtttctcaccggccggcggacgcagctccgccagcccctcgacccgcagccgcagttcttcgatgtaccgatcctggaggggcgcggcgtcggccgcgtcggccatccgggcgagctgtggccgttccggtgcatcagcacggcggtcgagcgcgacttccagtgctgggcccggcgggctgtgccgcacctcgccgtcggcgatcgcctgtgggggcaagagccctggcaggttgcccacgagacgctcgattacgagaccggcggcgaatacgacgtgttcgagtggcgggaggacgagtacggcgacccgcgcccgttcctgggcggagatgcccgcttcggcacaagggcggggctgttctacagcgccgatggtcaggacgagaacccgtcgaacttctacccgctgatcggcatccgcggcgacgtgctgcggcccgccgagatcaactggatgccggccgaggacatgccgcgctgggccagccgctgcacgctcctggtcacggccgttcgcgtcgagcgcctgcacgacatcagccgcgatgacgcgatggccgaggggatcgtccagacctggggcgacttccgcggccacccgccggagtgggcgcttcgcgagggcgaggacgcgtcgcacttctacgacaaccggacctcggtcgagaacttccgcttgttctgggaccacgtccacggccctgacgcttgggcggccaacccctgggtcgcggccgccacgatcgccctacagcccggcaacatcgatagcccggcacaagccgcggaggccgcccatgcctga

SEQ ID NO: 6378 - DNA, 663 bp, Methylobacterium sp.
atgaacaccgacgcgattgccgcccggatccgcgcactgctcgccaagaccgtctccgccggcgccaccgaggccgaggccatgtcggccgccgagaaggcgcgcgagctgatggagaagtaccggatcgaggccggcgacctggacaaggagccgatccgcatggagacgcccgagcagcgccgcggcgccctgatccgcgcgcacctcatggccggcgtcggccgcttctgccaggtcatggcctaccgcggcgccgacggcaacttccgcttcgtcgggcgcgatggcgacgtcgtgttcgcaacctggctgctcgacgcgctggaggcgttcgtcagccggcgcacgctcgaccacgtcgccagcctcggcgggatgtcgcgtggcgcccgcgagcggacgctgcagagcttcaccctcggcgtctgcgcccggatctcggagcgcctgcgcgaggcgtcgccggctgtctcccgcggcgaggcgcgcgcgatcgccgagtacctgaaagggcagggcatcacgatccgcaccggcaagtcgagcggccgcaccaccgtcgaccgcgacagcttcaacgccggccgctcggcgggcgatggcgcccagttcaaccgccccgtcaacgcgggccagcccgcccgccgcatcgccgcctga

SEQ ID NO: 6379 - DNA, 174 bp, Methylobacterium sp.
atgctcgcgcgggtctgggacgtggtgaaggcgacgctggcggtgtcggccctgatcgccgccgccctcgtctcggcggacaagctcgatcgccagagatcacaaccggtcgccggcgcggctctggtcgagcctgcgacgaccggtgcgatcgcaccggcgatacgtccgtga

SEQ ID NO: 6380 - DNA, 885 bp, Methylobacterium sp.
ttggccactctgtgctgggccgggctcgccgcgccgtcggtcgccgaggggcgcctcgacaagatccgcgcgaccggacagatcagcctcggcttcccagacgcctcgccgcccttcggcttcctcgaccagaacgccaagccggtcggctattcgctggagatatgcgagcacgtcgcgcagaagctcaaggccgcgctcggcctgaacaagctcgaggtgcgccacgtgccggtgatgtcggcgacccggatcccgctgatcaacaacggcacgatcgacctggaatgcggcaccgccagcaacctgcccgagcggcacaagctggtctcgttcgcgccgaccaccttcgtggcgcaggtggtgctggtggccaagaaggacacgccggtggatgtcgacgacatcgcctcgttccgtggcaaggccatctcggcgcaggccggcggcgagacccagcgcgtcgccacccggatcaacgtccgcgacaagctcgacatccaggtgatgccggccaaggacaccgccgaggtgttcctgctcgtggagaccggccgcgcggcgggcgccatcaacgacgacgctctggcccacgccacggtggcgggggccaagcggccggcggattacaagatcggcaccaagggcctggaattcgccccctacgggatcctggagccgaaggacgacgcggccttcaaggcggcggtcgacaaggcggtggtcgagctgatccaggacgggaccgtggcgcggctctacggcaagtatttcgagcagccgatcccgccgaagggtatcaacttggagctgccgatgagcgacgtgctcaagcgggccctggccaacccgaccgattccggtgacgaggcggcctaccggtag

SEQ ID NO: 6381 - DNA, 129 bp, Methylobacterium sp.
atgggtctgatcgccttcatcctgattggtggcccctgggtggcagcaacggcgtggctctggcaccaggcaggcggcgcggaggcctggcgcaacgccgtccacggcaccgtgcctggcaggcagtga

SEQ ID NO: 6382 - DNA, 1284 bp, Methylobacterium sp.
atgagcggcctgatcatcttcgggctgctcatcgccctcatgctcaccggcatgccgatctcgatcgcgctcggcctgacggtgctgaccttcctgttcaccctcacgcaggtgccgatcgagagcgtcgcgctcaagctgttcaccgggatcgagaacttctcgatcatggcgatcccgttcttcatcctcgccggcaacttcctggcccatggcggcgtggcgcggcggatgatcgccttcacgacctcgctcgtcgggcactggccgggcggactcggcctcgcgggggtcgtcgcctgcgcgctgttcgccgccgtgtcggggtcgagcgtggcgaccgtggtggcgatcggctcgatcatcctgcccgccatggtggcggagggctacccgcggcgcttcggcgccggggtgatcaccacctcgggggcgctcggcatcctcgtgccgccctcgatcatcctcgtgctctacggggtgtcgacgaattcctcgatcggcaacctgttcctcgccggggtgatgcccggcatcgtcctgtcggccatgctggcgagcgtcaccttcgtcatcgccaagcgccgcggctatccgcggatgccgagggcgtcctgggccgagcgcctgcgcgccttccgcgagagcgcctggggcctgttcctcgtggtgatggtgatcggcggcatctacgcgggcatcttcaccccgaccgaggcggccgcgacggcggccgtctacgccttcgtcatcgcggtgttcgtctaccgggacctgaagctgtcggacgtgccccgcgtgctcctcgcgtccgccaacatgagcgcgatgctgctctacatcatcaccaacgcggtgctgttctcgttcctgatgacgtcggagaacatcccgcagacgatggcggcgtggctgatcgccatgaacttcagcccgctggtcttcctgctggtcgtcaacatcatcctgctgatcgccggcaacgtgatggagccgtcctcgatcctgctgatcatggcgccgatcctgttcccgatcgcggtcaagctcgggatcgacccgatccatttcgggatcatcatggcggtcaacatggaggtcggcctgtgccacccgccggtggggctcaacctctacgtggcgagcgggatcgcccatatgggcatctccgagctgaccgtcgcggtgctgccctggttgctgacgatgctggccttcctggtcctggtgacctactggcccgccctgtccctgtggctcccgcgggcgctcggggcaatgtga

SEQ ID NO: 6383 - DNA, 588 bp, Methylobacterium sp.
atgttgctgaaactcctcgatcggctcgaagaggtgctgatcggaaccctgatggcggccgcgaccgtcatcaccttcgccacggtggtgcaccggttcctgtccggcatcccggcgctgcaggactacaccgaccggatcgacttcggctggtcgcaggaactgtgcatctacatgttcatctgggtcgcgaagttcggcgcggcctacggcgtgcgcaccggcatccacgtcggcgtcgacgtgctggtcaaccgcctgccgccgggcgcacgccgcgtcatggtcttggtcagcctcgcggcgggcgccctgttcaccgggatcgtcggcacgctcggcacgaacttcgtctggcgcatcggccacaccgaccagacgacgcccgacatggagatcccagtctggatcgtctacctggcgatcccgctcggctcctacctgatgtgcttccgcttcctgcaggtcgcgtggagctactggaagaccgggcacctgcccgcccgcgatcacgcccatgtcgacggcgtcccgaccgtcgagggcgtcgacccgatccagctcggccgcgagggaggccccgcatga

SEQ ID NO: 6384 - DNA, 1272 bp, Methylobacterium sp.
atgggagagctgtgcgtgccggatcactccgccaagactcactccgccgagacgaacagggacgggccgctcgcgggcgtgcgggtggtcgacctgaccagcgtgatcatggggccctcggcgacgcatatcctggcggatctcggggccgacgtgatcaagatcgagacgccggagggcgattccttccggcactaccggccggcccgcggcgccgggatgggcggcaacttcctgcacctcaaccgcaacaagcgcagcgtccgcctcgacctgaagcggccggcggcgcgggccgccctcgaccggctgatcgccaccgccgacgtgttcgtccactcgatgcggcccgacgcgatcctgcgcctgggctacggctacgcgcgggtgcgcacgctcaagtccgacatcgtctactgcggcgcctacgggttcggggccgacggcccctacgcccacaaggcggcctacgacgacctgatccaggcgggctccggtctcgcggccctgcagacagccgtcaccggccagcccggctacctgcccacggtgctgtgcgacaagatcgccggtcaggccatcgcctgcgcgatcctcgccgccctctacgagcgccgggccggcggcggcgggcaggcggtcgaggtgccgatgttcgagaccatggtggagttcaacttcgtcgagcacatggtcggctacgccttcgagccgccgctcggcccgccgggcttcaaccgggtcctgagcccgcggcgcaagccctaccggacccgggacggccacgcctgcatcctgccctactcggaccggaactggcgcgacttcttcatccataccggccggctcgaattcttggacgatccgcgcttcgcgccgctcgccgtgcgggtggagaacatcgagatcctctacgcgctggtggaggaggaggcgccgcgccggaccaccgccgagtgggtggcgttctgcgactcggtgagcatcccgtgcatgccggtcctcggcctggagaacctgccggaggacgcgcacctgaaggcggtgggcttcttcggcagcgccgagcacccgagcgaggggcgctaccgcacgatgcgccggccggtctcgttcagcggcagccgcttcgcgatccgccgccacgcccccaggcacggcgagcacaccgccgaggtcctggccgaggccggcctcgacccggccgagatcgccgccctgatcgacgcaccggacaagccagacaccgcgcccctggaggccgcccgatga

SEQ ID NO: 6385 - DNA, 873 bp, Methylobacterium sp.
atggaacagagaaccatcggcgtcatcggcctcggcatgatgggcgatcccatgagccggtgcctcgcccgagcggggcacgcgctccgcctgctcgacgcggatgcaggccggaccgacgcgcttgcccgggatctcggcgcggcgacgctcacgctggagaacgcgtccaaactcgacctgctgatcacgatgctgccgaactcggccatcgtcgaggcggtgctgctcgacgagggctgggccgacgcgctcccggccggcgccaccgtgatcgacatgagctcctcggagccggtgcgctcccgcgccctcggcgagacgctcgccgggaaggggctcggctatctcgacgcgccggtctcgggcggcgtgcggcgggccgtggacggcacgctcgcgatcctcgtcggcggcgagccggatctcctcgcccgctggcggccggtgttggaggcgatgggctcatccgtcctgcatatcggcccggcgggatcgggccacgccgccaaggcgctgaacaatttcgtctccgccgcgggcctgctcgccaccgtcgaggcgctccacgtggcgcagcgcttcggcatcgcgccggaggccatgacggacgtgctcaacgcctcgtccgggcgcagcaacacctccgagaacaaggtcaagcagttcatgctcagcggcagcttcgcctcgggcttctccctgaagctgatggacaaggatctcggcatcgccggggccttggccgagtcggtcgactacccgctcgggttcggccggcactgcatcgagacctggcacgcgatcgccggcgaggtcgggcccgcggccgaccacaccgagatgtaccgcctgctggccgagggagcctga

SEQ ID NO: 6386 - DNA, 591 bp, Methylobacterium sp.
atgtcggcgctgggcgtcggcatctgggaggatgcgccgcacacgggatgcgtgcgcggggacgcgacgatggcgcggatcttcggcctgaccgaggccgaggcggcggacggcatcacctgggagcagctctccgcgctcttccacccggaggacctcgcccgggaccagagcgagcgccgccgcgtccgcgaggagggcggtctcttcgcctgggagcaccgcatcgtgcccgcgccgggcgtcgtgcgctgggtcctggcgcggggccggttcgagcgccgcgcggacgggcacatctacggtcggggcatcgtgatcgacatcaccgacagccgggtcgacggcccgtacgagccgccggtcggttttctcggggctccggccgagccggggaccgccgtcgagcggatggccgattacgcgatgcgcctgtgggagctggtcggcgatctcgggcccggggaggcgaagcgggtgcagccgctgctcgaagtgctgctctacgagctgggacggcagatcgcggccaccctgtcgggcgagcccccggaggcgccgcggcgcccgcggaacccgcgggcgcattga

SEQ ID NO: 6387 - DNA, 924 bp, Methylobacterium sp.
atggaccgatccgcccgcgtcaccgagatcctgtcgtggtacggggccgacagccccgggaccctcaccaacctcgcccggatgctggagcacggcaagctcggcggcaccggcaagatgctgatcctgcccgtcgaccagggcttcgagcacgggcccgcccgcagcttcggtccgaacccgccggcctacgacccgcactaccatttcgagctggccctggcggcgggatgcaacgcctacgcggcgccgctcggcttcctggaggcgggcgcgcgcgactatgctgggcgcatcccgctgatcctgaagctcaacgaccacgacctcctggccgacgaggaggatcccgagcaggcgataaccggttcggtggccgacgccctgcggctcggcgcctgcgccatcggcttcacgatctacccgggctccgcccaccgcaacgccatgtacgggcagatccgcgagatcgccgaggaggccaagagcgtcggcctcgccgtggtgatctggtcctacgcccgcggctcggccctgtcgaaggagggcgagaccgccatcgacgtgatcggctacgcggcccagatcgccgcgcagctcggcgcccacatcatcaaggtgaagctgccctcggcccatatcgagcagccggcggcgaagaaggtctacgaatcgaccggcatcccgatcggcacggcggccgagcgcgtccgccacgtggtgcagtgcgcgttcaacggccggcggatcgtgatcttctccggcggcgcccaggccgaggaggccagcttcctcgacgagatccgggccatccacgcgggcggcggattcggctcgatcgtgggccgcaacgcgttccagcgctcgaaggcggacgccctgtcgctgctcggcaagatcaccgacatctacgcgggccgctga

SEQ ID NO: 6388 - DNA, 657 bp, Methylobacterium sp.
atggcgaccgacacccgagccgggcaggcgatctacaatccgcggacgctgcagatctacgacctcgtcgtgctgcgcctgtcgaacccgctgatctggcgctgcccgacggcgcggattctggatctctacgaccggcacgcgggcctcgcgcatctcgacgtcggggtcgggaccggctggtacctcgaccgatgccggttcccggcgcccgcgccgcgggtcggcctgatggacctcaacgccgacagcctcgccttcgcggccgaccggatcgcgcgctaccggcccgagacctaccaggtcgacgtgctcggcgccccggccagcggcattgcgccgttcgactcgatcgggatgacctacctgctgcactgcctgccgggcgacatcgccgcgaaggcgaaggccttcgacacggtgcggccgtgcctggccgacgacggcgtggtcttcggcgccacgatcctgtcggggggcgtcccgaccacgggggcggcgcgggcgctgatgcgggtctacaaccgcaagggggtgttctcgaacgccgccgacacgctgccggagctgcgcgcggcgctggagcagcggttccggtcggtggagatcacggtcgtgggctgcgtcgccctgttcgtcgcgcgcgagccgcgctga

SEQ ID NO: 6389 - DNA, 210 bp, Methylobacterium sp.
atggcctacaagatcacttttcgccgcggaaagcgcgagagcttcaccaagctgtggccgtgcgatctcgaggcggcgacggcctacgcgctcgcgcagctccccctgcagcagcgcgagaacggggcgacctctgtcaccgtcgtgtgcgagcggaccggcgaggtcgtgttcaactcgaccgagcagcccgaggtcgcgaccgtctag

SEQ ID NO: 6390 - DNA, 288 bp, Methylobacterium sp.
atgatcagacgatgtctgctgctcctggtctcggcgctctcgctgccgctgcagaccggcgtggcgctggccgagagcgaaatgccggcagggggcgccttcatgagcagttacacttcggatccctacttcgacccgcggtcgcggtactcgcaggctcactctaccggagacatccgcggacagccgatgctggccgaaccgggcgacgcccagccgccctgcgagctcttcgacacggcctgcgcggccgccttcgagcgctcacgcccccacgcgtatcgctag

SEQ ID NO: 6391 - DNA, 840 bp, Methylobacterium sp.
atgaagttcccggacggtgacactgtccgcggtagctggactatcgccgactttagtcagtacatcggcgggtacgatctccagggtaagtctgtcctggatgtaggcacagcgtctggcttcctggccttcaatgctgagaaggccggtgcgcaagtcacgggcctagatgccgcctcgaccgacgagtttaggcacgtccctttttcagacagtctgtcatacagggacatccgacaattcaaagatacgtggaccattcacaacctaatcccgataaaaaactcctggtggcacgcgtggcataagtacaacagcaaggccaagtgcgtgtatgcgccgatgcccgagctttacgagtggcccgagcagatgttcgacgtggtcatggccggcgcgatcgtcgagcacctgtccgagcccgtatatgcgatcggagcatgggcccgcctcgcacgcgaagccgtgttgatcccgttcaccgacgttgttccggtagacgatctgatgatgcggccgatcacgccgctggacaacagcgcgatcaactacgtctggtggcacctgtcgcgcggcctttacaacaagatcttcgacaatctcggcttcgacttgcattacacgctcgcgcgtgctgagcaccacgacgccgaaggcggcacacagctcgccacccgtccgtcgatcatcgcgatcagacgcgggacggacgcggccagacgcttcgacgcctcgaagctggaggatccgttcccgagcgtgctggtgtctgccgtgccggcgccgccagacacgcttatcccgggcgggaagaagcgctggtggcgcgggaagctgtag

SEQ ID NO: 6392 - DNA, 339 bp, Methylobacterium sp.
atggccgcccgccctcgcttcgccagcaccgcgcaggccatgcgcgcctcggccgccatccgccgcgccgtcccaacggcagggggagccgctcggctcgcccatcacctcggcctgcacgccgtctcggtcgcccagtggacgttctgcccgacgcagcacgtcgaggcagtcgaggccgcctcgggtgtgtcccggcacgacctgcgcccggacctctacccgcgcgccggcaagggccgtgacctgacgcccgaccaggccgtcgccgcgcatctcgcggccggcgatcacttcgcccgcaccggccggtgcctctcttcggaggcgcacacatga

SEQ ID NO: 6393 - DNA, 1077 bp, Methylobacterium sp.
gtgcgcgctcccgctgtcgtcggcctcgtcctgctgctgatggccggtccgggcccggcctcggcacaggtcgaaccgtctccggcggccgaggggaccgggtctgccgcggcccgcggcgagaccgtcgtggtcgtgcgggcgacgaccgacgaggccgaggtcgccgacctcctcgcgggcttccgcgaggcccatcccggcgtggcggtctcctacaccaagatgaactccgcgaccctgtacgacggcttcgtggaggaggccgcggccggcacggtcaaggcggacatcgtgtggagttccgccatggatcgccagatcaagctggtgaacgacggctacgccgcccactacgcgtcccccgaggcttcctccctgccggcctgggccgtgtggcgcaacgaggccttcggcgtcacggccgagccgatcgccgtcgcctacaacaggacgctcctcccgccggagcaggttccccagacccgcgccgacctgatccgagccctcaccgaccaccccgagacgtggaaggggaaggtcgccgcctacgatccggagcggagcggtgtcgggtcgctcatcctcgcgcaggacgcggacgtgacgtcccggacgtgggacctcgtctccgccctcgggcaggccggcgtgaagctctacacccggacggagaccatgctcgaccgcatcgccgcgggcgaggccatcctcgcctacggcgtgttcggcgcctacgccctcgaacgggcccggcacgatccggcgatcggcctcgtgctgcccacggactatacgctcctcgtctcgcggatcgccttcatcgcgaaggacgcgccgcatcccgccgccgcccgcatgttcctcgactacatgctctcccgcgaggggcaggcgcggctcgccgcccggtcgctgacgccggcccggacggatgcccgccgggccgacgacccggtcgcgtccgccccggccctgcggccggtcccggtcgggccggagctgctggccaacctcgaccagatccggcacgcccgcatgctgcggcgctggcggcgcgccatggaaggccgctga

SEQ ID NO: 6394 - DNA, 1401 bp, Methylobacterium sp.
gtgacccggccgcgcgcgccctcgatccggcggcgcctgctcgtccgcatgctgctcccggccctggcgctcgcgctgctcctgggcttcgccggagcgctcgtgatccggaacgtcgtggagaccacccacgatcgcctgctcgacgggtccgtcctggcgatcgccgagcggctgaccgtggaggacggcgaggtgtcggtcgacctgccccgcgtcgccctcgggatgctggagagccaggcgcaggaccggatctactacagcgtcacctacggcggggcgctggtgaccggctatcgcgacctcccaggcctggacgtcgatacgctcccgctcggggtgacgacccatcgcgacggcatcgtccgcggggcggccgtgcggatcgccgcccaggcccggcgggtctacgggaagcccaacccggtcctcgtgcaggtcgccgagacgcgcgaggcccgtcagggcctggagcgacgcctgctcgccgggctcgcgctggccgagctggggctgatggggctgatcggggcgctgtcgtggtacagcatcgacagcagcctgaggccgctgacccggctgagcgacgcgatcgaccggcgggcggtcccgggcgcgatcaacctgcagccgctcgacgtggccggggtgccccgcgaggcgctggccccggtgctcgccctcaacacgctgctcgagcgcctggagcagtcgatcgcgggggagcgcaccttcacgtcggacgcctcgcaccagctgcggacgccgctcgccgtgctcaggatgcacgtggaactgctccgcaggctcacgcccggcgaaccggcccacgccgcggcgatcgacgatatcgacggagccgcgcggcgcctggaacgcctgctcgcgcaactgatcgcgctcgcccgcgccgatgcgggcgcggccggcacggacgcccccgcggcgatcaccgacctgaacgacatcgcggcccgcgtggtcacggagcaggtgccccacgccctcgcgcgcgggggcgagatcgcgctcgatcgccccgacggcgcggtgccggtcgtcggcgatccgttcatcgtcggcgagatcctcaccaatctcgtggacaacgcgatccgctacaaccgtcccgaaggcaccaccgtcgtccgtgtccggcgcacggagatcggagcctgcgtggacgtcgaggacgagggcccgggcataccgccggaggtgcgcgagaaggtcttcgagcggttctaccgtgtcgcgacgagagacggtcctgacggcagcggcctcgggctcgcgatcgttcgagccctcgcggaccggatcggcggagcggtcacgctcggttcccggcccgggggatcgggactggtcgcgcgggcgagcttccgtgtgccgtag

SEQ ID NO: 6395 - DNA, 2010 bp, Methylobacterium sp.
atgaacggcaccttctcggatgcgtgcggcgtcgccgtcgcgacgctgctcggcatccccctcgttctcctgccgggctacgccctgggcgggctgaccggcatcctcgggttccgcacgctcgcgcccggcgaccgcctcctgtgtggggcgctcctcgggatcgggctcctgccggccctcgacagcctgctgatccaggcgggcggcgtcccggtcgcgaccctcgcgaccggtgcactcgggctcgccgccctgcggccggtcgtgcggagcctgcgcgaatccctcgaccgggcggcgctcgccctcgcgctgctctggctcggcgtcgtggcctacgcgctcatcgacgtcgataccggcaccgccctctaccggcccgtgacgatcatcgacctcgtcaagcacgccgccctgacccgcgcgatcgtcgagcacggattgccgccggtggacccgttcttcgcccggcccgagcgggcgggctactattacggcttctatacgctcaccgccctggtcgactgggcgggcggacggctggtcgacgggcggaccgccttcgcgggcctggccttctggaccggcctcgcgctcctcggcctgatcgaccgtctcctcgccgcgaccggactcgtcgcggacgccgtaccccggctcgtgcgccacgcggtgctgctgctgctgccggccggaagcctcgacatcctgctggtcctcgccgaccgggcgacgtccgggacgtggctgccggtcccggaatggctgaacgagcagatcctcaactggcccgcctcgctggtctgggtgccgcaccacgtcgccggcgccctggccgggtggctcggactcctggccctggcagaggtcgcggaccggacgcggccggaccggcgcgcggaggcggcggcgatcggcgtcgcggcactggccttcgcggcctgcgcgggcctgtctgtctgggtctgcctcggcacggcggccgcggctggcgcctggctgatgctgctcggcctggagcgccgctggcgcgcggcggcccggctggcggttgccggcctgctcagcgccgcgctggccgccccctacctgctgagcgtcctggccaaccggaccgacggcggcgcgccgatccggttcgcgatccggcgattcgggccgctcgacggcctcgtcgacgagccggcgctgagcgcgctccgcctgatcctcctgccgctgaactactacacggccctgggggtctgcgccgccggtgcgctgctgttctggcgcctcgtgccctgccgggaggcgcacgggcgcgaggccggacgactgctcacgctctgcgccgcggcgagcctgctcctcggcggtttcctgcgctcggcgatcctcaacaacgacctcggcgcgcgcgtggtcctgctcgcgcaggtcgcggccctggtctggaccgtggtggcgctgacccgcctgagcgaggcgcggcggctccggttccccggcctcctcgccgcgctgctgatcctcggctacgcgacgaccctctacggcttcgtcgggatgcgcgcctatcccgcctcggaccggcccgccttcgcccgcctcgccggccgtcccgatatcgaccgggcgctgcgcgcggcctacgcctgggcgggcacgcacctgccccgggacctggtgctgcagcagtcgccggtgccgcaccgggtgttcgatttcgggctctacggcctccagccgacgggggtggccgacgcggaggcgcgcctgttcggcgccccgccggacgccgtggcgtcgcggctcgccgacgtcgcgccgatctttcgcgaccgcctggacggcgccgaggttcggcagcgcgccgattcggccgggatcggcgccctggtcgtcaccgcgcaggacgccccctggagcagccccgattcctgggtctggcgcagccccgcggtctacgccgatccgctcgtacggatcctgcgggtccaggatctccgtggaggatctccgtga

SEQ ID NO: 6396 - DNA, 582 bp, Methylobacterium sp.
atggccgagagtccgttcccgcagatcacgctggtccgccacggtgagaccgcctggagccggtccggtcagcataccgggcgcagcgatatccccctgacgccggagggcgaggacgcggcgcgcgccctcgcccctcgcttggcgcgccgcgcctacgcggaggtctggtcgagcccgtcgagccgggcggccgcgacctgcgcgctggcgggtttcggcgacagccgcgcgatcgacccggatctcgcggagtgggattacggcgcctacgagggccggaccacgaaggcgatcctggccgaccgaccggactggcgcctgttccgcgacggctgccccgcgggcgagacggcggcggatgtcggcgcacgggcggaccgcgtcatcgcccgggcccgcgcccgcgacgccgacctcatcgtcttctccagcgcacacgttctgcgggtgctggccgcgcgctggatcggcctggagccgcggtgcggcgcgctcctcgtgctcggcaccgcgagcgtctcggtcctcggctacgagcacgaccgcaccgagcccgtgctgcgcgcctggaacgggtag

SEQ ID NO: 6397 - DNA, 957 bp, Methylobacterium sp.
atgttcgctgagcgcccgcgcggcggcgtcggcgcgtggcccctgatcgccgccacgctggtcgccacggtcgtctggatggcggtcgccgggctgcacttcgcctgggacagcgccctcgtcaccctcgcggcctgcggcgggctcgaggccctggcgcgggtctaccgcacgcgacgccccgagccgcgcatcgccgcgacgctcagcgcgctggcgcaggtcatcgccttcagcgcctgcgcggccgcgctgtcgtacacggtcgcgagcaccggcggcccgctctgggattcgaccttcgacgcctgggaccggcggctcggactggactggcgcgcctacctggccttcgtggacggccatccgcggctcgggctggcgctctcgctggcctaccggagcctgatcctgcagaccatgctggcggtcatcctgctggggttcagcggccggctgcgggccctgcgggacttcgtcctggccttcgccctcgccggcacggtgacggtcctgatctccgcgctgacgccggccctggccaacttcgtgttcctgggcctgtccccggcggacttccccaacctgcacccggccgcgtcctacgtccgcgtcgcggacctgaccggcctgcgcgacggcacgctccggacgatctccctcgaccacgtcgagggcatcatcacgttcccgagcttccacgcggcgctgggggccctctacatctgggcgttctggcacctgcgcgcggcccggatcccggccctcctcgtcaacgtcttcctcatcgccgccacgccgatcgacggcggccactacttcgtcgacgtgatcgccgggctggtcatcgccgtcctggcgatctgcgccgcgcgggcgctcgggcggcggcggcgggccacggacgcgctccgccccggagcgccggagggcggacccgctccgggacgggcctga

SEQ ID NO: 6398 - DNA, 1008 bp, Methylobacterium sp.
atgcggcgatcgatcctgttcctggcggcctgtctgctggccggcatcacgccggcggcctccgccgggcccgcagcggacggcgtcgccgatctcggcagctacgccgcccgcgtggaggttcacccgttcgagagcctgacgctgaccgaccggcagttcctcaccggcacgtccgagggagcgaagccgatcacggtcgcggggatcctgcgcgtcgccaaggcggggaccgagcgcctgccgaccgtgatcctgatgcacggctccgggggcctgggcggcaacatcgagttctggcagcgggcgctggcggcgcgcgggatctcgaccttcgccatcgacggcttcaccgggcgcggcctgaccagcgtcaacaccgaccagagcctcctggcgcgcacgaacctgatcctcgacatctaccgggcgttgggcgtgctggcgaagcatccgcgggtcgacccggcgcggatcgccgtgatgggcttctcgcgcggggggcaggcggcgctctatgccagcctcaagcgcttcgacgccgcctggaaccgctccggcgtgatccccgccctctacctgccggtctacccggactgctcgatccgcttccgggacgacacggccgtggcggatcggccgatccggatcttcggtggcgggggcgacgactacaatcccgccgccacctgcgcggcctacgcggagcggctgagggcggccggcgccgatgtcgacctgaccgtctttcccggagcgcagcacgtcttcgacaacccggccgggccgacccagcccgtggtcgcccggggcgcgcagaccgtccgcgcctgcgcgatcagcgaggcggcggacggcgccctcgtggcgggcccggacgccacgccgttcacctacgcggacccgtgcgtgcagcgcgacccgcatatcggctccgacgccgccgcccgcgccgggatactggcgcgtgtctcgcacgcgctggacgtcgcgttccggggacggtga

SEQ ID NO: 6399 - DNA, 1086 bp, Methylobacterium sp.
ttgttggaacattacgttccgatcaagccgtcgtggggaaagctgacacctcaggctttcgtcacctcgtacccgctgtcgatccgggacgacatcgtccgggccggtccatggggcatcttcaggatcgtgctgtcggccgctttctcgcgcgtggcgcggcgcaggatcgggaatgcgcgggagtttgctcgctactggatcggtgattatctgctcagaaggtccggcctcgagagctacatgaagcggttcttcggcgttccggccgaccgggtcgatctggaatttgccgagaagcggatgctctggatcaaggagcacgccagcccgcgcgtcttgttgcgctatgtccgccggcatcgcgcgccgggtccgaccaacaggcagttggcgcgaccccgcgaaggcttcaatgccctctacgaagtggccgcccggaccctgcggcagcgcggttcggtctttcatctgggcgagcggatcgattcgatcacacggcgcgggacgcaattcgatgtccgcaccggtggccgccgtttgaccgccaagcgactcatctcgacgatccccattgcacgggcgttgaccctctgcggagtccgagaggatcccggtctcgcgtcggtaacgctgatcagcctgtatttcagcttcgacgggaatcgcggcttcgactgttcgatcctctacaacttcgcgcatgacggtgcttggaagcggctcacgatgtattccgatttctacggtcgggtggaggggcgcgagtattttggagtcgaggtcatcgccggccacgcgaacgattccgtgacgatcgccgaggaggattttcgggctcacgttgccaagaacgggctcttcgccggggatctggtttgcgaaggcagccaagtggtgccctgtgcctatcccatctacaccgggcaggcccatcagcgggtgtcgcgggcgctcgcccaactcgccgacttcgggatcgagtcgttcggacgacagggcggattcgactaccagccgacggcccgtgtttcgacgctcaacgcggcggcccacctgatgccgaccaggacatcggacgcttag

SEQ ID NO: 6400 - DNA, 2538 bp, Methylobacterium sp.
ttggcgcgcgagctgtccggcggcggcctgagggtcgtgctgctggagagcggcggcctcgaccggatggagagcgcggacgcgctggacgccatcgtgaatgtcgggcggccgcgcgcgacccagtgggccgtccggaaccggatcgtgggtggtagctcgcacacgtggggcggccggtgcgcgcctttcgacaccatcgacttcgagcagcgtgcctgggtcccggagagcgggtggccgttccagcgcgacgcactcgatccttatctcgagcggacggccaagtatctcgggctcgcctacggcaaccatttcagcgacgcgcgcttctgggagctgttcggttcgcagccggcctggtccgagccggatcctcggatgctcctgcccttcttctggcagttcagccgcgacgacgcggaatcctatccgttcgagtacacgcgcttcgggcggaaactggacgagaagttgggcccgaacgtcacgttgatcagcggcgcgaccgtcgtcgcgatcgacgtgaacgggacgggcgacagggtacagggcgtccaagtcgcggcgcccgacggcgccatcgtcaagctgccggcccgccatgtcgtcctgtgtgccggcgggatcgagaatgcgcggctcctcctcgcctccgatcatcaggtcccgggcggcctcgggaacaggttcgaccgcgtgggtcgctacctgatggatcatctgcgcgggccggtcgcgcatttcgaccctcaccggtcgcgcgcgctgcagcggcggttcggccgctacaccatcgaggatcggctgttccggggcgggctccgcctgagccccgacgtccagcgaagccgtcagctcctgaactgcgcggtctggctcggagagacgctcgcccccgacgacccgggcgacgcgatccggaggattctggtcggcaagccgcgggcgaaggacatcctgacgctgacgtcgaacctgccgctgctcctgcgcggctgccgggaccatttcatcgcgcgcaacggctttccgcggaagctgtccgagctgagcctcgaatgcatggtcgagcagcggccggatcccgagagccgggtcatgctctccgatcggcgggatcacctgggcagccggctgcccctgatcgactggcgcagtcacgaagatgaaggccgcacgatgcgcgagacggcgcggctcgtcgtctccgagttcgcccgcctgggcctgcccgtgcccgagctggcagactgggtgcgcgaagaggcgccgatcccgctcagcttcgtcgatgtcgcccacccgaccggcaccacccgcatggccgacgatgccaccaggggcgtcgtcgatgcgcgaggccaggttcacgggatcgacggcctgttcgtcacgggaagttcggtgttcccgacgggaggccactgcaatcccacgcagatgatcgtcgccctggcgatccgcctcgccgacctgctgaaggtccgggagcagcgcgacaccgtggtctccgacctccgaacgtctccgcccgtccccgccgatctccgcgtcctcgtgacgggggcgacggggcggatcggccgcatcctggtggaggacctgcaggaacgcggctacgcggtcagggccgtcacgtcccagcccctgaccgaggcgcagccgcgcacgggtcggatcgagtggcggaccttcgacttcacggcggatcaggattacgccggcctcgtccacggctgcgcggccgtcatgcatctcgccgccgagctcgggaagcaggaccggatgcaggccatcaatgtcgaggcgacgcggcgcctggccgaagccgccgagcgggacggcgtccgggccttctgctacatgagcaccgtctccgtctatggcagcggccgcgcgcgcaccatgacggagacggccccggttctcaccagcagcgtcgacgtcaaatccgagtactgggccctcgactacgttcgcgcctacggtcgaacgaagctcgccggcgaagaggccatcaggcgggtcgcctcgacccttccctacgtgatcctgcgccccacggtggtcgtcgacctccataatctcatcggcttgcgcgactggagcctctcgaagcgcctcttcgcggcgcaccggccctcccatcacgtctacgtccgggacgtcacggacgcggcgatctggacgatgacgcggtccctgtccggggcttggccggcgggcgaggtccaggtcttcaatctctccgatcacgaggcgcgcgatgcgcggatcggcgacttcatgcggcgggcgttcgcgatcagccgcgatccccgcttccgggtcatcccgatgccggccgtcgtcgactggctccacgatttcctgcgcaaccggacgctgcccttgcgcaatcctctctggaggatgcggttccccaacgatcgtctgcggcaggccgggtatcgacaccgctacggaatggccagagcccgcgccatggcgctggacatcctgcgagcggaaacacgggagcgaacacgggcctga

SEQ ID NO: 6401 - DNA, 975 bp, Methylobacterium sp.
atgccgggcacgaaccgtcgcgatctggtgcgggccgcgctcgccggaggggccgtcctgggtctcggcggccgcgcccgcgccaccgcacccttcggcggagcgcaggcgccgggcttctaccggacgcgtgtcggcagctgcgaggtcacgatcctcaacgacggggcgcgcagcttcccgatgccggaccgcttcgtgcgcaacgttccccgggacgaggcgctcggcgccgcgcgggcggcctacatgccccccggccaggtgacggtgccgttcaacccgacgctgatcaacacgggcgcgaagctcgtcttgatcgataccggcaacggcccggtcccgggcgcgcccgtcggccgcctcgcggcgaacctcgcggcggccgggatcaggcccgaggacatcgacctcgtcctgctctcgcacctccatcccgaccacacgaacggcctcaagcgggcggacggctccctagccttcccgaacgccgagatccgggccgccgcgcccgactgggcgttctggatgagcgacgccaacatggcccgcgccgccgacccggtgacgcagggctacttcgccaacacccgccgggtgctcggcgacctgaaggaccggatcggcaccttcgcgtgggacgaggagatcgtgcccgggatcaccgccctcgccgcccccggacacacgccgggccacacggccttcgcggtcgcctcgggcgcggaccgtctgctggttcagtccgacgtgaccaacatcccggccttcttcctgcagcacccggactggcacgtgatgtacgatcacgacgccgatcaggcgcaggcgacgcgccaccgcttctacgacatggccgcgtccgagagggccctcgtggtcggttaccacttccccttcccttcgctcggccacgtggaacgggacggaccgggctaccggctcgtgcccatcgcctggaccggcgcgctctga

SEQ ID NO: 6402 - DNA, 288 bp, Methylobacterium sp.
atgaacatcacgatggtcgggtcgggctatgtcggtctggtctctggcgcgtgctttgcggatttcggccacacggtcgtgtgcgtcgacagcaatcgcggccggatcgacgcgctgaatgccggccggatgccgatctacgagccgggcctcgaggccctggtcgccgagaacgtccgccaggaccgcctgtccttcatcaccgacctggaagcggcggtcggtcaggccgacgcggtcttcatcgcggtgggcacgccctcccgccgcggcgacggcttcgccgac

SEQ ID NO: 6403 - DNA, 1377 bp, Methylobacterium sp.
atggccgatgcgtccaagacgcgcgttgctatcgagcaagcgtctgagaacgaacgagccaggatctatcggaagatcagcctccggctgatcccgatgattttcctatgctatgtcctgaactacatcgaccgtgtaaacgtcagcttcgccaagttgacgttccagagtgacatcggcctgtcggacgcgagttacggcttcggcgtcggcatcttctacgtcgggtacatcctcttcgaggtgccgagcaatcttctccttggccgcattggcgcgcggaagacgctgacacgtatcatgtgtctgtggggcctcgtgtcctgctcgatggcgtttgtgacgagcccggcgaccttctacctggccaggatcctactcggtgcggccgaagctggcttcttcccgggcatcgtcctctacctcaccttctggttcccccatcgcctgcgcgggcgggtgatgtcgctgttcgtcctcgccattgcggtgtcgggcatcgtaggcggaccagcctccggttggatcatccagcacctcgctggcgcggccggcttcaagggctggcaatggctgtttctcgtagagggggcgctgccggtactcgtcggagtcggcgcgttctttgtgctgagtgaccgaccagcggatgccgcctggctgacgccacgggagaaggcgatcgtggcggccgatctctcatccgggaccttcgaacagggacacgcgcccgcgagggccttcctgtcggccctgcgaaatccgaagctgtggatcgcgaccttcggatatttctccatcacctgggcggggaccgttctgaacttctgggcgccgacgattatccagcgatcgggcgtagccgacgtgttcagcgtcgggcttttgtcggcgatcccctattccgtgggtgccgtcggcatgctcctgctgtgccgtagttcggaccggcggctcgagcggcggtggcatttcgccctatccgccttcctggccgcgacggccgccctcgccatctccctcgtcgcgcagaacgttgcggcggccatcgcctgcctggccctgctcgccatcggctatctgtcggcgaccgccctgttctggaccataccggtgcgcttcctgaccgaagccgaagccgtgggaagtctcgccttcatcagcagcatggggcaggtcggaagcctggcggcgccaatcgcgttcggatttttcacgagcctgacgggcggtctcgccgtctcgacgggtctcgtcgctttcgtccttgccaccggcggaatggctattctctccctccgcaacccgcgtttggttgaaagacctctgtcatcaaagccaataaacacgggctgcgacttcggcacgcggtcgtga

SEQ ID NO: 6404 - DNA, 720 bp, Methylobacterium sp.
atgtcgtcgcgggagctcgccagtgtgtccacgaccgctacggcgaacgagcccgaattggagtcagatatggcagccaagcaggtcaccctcaccttcgacaacggccccacaccacatgtgacggatcagatcctggggatcctagaccgggccggaatcaagaccaccttcttcgtgatcgggcagaggctcgacgaccccgctgcagccgatctcatgcgggctgctcatacagcggggcattggatcggaaatcacacctttacgcattcggtggcactcggggaccggacggaccgggactatgcgctccgagagatcgaggagacgcagcaaaggatcggttcgctgacgcgaccggagaagctcttccgcccctacgggaacgacggactgatcggccggcatctgttgagtcgggcggcgctcgatcacctcctcgccgaacgctacacgacgatcacctggaacagcgtccccggtgactggaaggacgcggacggctgggtcgagaccgcgatggcccaggtgcgggagcaggactggagtgtcatggtcattcatgacatcgaggctggatgcctcgtccggttgcctgagctgcttcaacgtctgacagatcttggagcgaccttcgagcaggcgattccgaggtcggtgattttgaccgaagcgggacggactgtgtcgatgtctccggacttcatggccgattga

SEQ ID NO: 6405 - DNA, 903 bp, Methylobacterium sp.
atggaactccgtcacctgcgttacttcgtggctctggctgagcacctgagcttcacccgggccgcgcggcagacgcacatcacccaatcgaccctgtctcaccagatccggcaactggaggatcaggtcgggcaacgcctgttcgaccgcgtcggcaagcgcgtgttcctcactgaagccgggcagaacctgctgccccgtgtcctacgggccctcggcgaactggacgagggccttcgggcgctgtccccccaggatcaggtcctgaccggttggcttaggatcgccgcgacgcatacctttaacgtcaatctcgtccccgcctgcctgaccgagttcctcacccgcaatccttcgatgcgcgtcgtcgtggaggaactcgccgctagcgtgatcgaggagcggctcctggccggtgccctcgatctcggtatctcctacaggccggaccaccagcaggatctcgccttcgaacccctctatgacgagcctctggatctcgtgctttcgcctgaacaccggtgggcagcccggaaatgggtccgcatggcggaactccaccatcagccggtcgtgttgctctcaccggaattcaccacccgcaggctgctggatgactgcttccggcaatgcggcgccgtcccgcacctcgtcgcagagatgaacacgatcggtcccatcctcggcctcgttcggcgtatgaacatcgtcgcgatcctgtcgagacaggccgtcccagaggatgggacgcttttgtcggttcctctcgaaactcccacgcccatgcggagccctggcgtgctattgcgccggaacgaggtcctgcctccgcacgtcgcatccttcctgcacacgctccgacgagcctgcaataagacttctcattcgacgcgtcggttgtag

SEQ ID NO: 6406 - DNA, 1296 bp, Methylobacterium sp.
ttgcagtggcggctgctgccgttcctcttcgcatgctacgtggctgcctatctcgaccgggtgaatatcggctacgcgcagttgcacatgcgcgcggagctgggcttcaacgacgcggtttacggcctcgccgccggactatttttcgtcagttactttctgtgcgaagtcccgagcaacttcgtccttcagcgcgtcggcgcccggcgaacgctggcgcgcatcctaatcctgtgggggctcgcctcctcggcaacgatgttcatcaccgggccccattcgttctacgcgctgaggctgatcctgggagcgttcgaggcgggcctcgcccccggggtgatgtactatctgacgctctggtatccgaaccgccgccgggcggaaatgactgcaatttttctgagcggcagcatgctcgccggtgtgatcggtgcacctgtctcaggcttcatcctcgaaggcatgcagggcgtcctcggcctcaggggctggcagtggatgttccttctggagggcatgccggccgtgcttctcgggctcgtcgcgctccggatcctcgtcgacaagcctcaagatgctccctggctgacatcatccgagaagatgctccttttggcagagatcaaccgggacgcgaacttggctgccggcggccatgcattcggtgcggcgttccgcgacccacgaatctacgtccttgcgctggcgtacttcaccctcgtctgcgggctctatgcgatcaccttctggatgcccgtgatgatgcaggccgccggtgtccagggagccgccgcaattggcctatggtccgtaatcccctatgcgatcggcggcatcggcatggtgtggctgtcccgacgctctgaccgacggcaagagcggcggtggcactacgccgtctgtgtcggtgtcggtgcctgcgcgctgattggggcgtccctcgccggcgcgaaccttccagtcgtcctggcactgctctccgtcgcgaccgcgacgctcttcggcgcgatgccgatcttctacggcatcccgatggcctatctccccgagcgttcggccgcgggcggcttggcgctgatcaactgccttggcctcacgggtggcttcgtgagccccttcctgctgggctggatccggaacgcgacggggagcctgacgcccggcctgtggttcatgacgggcctgatgctgacgggcatcgtggtgctactcctggcgacacgccgcccgttcacgcgagtcacaccccaccccgccaactccgggctcagtttcgggtcggaggcaggccggtga

SEQ ID NO: 6407 - DNA, 657 bp, Methylobacterium sp.
gtgagcctcgatagcttggcccaccgctggtatgcgtcggaagggagccgatcgccgctcctcctgctgcacggcaccggaggtgacgaagacgagcttgtgccctttgcccaggcagcggcccccggcgcgccgatgctggccgtccgcggagccgtatcggaaggtggcaagctgcgccacttcgctcgccatccggacggtcgtttcgattcatccgaggtcgtccgccgagccgatgagctggcggccttcgtcgcggccgcccgcgaccgttacggtttcgggcccccgcttgccctcggcttctcgaacggagccaacatcgcggccgcactcatgcttctgcatcctgctcttctgacgggcgcgatcctgttgcgcgccgttccaccgctgactggtaccgcggccgctgcccttgtcgggcagcgcgccgtcgttgtctcgggcgagacggatacgatcgcgccgccggcactcggggccgatctggcactttgcctgaccgagctgggcgccgaagcgacccaccatgtcctaccctgcggccacgacctgacaccggccgatgtgcccctcgcccgcgactggctcagctctctcgccgaaggggcacccgctggaccggcttcctcccacttgattcgcccttga

SEQ ID NO: 6408 - DNA, 2973 bp, Methylobacterium sp.
ttgggcatcgtgtcaacgagctatgtcggacggtccgtagagcgcgttgaggacgccgccctgctctccgggctcggccgctacatcgacgatctcggcacgcggcccggcacgctgcacgcgtcgatcctgcgctcgccccacgcccatgcggacatcctcgccattgacgtccaggcggccaaggcgctgcccggcgtcaccgccgtgatcacgggccgcgaccttgatgccgtcaccaccggtctcgtccccgccctgcgggcggccgtcgatgcccgcgccatcgcggtggaccgggtgcgctatgtcggcgagccggtggctatcgtcgtcgcccgcgaccgctacctcgcggaggacggctgcgacctgatcgaggttcagtaccgggtccgcccggcggtggtcgacccgctggcggccctcgcccccgacagcgagatcctgcacgagggtgtcggcgcgaatctcgtgagcgaccggcgtttccgctacggtgaccccgaggtcgccttcgcagatagcccgcacagcctgtccgtgaccgtgcgctacccgcgcaacaccggctcgccgatggagacctacggcgtcgtcgcttcctacgaccccaccgacgactcctacgacgtgctcgcgaacttccaggggccgttcagcattcacgcggtcgttgcccgggcgctcaaggtgccgggcaaccgcctgcgcctgcgcacgcccccggattccggcggcagctttggggtgaaacagggcgtcgccccctacgcggtcctgatcgccgccacggcccgcctcgtgggacggccggtgaagtggatcgaggaccggctggagcacctctcggcctccgtctccgccacgaaccgggtcacgaccctccgggccgccttcgaggcggacgggcgcgtcaccgctctcgattgggatcaggtcgaggattgcggcgcctacctgcgggcgcccgaacccgccacgctctaccggatgcacggcaacctcaccggcgcctacgccatccgcaacgtcgccgtacgcaaccgggtggtgctcaccaacaagaccccgaccggcctcgtgcgcggctttggcgggccgcaggtttactatccgctcgaacggctgatgcagcgcatcgccgtgacgctgggcctcgatcccttcgcggtgatccgggcaaacctaatcccggccgacgcctttccctaccgcaccgcgacaggcgctctctacgattccggcaattaccagcgcgccctcgacgaagccgcccgggatggcgggctcgtcgagttgaagcggcgacgggacgccgcccgcgccgagggccgcctctatgggatcggcctgacggcggcggtcgagcccagcgtctccaacatgggctacatcaccaccgtcctgacggcggaggagcgcaccaaggccgggccgaagaacggcgcgcaatcgaccgccaccatcaccctcgatccggtcggctcggtgacggtgcaggtcgcttcggtgccgcagggccaagggcaccggacagtgctggcccaggtggtggccgacgtcctcggcctcccgatggagcaggtccgggtcacggccgacctcgacaccgccaaggacgcatggtccattgcctccggcaactatgcgagccgcttcgccgccgccgtggcgggggtcgcgcacctcgccgccacccgcctgcgcgacaggctcgcgcggatcgcggcggcgcagctgaacctacgtcccgaggacctgctcttcgcggatgggcgcatcgcctcgcgattgaacccggatgcaggcctgcccttcgcgcgggtggccgccacgagccactggtcgccgggcctcgtgcccgaggatctcggcgcggtgatccgcgagacggtgttctggacgcccccggagctgaccgctccggacgcggaggaccatatcaattcctccctctgccacggcttcatcttcgacatctgcggcctggagatcgaccgggtcacggggaaaatcgccatcgaccgctacgtctcgatgcacgattgcgggcgcgtactgcacccgggcatggtcgagggccaggtgcgcggcggcttcgcgcaggcgctcggcgcggcagtctacgaggaactcgcctacggcgacgacggcgccttcctgtccggcaccttcgccgattacctcctgcccaccgcgaccgaggtgccggacctgcgcatcctgcacgtcgagagcccgtctcccttcacgccgctcggcgcgaagggggtcggtgagggaaactgcatgtcgacgccggtctgcctcgccaacgcggtggccgacgccctcgacctcgaggccatcgacctgcccctgacgcctgccaagctcgccgccctcgcggcagggggcgacgagccggcgccgccggccggtcgagccgcgaaggccgccgcgaaggcgggcgaccggaccctgcgcggcgacggcgcggccaccgtcactgccccgccggagacggtctgggcgatgctcctcgacccggacgtgctcgcctccgtcattcccggttcgcatggggtgcggaagctctccgacacaaggttccgggccgacgtcaccctcggcgtcggtccggtgaagggtcgctacaaggccgaggtgatcctctccgatctcgatgagccccgggcggtgacgctcaccggcacggtgacgggcggcctcggcagcggcggcggcaccggccgtttgaccctggagcccgacggctcggggggcacgcggatcgcctacgtctacgaggcggcggtgggcggcaaggtcgcggcggtgggcggacgcctcctcgacggggccgcgcgggtgatcatcggcgggttcttcacggccctcgcccggcgagccggcgggtccggcaagcgcgggctccgcctcccggtcgccctgcgatggctcctcgcgcgtctgggggtgtccgcatga

SEQ ID NO: 6409 - DNA, 210 bp, Methylobacterium sp.
atgacggtctcggacagcgcggtcccctacgtgctgggcgctgcggcggtgcgctcggtcgaggtcatcgacggcggcggcacactggcgatccgattgcggtcgcccgacgacagtgagttctgcgtcctgctgccgatcggtgtcgtgggcgacctcctctttcaactcgcggatgtgatgagcgtcagccttgacccacgcccatga

SEQ ID NO: 6410 - DNA, 972 bp, Methylobacterium sp.
atggccatccggcacgacgacctgatcgtgatcgacgggctgatcgtctccgacttcgggcccgaggtcttcgccgacatgcgacgtggcggcgtcacggcggccaactgcacctgctccgtctgggaggatttcgccacgaccatgcggacgatggcccgctggcggcgctggttccgcgagcacgccgacctgatcaccccggtccacgacgtcgccgatatccaccgcgcgaaggcggagcgccgcaccggcatcatccacggctggcagaacaccagcgcgatcgaggaccgcatcgagtacctggagctgttccacgcgctcggcctacggatcgtccagctgacctacaacacccagaacctcgtcggctcgggctgctacgagtcccgcgacagcgggttgtccgatttcggccgcgacgtgctggccgagatgaaccgcctcggcatcctgtgcgacctttcgcatgtcggaccgaagaccagcgaagacgcgatccgcgcctcgcagcgacgcgtcgcctactcccactgcctgcccgccgccctgaaggatcatccgcgcaacaagacggacgcgcagctgcgcttcatcgccgagcggggcggcttcgtgggcgtgaccatgttcccgccgttcctggcccggggcgcggccgcgacgatcgaggactatctcgacgccatcgcgtacgtgatcgacctggtcggcgaagagaacaccggcatcggcactgacttcacccagggctacggacaggccttcttcgactacatcacccacgacaagggtgacggtcgcaagctcacggatttcggtgaggtcctgaaccccgaaggcatccgcgtcatcggcgacttcccgaacctcaccgccgcgatggagcggcgcggctggccggccgcccgcatcgagcgcgtcatgggcggcaactggctcgccctgctcggcgacgtctgggcctga

SEQ ID NO: 6411 - DNA, 174 bp, Methylobacterium sp.
gtgctgccgcgggtgaccgaggactgtcgcgcgcggctgtgccgggtcgagttcgaccgcgtgcctggcgtgggacatctgtcgatggccgaggacgctgcgccggccgccctcgaccggatcggtgaccgctccgccggcgtgccggcaccgggcgactgcggtgagccttga

SEQ ID NO: 6412 - DNA, 114 bp, Methylobacterium sp.
atgaccgtcctgcgattcctgcgcaattggttcctggtgtcgatcccgctcggcctcctgatcggccggttcatcaaggccggcgaagggccgccgagacgagaccggcggtga

SEQ ID NO: 6413 - DNA, 930 bp, Methylobacterium sp.
atgctgacggcgctgctcgccgccgccccggcccgcgcgcaggcccccgcgcaggcccctgccccggcaccggcggggccggcgaccaagcccgagagcgatcccgctcaagagacgatccgcaagctcaacgcttatgtcgggctcctcaaccggaccctgcgggcgcaggactcgctcggccgctatcagagctgggtcaacatgaagaccggtccgaccggccgcgagcggatcatctacggcctctacgggctctacgacgtgcgcggcgagatcgcgaaggcggaggccgcgacggcgcagccgcccgcgatgccggacctcgacggcgccgtgaagacctacatcgccgcctatcaggcgctcgccccgacggtcaccgaggcggagggctactacgagcggcaggattaccgcgcggacaagatggagcagggcaaggcgctccacgccaagctcgccgtcgcggggccggccttcctggcggcgcgcgccaaggtcgatgccgcgctgcgggtcgagaaggagaagagcgacgcgctggaactcgccgccctcgaggcgcgggagggccgcaaggcgcgctggcacgtcgcgaacgtgatgaccgcctgccgcaaggtcatggacctgctgcccaccgacgccaagccggtcgtcgacatggcggccttcgacgccgcgctcgggcgctacgccgtcgccgtgaaggacatggacgggtacagcgccgccaacccgaactctttccacgtgttcgagagccggccgcgcgcgctcctgggcaagctgcgcgagttcgacgacaagctcgccaaggccaggggcgatgcccggcgcggcgccgggcgcgacgtgacctggatcgtcaacgactacaacatgatggtgtcgaccgcgcagacggccacgaccttctcgcgctga

SEQ ID NO: 6414 - DNA, 1602 bp, Methylobacterium sp.
atgttcggcaagatcctcatcgccaaccgcggggagatcgcctgccgggtgattgccaccgcccggcgcctcggcatcggcacggtcgcggtctattcggaggcggatgccggcgcccgccacacctggatggccgacgaggcgtggccgatcgggcccgccccggcgcgcgagagctacctcgtggccgagcggatcctcgacgtcgcccggcgcgccggggcggaggcgatccatccgggctacggcttcctgtcggagaacgcggacttcgccggcgcctgcgccggggccggcctcgtgttcgtcggcccgccctcggcggcgatccgcgccatgggctccaaggccgaggccaaggcgctgatggagcgcgccggggtcccgctggtgccgggctatcacggcgccgcgcaggatgtcccggcgctgaaggaggcggccgcccggatcggctacccggtcttgatcaaggcctcggccggcggcggcggcaagggcatgcgcgtcgtcgaggcggccgcggcgttcgaggccgcgctcgccggcgcgcagcgcgaggcgcgagcctccttcggcgacgaccgggtgctgatcgaggcgtacctgacccgcccccggcacatcgagatccaggtcttcgccgacagccacggcaacaccgtctcgctgttcgagcgcgactgctcgatccagcgccgccaccagaaggtgatcgaggaggcgcccgcctcggggatggatccggtccggcgcgcgcggatgggcgaggccgcggtcgcggcggcgcgggcggtcggctatgtcggcgccggcacggtggagttcatcgccgagggcgagaccttctacttcatggagatgaacacccggctccaggtcgagcatccggtgaccgagatggtcaccggcctcgacctggtggagtggcagctgcgcgtggccgcgggcgagcggctgccgctcggcgccccggatctggccctgcgcggccacgcgatcgaggcgcgggtctacgccgaggatccggcgcgcgatttcctgccggcggtcggcaccctcgcccacctgcgccagccggaggcggtgccggggcgggtgcgggtcgagaccggcatcgtgcagggcgaccggatcaccccggattacgacccgatgatcgccaagctggtcgtctggggcgaggaccgggcggccgcgatccggcagctcgcgaccgccctcgccgcctacgaggtggtcggcgtgacgaccaatctcagtctcctgcgcgccgtcgccggccatcccgcctaccgcgcggccgacctcgacaccggcttcatcgcccgccacgccgacgacctgctggcgccgcttgcgaccggtgcggtcgatcccgcgctctgggccgccgccgccctgaccgtcctgcgcgaccggcgcacggccgtcgccgcgcaggcgcaggcgagcggcgacccgtggtcgccctgggccgatccggatgcgtggcggatgaacggggcgggctaccaggacctgcagttccgccacggcgacgcgccgcccgtcaccctgcgggcatgcccccgccccgacggcagcgcccgcctcgacctg

SEQ ID NO: 6415 - DNA, 996 bp, Methylobacterium sp.
ttgttcgcacgcgtcggacagcccgcggcctgcccctggcggctggcgctgatcacgctgctgcagttctccgagaacccgtccgaccgccgtgcggccgatgctgtacgggctcgcatcgactggatttacctgctcgccctcgacctgaccgatcccggtttcgacgcctcggtcctgagtgaattccgctcccgcctcgtggccggcgaagccgaggccctgctgttcgacaccctgctcaccctctgccgcgagcgcggcctcttggccaagcgtggccgccagcgcacagacgcgacccacgtcctcggtgctttccgcagcctcaaccgcctcggctgcgccatcgagaccttgcgggccgcgctgaacgccctggctgtcgtcgcaccggactggctgcgcgcctatacggatccgagttggatcgagcgctacggccgttccatcggcgacttccatatctcgcagggcgagacggcgcgccgcgcctgcgcggagacgatcggtgacgacgggcaccggctgcttgcagccgtcgacaccaaggctgcaccgggctggctgcgcaacgtccccgccatggtggtccttcgccgcgtctggctgcagaatttccacgtcgccgaaccacccgctgaaggatcggagggagacgggcggatccgctggcggacggaggccgagggcattccgcccgccctggcgatggtcgcctcgccctacgatccggacgtgcactacgccaagaagcgcgcgaccacatggatcggtggcaccgtccatctgaccgagacctgcgacgacgcccagccaccgctgatcgtccacgtcgcgacgacaccggccccggcgtggaccgggcggtgctcgacccgctgcacgcggcgctggcgacgcaggatctgcttccggcgcgccatctcgtcgatgctgcctatatcgacgccgacggcctcgtggccgccgcgcgagatcacgacgtcgccctga

SEQ ID NO: 6416 - DNA, 1512 bp, Methylobacterium sp.
gtgagcgccgccgcgccggtcctgtcggaggccgcggccgccgaggaggagccggggctcgcctccggcgccgcggtgacgcgccgctcgttcgacgcggcgcgctgggtggcgctcgcctccgtcggcaacgtcgtcctgagcttcggggtattcctcgtgctcgcgcgcctcatcgggcccgccgagttcgggatggtggcgatcgccgccgtcttcatcgacatccttcagatcgtggcccgctgcggcctgcccgacgcggtggtccagcgcgccgacctcgacgaagacttcgccgccaccgccttctgggtgatgctcgttacgggcatcctgtgcgccgtgggcctcgtggccctggccggcccgatcgcctggatcttcgacctgccggcgctgcagccggtcctgtgcgcgctctccgcctgcttcgtgatcacggccgcgggcgcgatccacgaggcgcggctccagcggagcttcggcttccgcaagctcgccctgcgggcgctcggcgccaacgtgctcggcggggccgcggccctcgtgctggccctcgacggctacggcgtctggagcctggtggtccagcggctcgtcgccgcgatcgcgaccacgctcctgacctgggcggcggcccgctggatcccgcccctgcggctgcacctcgcttccgtgcgcgagcaggtcgccttcggctcgcgactgttatgcacctacctgctgctcgtcgcctcgatccggagccaggaggtgatcgcggcctacttcctgtccgcgaccgatgtcggctacctgcgcctcgcgtggcgctgcatcgacctcgtgagccaggtcgcggtgatcccgctcaccaccgtcgggctgaccacctacgcgcgcctccaggaccggccgggcgagctggccgcggccttccacggcttcaccgaggcctccgcgtttctggccgtgccagccttcttcggcatggcggccgtggccccgaccctcatcccgttcctgttcggcgaccagtggcatgacgcggcgccggtgctgcggacgctcgcgctcctcgccccggaattcgtcgccacctcgatgctgtggatgatcttcacggccctgggccgcaacggcacggccctgcggctcgccggcgcgcagttcggactcggcgccgtggcggcattcgtgaccgcgcccttcggcctcgccgccctggtcgccgggcacgtggtgcgggcctacctgttcacgcccgcgatcgtcgccagcgcggggcgcgtcgtcccggtcacgaacgagcggctcgtgcggctcctcgcgccgatcacgctctgcgccggcgcgatggccgggctggtgctgctcgtccaggggccgatccatgccgcgctcggggaccggttcggcctgttcgcggcggtcgggctcgggatcgcggcctatctgggcctcgcctggatcttcatgcgcggcacgctccgcacggccgtcggcctgttcctgagacgccccgcctga

SEQ ID NO: 6417 - DNA, 1137 bp, Methylobacterium sp.
atgccgcgcgtcctcgtcaacatgccgagccagcatgccggtcggccgtcgggcgtggcgctcgtcgccttccgggtgatcgccggtctggtcgcgcgcggcaccttcgcggtggtgctccgctctccctggcgtcgcgaccagctgccggcggcgatccgcgaccgcgtcgaggtcgtgacggtgccgcgaccgcggatcatgctgctcgacgtcctgcgccagtgcctcgccgtcccacggctgagccgcgcccgcgccatcgacgtggtgctgaacatcgatccctacggtgcggccttcggtggccgcgcccgcgtcagcgtcgtgcacgacctctatttccgcacgctgcccgagcgcatccggtcccgcgaggccctgaccaccgatccgatcttccgcctggtcctcggcaacagcgcccgggtgatcgcagtctcggaggcgacgcggcgcgatctggagtaccattacccgcggctccgcggccggacgcagaccgtgccgtccgcggccatgctggacccctcggcgggcgggtccgcagccggggtcccggcggggccgtacgtgctggcggtcggcaacgccctctacaacaagaatttcgcgaccctcgcgcacgccgtggtcgggctcggccggtcgggaatcgggatcgtccacgtcggcgaggattccgacgaggccatcgccaccgcgctcggcgacgcgccggtccccctgacccgcctgtcgggcatcggcgacgacaagctggcggccctctatcgcggcgcgctgtgcctgtgcgtcccgtccttcgccgagggattctgcctgcccgttctggaggcgcaggccctcgactgtccggtgatctgctcggaccgctccgcgacgcccgagatcgccggacccggcgccctcaccttcgatcccgccgacgcggcggcgctgaccgagtgcctgcgccgcctgctggacgagcccgggctcagggacgcgctgatcgcccgcggccgcgacaatgtccggcgctacgactgggccgagaccgcgcgccgctacgagacactgctgctcgacgcgctgcgggacggcgcggcggcgcgcaccgcccgggaggtgccgcatgcgcatcctgcaccttag

SEQ ID NO: 6418 - DNA, 1227 bp, Methylobacterium sp.
atgaccgaagtgctccacgccgacgcgctcgcggaacgcgcccctcgggaccgggcgcaggcctcgcggtccgacgtcgccgcgcggccgcgggtcctgttcgtgagccataccggcaccatgtcgggggccgagctcgtgctccgcgacgccgtccggccctgggcgggctccagcgccttcctgttcgaggacggcgcgctgaccgaggccctccgcaatgagggtctggagatccgcctcgcgcgccgccggtccgcgctggcgggcctcaagcgcgatgtctccccgttgagcgccctgccggtcctgggccagctcggcgccctggcgctggagatcgccagggcggcccgggcctgcgatgtggtctacgccaactcgcagaaggccttcctgctctcgtccctggcggcccgcgccgtcgggcgtcccctgatctggcacctgcacgacatcctcgacggcgcgcatttcggccgggcgcagcgcgttctgcaggtccggctcgccaatctctgcgctgcccgggtgatcgtgccctccgaggccgccgcgcgggccttcgtccaggccggcggccgccggtccctcatccgtatcgtgccaaacggcctcgacgtcgatccggcgccctgccccgccgcgacgctgcgggcggagttcggcttgccggacggccccctcgtcggcgtcttcagccgcctcgcgccgtggaagggccaggacgtcttgatcgaggcgctcgcgaccctgcccggcctcagctgcgtcgtggtcggggcgccgctcttcggcgaggatgcctatgcgacgcatctgcgcgatctcgcgacgcggctcgggctttcggaccgggtgctgttcctcggacagcgcgacgacgtcccccggctgatgcaggcggtcgacgcggtcgtgcacccctcggtcgatcccgaaccgttcggccgtaccctggttgaggcgatgctggtcggcgtgccggtgatcgccaccgacaccggcgcgtccgccgagatcctcgacggcggcgcggccgggacgctggtgtcaccgcgtcggccggaccgcctcgcggcggccctttcggcgctgttcgccgatcccgattccttccgggcgcgcaccgcgctcgcccaggagcgggcgccgtcccgctacggcgccgaccgcatgcagcgcgatctcgccgacatcatcctccaggtcgccggccgggcctga

SEQ ID NO: 6419 - DNA, 1170 bp, Methylobacterium sp.
atgcgtgtcgcgatcgttcacgactggttgtacatcgtcggtggcgccgagcgtgtcctcgaacagctgctgcggatctatccggacgcggacgtcttcgcgctcttcgacttcctgcccgaggcggaccgggcgcggctgggctacacccaggcgcatacgagcttcatccagcgcatgcccttcgcgcggacgcggcaccgcaactacctgccgctgatgccgctcgcgatcgagcagttcgacctgtcggcctacgacctcgtcatctcgagcagctacgcggtggcgaagggcgtcctcaccgggcccgaccagctccacgtctcctacatccactcgcccatgcgctacgcctgggacatgcagcacacctacctgcgggagagcggctgcgacgcgggcatgaagagcgtgctcgcccgtctgatcctgcaccggatgcgagtctgggatttccgcactgcggccggtcccaacgcgatcgtggccaactccgccttcgtcgcccgccgcatccacaaggtctacggccgcactgccgaggtcatccacccgccgatcacgctgccgagccagcggtatgacgggccgcgcggcaaccacttcctcgtggccagccggctggtgccgtacaagaacgtcgaggcggtgatccgcgcgttcgcgctgctccccgacctcgaactcgtggtggcgggcaccgggcccgatgccgcgcggctgcgcgagatcgcggggccgaacgtgtccttctccggcttcgtgcccgacgcggagctgcgccacctcatggccacggcccgcgccttcatcttcgcggccgaggaggatttcgggatcatcgtggtcgaggccacgtcggagggcacgccggtcctcgcgctgggtcgcggcggcgcccgcgagacggtccagacccgcggcccgcagcgcaccgggatgttcttcgacacgcccgagcccgtggcgatcgccgagtgcgtccagcgcttcctgctgcaggagggccacttcacccgcgaggcctgctgggcgcaggccgagctgttctcggccgagctgttccgcagccggttctcgaccttcgtcgacgaccagatggcgatgcaccgggccgcctgcgagacgcgcccgcggatcctgccgcgcctcgaagccgtcggctga

SEQ ID NO: 6420 - DNA, 1593 bp, Methylobacterium sp.
atgaagcgacgcacgctgttgcagggagccggcgccctcgtcgccggcgccgtcgcggcgccggccctcgtccgcgcggaggcggcccggaccctgcgcttcatcccgcagcaggatctcgtcaccctcgatccggtgacgaccttcgcgtacatcacccgcaaccacggctacatggtcttcgacacgctctacggcatggacgcggcctatcgcgccacgccgcagatggtcgagggccatcgggtcgaggcggacgggcgccgctgggacttgatcctgcgggcgggcctgcgcttccacgacgggacgccggtgctggcccgcgactgcgtcgcgtcgctgcggcgctgggcgaagcgcgacccgttcggcggctccctcatggaggcgaccgacgaactctccgcgcccgacgaccggacgatccggttccgcctgaaacacccgttcccgctgctgccaatcgcgctgggcaaggcgtccgtcccggtctgcgccatgatgccggagcgcctcgccgccatcgacccgttccagcaggtgccggagctcatcggctcgggaccgttccgcttcaagcccgacgagcgggtgcccggcgaccgcgtcgtctacacccgcttcgaggactacgtgccgcgcccggacggcccgctgacctggacctcgggtccgaaggtcgtccatttcgaccgggtcgagtggcgcgtcatcggcgacacctccacggcgacctccgcgctgatcgccggcgaggcggactggcaggaatacgcctcgcacgaccagatcgcgctcctgcaggcggccaagggcgtgagcacccgcgtcctcgacccgaccggcttcgtgaccatgctgcgggtcaaccacctgcagccgcccttcaacaacccggcgatccggcgggctctctggggcgggatcgaccagaccgcgtgcatgcagggggtcgtcggcgccgaggatcccggcctgttccacgtgcccctcggcttcttctgcccgggcacgccgatggcctcgacggacgggttgcagccgctcacggatccgcgcgatccggcgcgggtgcgcgccgatctcaaggcggccggctacggcggcgagaccgtgctgctgatggtgccgtcgaactcggcgccgctgctggcgctcggccaggtcgcggccgacctgctgcagcgggtcggcatgacggtggaggtctacgcggtcgagttcaacgcgatgctgcagcggcgcaaccgaaaggggccggtctcggagggcggctggagcgccttcgtcaccaactggtccggcatggattggctgaaccccgcgggctacatcgccctgcgcggcaccggcgagagcggctacgccggctgggccacgaccccgcggatcgagtccctgcgcgacgcgtggctcaccgccccggacgaggcggcgcgcgccgccctgtgccgggacatccagctccaggcgatgcaggacgtgccctactacccgctgggccagtacctgcagccgaccgcctaccgctcccgcctcaccgggatcctcgacgggttcccgacgttctggaacgtccggcccgcctga

SEQ ID NO: 6421 - DNA, 2280 bp, Methylobacterium sp.
gtgccccccgcccgccccggggcgggcgcggcgcgctggatcccgcccgcgatcctggccgccggcctcctcgcgaccgggctgagcacggccctcagctggcaggcggcggcgctgcgcgaccgcctgaccttcgagcacgccaccgagatcgagctgcgcacggtcgaggaccagttccgcacctacacggcgctcttgcgcggcgctgccggcctgttcgcagccgacggcgacaccgtcacgctggcccagttccgggcctacgtgcagcggatcgagttccagcgcctctaccccggcttcctcggcatcggcttcacgccgaccctgcccgcctccgcgcgcgagacgttcgccgcgcgcgccgcagccctgggcgtcgagaatgcccgggtccggccgccgaccgataacccgatgatcagcccggtcctgttcgccgagccgccgaacccgcgcaacctcgccgccatcggcttcgacgtgatgtcggacccggtgcggcgcgacatggtcgagcgggcccgcgacaccggccagccggcagcctcggcgcggatccagctcgtgcaggagatcgacgcgaacaagcaggcgggcttcctcgtcgccatgccggtctatgccggcggcgccgtgccgccggacctcgaggaccggcggcggcgcttcctgggcttcgtgttcggcgccttccgggccgacgacctgttcaacagcatcgtggcggcggaggccgaggaggacgcggccttcgccatctacgacggcgcgccgagcgaggcgaacctgctgcaccggtccgcgcgggcctccgctgcgggagcggggcgcctcacccgcgaggcgcatctcgagctcggcggccgcacctggaccgtggcgttcgcgcagcgcgtctcgccccggcgcggctcggcgctgccggagatctggctcgtctgcggcggcggcctgttcgccaccgctctgctggccttcgcggcctaccggcagcgccgcacgcaggacgagatccgccagctcaacgcgtcgctggaggcccgcgtcgaggagcggacgcgcgatctccgggcggcggccgaccgtctgcggcaggccggggaggagcgggcgcgcatggaggaggcgctgcgccagtcgcagaagatggaggcggtgggccagctcaccggcgggctggcgcacgacttcaacaaccttctggcgggcatctcgggctcgctggagctcatcgaggcccgcatcgcccaggggcggtcgaaggatgtcggcaagtacatcgcggccgcccagggcgccgcccggcgggccgcggccctgacccaccgcctgctcgcgttctcgcgccgccagacgctggcgcccagggcgatcgacgccgaccggctggtccgcgggatgctggacctgatccagcgcacggtcgggccgagcgtcgaggtgcggcacgtcggggcggacgggctctgggtcgccctcgcggacccgtcccagctggagaacgcgctcctgaacctctgcatcaacgcgcgggacgcgatgcccgggggcggccggatcaccatcgagaccgacaaccgctggatcgaccggcagcaggccgacgcccaggacatgccggaagggccgtacctgtcgctgtgcgtgtccgataccggcaccggcatggccccggaggtcgtcgcccgggccttcgacccgttcttcaccaccaagccgatgggcgaaggcaccggcctcggcctgtcgatgatatacggcttcgccaagcagtcgggcggtcaggtccggatcacctcaacggtcggccagggcacgaatgtgtgcatctacctgccgcggcacttcggcgaggcggacgcggacgggcccgacccaggcaggggcctgatggcgcaggccgaggcgggcgagaccgtgctgatcgtggacgacgagccgacggtgcgcatgctggtgacggacgtgctgagcgacctcggctacacggcgatcgaggccgcggacggcgcgggcgggctcagcgtgctgcaatcgggtgcgcggatcgacctgctcgtcacggatgtcggcctgcccggcggcatgaacgggcgccagatggcggacgccgcccgggtcgcacgaccggacctgaaggtgctgttcatcaccggcttcgccgagaccgcgctgccgggcgacgggcgtctcgagcccggcatggcggtgctgaccaagcccttcgccgtggaggccctggccgcccgcatccgcgagctgatcgcgcgctga

SEQ ID NO: 6422 - DNA, 1092 bp, Methylobacterium sp.
gtggcggaggcggcgggtggccgggatgcgcgggcgaacaatttcgggtctctgcgactcctgttcgcgggcctcgtgatcctcgcgcacgcccccgagctcgtggacgggaatcggtcacgggagttgctgacgcaggtcttcggaaccctgtccctgggggagatcgccgtcgacggcttcttcctcgtgagcggctacctgatcaccgcgagctaccgcgccaagcgctccttcggcgactatctcgcgcggcgggcgctgcggatctacccggccttcgtggtcgcgtccctgctctgcatcgccgtcgtcgcgcccctcggcggcggcaacctcgcggccgcctcgccgctcgagacgctgctgcggctgtcgctgctgctgatgccggtggtcccgggcgccttcgccgagctgccctacccgctgctgaacggctcgatgtggaccatcccgtgcgagttcggctgctacctcctgctcggcctcttcggcaccgcccgcgccctgcgccgccgcgggcgctatctcggcctgctcgggggactcggcagcctcctcgccctgcgctggctcttcctgccggtcgggcatccgggcgacaccctcggatccctgtcggagatgatccgcctcaccttcgtgttctgctgcggcggcgccttccggctgttcgccgaccggatcgcctacacgcggcgcggcgcgacccgcgccgccctgctgctcctgccgctgatgttcagccggccgctggccgagccggccttcgcgatcctcggcggctacctgatcttctggttcgccttcgcggtgcgccccaccgccctcagccgcgccaccgcccaggtcgacccgtcctacgggctctacctctacgcgtggccggtgcagaacctgctggtcgcgcggatccccggcatctcgccctggacggtcgccgccctcgccctcgcggccgccatcccgctcggccttctgagctggtacctgatcgagcggccgatgctccggttccgaccgggaccgggcggtgcgcggccggagcccggcgcgatcccggcggccgggtccgccctcggggcctag

SEQ ID NO: 6423 - DNA, 633 bp, Methylobacterium sp.
atgcgcgtcctggctctgaccacacagaagggcggctccggaaaaagcaccctcgccgcctcactcgcagtcgcggctatgcaggatggtgagaccgtcgcggccctcgacacggatcagcaggcgtcgctcgcaggatgggggcagcggcgcgaggccaacggcctggacatacagcgggtcgagccttcggccttcgccggcacgctcggcaagatccgggaggccggcgcggtctccctcgtgatcgtcgacacgcctggccggttcggacctgacgtcgccctggttctacgggaggccagcctatgcctcctgccggtgaagccatcgatcctggacgtcgaagcggcgcggccgacggtcgagcaactgcggctcctgggacggccgttcgccttcgtgctcaatcagtgcaatccgacgacccaggcccgaacgctcgatgcggcgacagctctcgtgagcaccggggcgctggcaccctcgatggtggcgacgcgctcggacttcctcgactccatgacgacagggcagggcgtcacggaactggctcccaagggcaaggcggccgtcgaggttcgcctgctttggcaatggattaaggcgcagctcggaggcgcgaaggcatga

SEQ ID NO: 6424 - DNA, 300 bp, Methylobacterium sp.
atgtcgaacgtcatcaccctgccgagccgcgcgaaggccgccgcgttggcgacgcactacgagacggtcgccacatacggggagacgggccccgtctccatcgcgcttctccggcgcctcgacgcgtcggctggcctgatccacgtggccctgctcggcgtgctgcaaggcgtcgagatcattgccagtctgcccgacaacgatcagggccgggccatcgctgatttcgtagggccggctgccctgcgcgccgtggagctgtcggaagtcgagttcgccgtcacctcggaggcctgctga

SEQ ID NO: 6425 - DNA, 330 bp, Methylobacterium sp.
atgaccgtggaaatgcgaatgctcatggcgcaggccctgccgccgctcacgctgcccactgaccgggcgcgacggtcccgtctgagtgatccccttccgcggctccgacgcctcgtctgcgtcgtcgccgcgctcacgctgcccgtcctcggggtcgccgtcgcggaaacggtccaccgcgccggttcaccgagggcgccgcaggccgccgcccccgccaccccctcaggcggggcggcggcaccctcgggcgccgtcgggccccgacgcgccgcgagaaccctgagggtcgcggcacgcacggaagagaaccacgaggtccgctcttga

SEQ ID NO: 6426 - DNA, 1725 bp, Methylobacterium sp.
atgcatcccgacgagacggtgttgttctctgtggtgcccaagatgagactgcgaagaagtatcgtatcgaagctgattctgccctcgatcatcggctttctgctgtttctggcaaactcgaccgtcggcttgatgcagatacaggccatcaacgccgccgccgtggagacgcgcgacgtctgggtgcgcaaggacaacgatctccatacgattcgattcctgatgctgcggtaccacacgacgacgatccgcaaggtggtcgccgtcgacgacggcgagaaccgggacctcgatgccgagttcgtcgagatggatcggaccatccccgaagccttccagagctaccgcgcgcgcgcgacgacgccccgggagcgcgcgctctgggacgcgttcgaggggcggtggaaggtctatcgcaccgcccgggaggcgatcctcgcgccgctcaggcgcggcgaccggaacgcggcccgcgacgccatcgcgccggcccgcacgccgctggtggccgccttcgatgccctggcggaactggcccaggtcaccgccgagggcacgaacgtctcggtccagcgctccgaggacgcgttccggacggcgtggtccgtcaccgtcgcgctcgcggtgatcgggttgctcatgaccggcgcggcggtctggtgggtctggcaccgggtcgcccgcccgatccggtccatggccggaacgatgggccggctcgcggccgacgacctcgacgcggccgtcggcggttccgagcgcggggacgagatcggcgtcatggcggcgtccgtccaggtcttcaaggacggcctgatccgggcgcgcacgctcgagcacgaagccgcccaggcccgcgccacggccgaggcggagcggcggagcggcatgcaccggatcgccgacgccttcgagggcacggtcggcggcatcatcggcacggtctcggccgccgtcgccgcgctgcaggacacggcctcggccatgaacggggcggccgccgacaccgccgatcgctccggccgggtggcgagcgcggccgaacgcgccgccagcaccgtcaacgtcgcggcggcggcggccgaggaactcggcgcctccgtccaggagatcggccgccaggtcgcgggttcgacggaactgacgcagtcggcggtcgcggacgcggaggcgaccgcgcatctggtccaggagctgaacggggcggcgatccagatcggccatgtcgtgaccctgatctccaccatcgccgagcagacgaacctcctggcactgaacgccacgatcgaggcggcacgggccggcgcggcgggccgcggcttcgccgtagtggccgcggaggtgaaggagctggccggtcagaccgcgcgggcaaccgacgagatcggcggccacgtcgcccggatccagtcttccaccggcgacgccgtcacggcgatcggacgcatcggcggtcgggtccaggaactcagcgcggtggcgacgcggatcgccagcgccgtggagcagcagggcgcggcgacacaggagatcgtccgcaacgtctcccaggccgcccagggggcagcggacgtcaccggcaccatcacgggcgtcgccgacgcggcgaaggggaccggagcggcggccgatcaggttctcacggcagcctcggagctgtcgaaccggtccggccacctcagggacgaggtgacgcgtttcctcgcgaccgtccgcgcggcctga

SEQ ID NO: 6427 - DNA, 1563 bp, Methylobacterium sp.
gtggattactatttcgcgaggctcaagattttctcgcgcgtccgcgaaaaattcgtcgacgcggcgctcatgaaccgcaacctcatcatcggcgagccgaaaggcgacatccccctcttccgcaagcgctacgacgcctccgtcaaggccgtggccgacggcatcgagacgctggaacagggctcgcggcgcgcggagatcgcggcgctgcagcgccagatcggcgcggtcgcccgggactatttcgatctgctcgaccgctccaactacctcgcgctccggaatgaccggccggcggtgatccaggtcggcgttgttgccagccgcgaggtccgggcgcagttcgaccgggctgcccaggcgtacgaggcggaggcggcggcccggctcggcgaggcgaagatcgccacgcagcagggggccgagcaggcccggacggtcctgatcggtgccacggtggcgggcctgctcgtcgccctcggactctccgcggccatcgtcgtggtcggtgtcacgcggccgctccaccgcctcgtcgccgcgctgcggcgcgtggcgcagggcgacggcgcggccacgatcgcggaggcgcggcgcggcgacgagatcggagcggtcggccgggcggtcgaggcgatccggagcttgatcatccgcaacgccgaggcggaggccgagggccggcggcgcgccgaggccgccgcggccgcagcccgcaaggaggccacgatgggcctcgcccggaccttcgaggcggcggtggccaggatcgtggaccgggtctcgaccgccgcgggcgaactcgagggcaccgcccaccagatgaccgcgaccgcccaggagacggccagccagtcgggcgcggtggcgctggcggccgaggcggcggcggtcaacatcggcgcggtggcgtccgcgaccgagcggctcggcagcgccatccgggcgatcggccgtcaggcgggcggctcgtccgaactcgcccagcaggcggtcggcgaggccgaccagaccgccgggctcgtggccgagctgcggcaggcggcctccgagatcggcgacgtggtgcggctgatcgcgtccatcgccgaacagaccaacctgctggccctcaacgccaccatcgaggcggcgcgggccggcgaggccggccgcggcttcgcggtcgtggcgggcgaggtgaaggccctggccgagaagaccgcgcgggcgaccgacgggatcgccgcgcagatcggccggatccagggcgtgaccggatccgcggtcggcgccatcggcgcgatcatcgaccggatccgcgagatcaacggggtggcgatcgcgatcgccgcggccgtggaggagcagggcgccgcgacccaggagatcgtgcgcaccatcgcccaggcgacgcggggcgccgcggaggtgaccggcaccatcgccggggtggccgaggcctccgagcggacgggggtcgcggccgaccacgtgctcacggccgccaccgccctgtcccgtcagtccgaggggctctcggcggaggtcgggcggttcctggccaacgtgcgcgcagcctga

SEQ ID NO: 6428 - DNA, 1494 bp, Methylobacterium sp.
atgccgcagactccgagacacacagagacgctcgaggcgcagctgttcgatctcgcgcccgtgtccctctggttgcaggatctcggcgcgctgaaggcccggctcgacgcgtggcgggaggccggcatggtcgacctccgcgcctggctgcgcgatcccgggcacctgcggacctgccagagcctgatccggatcgtccgggtcaaccgcagcacgctcgcgacctacgacgcgcgggacgaggccgaattgttcgcccacatccccgcgatcttcaacgatccgcgcgcggacgccctgatcgaggtgctgtgccagctctgggccggggcgacccaggtccgcctcgtcacgcagaaccgcaccgtcgcggggcgcgtcatcgacgtgagctacgcgggacagatgctgccggggcacgaggccgactgggcgcgctacctgatctcgatcgaggacatcacgcagcgcgaggcgctgcggcgggagagcgactcggaccggcgcaccgaagccctgttccagcacgcgccggtcccgaccctgatccgcgacgagtcggagctcgccgcccggctggcggcgctgcgggccgacgggatcacggacctcgccggccatctggcggcccatcccggctggctcgccgaggccgaggcctcccgccggatcgtcgacgcgaaccgccccgccctggcgctgttcggcgtcgacacccgcgccgccctcgcgcggcacctgagcggcgggctgggcgaggcgccgctgcagctcttccgcgaggagctggccgagctctgggacggcgccgcgccgcggagccgggacatcgcggcccgcggccgcgacgggcggcacctgcacctcaagatgcagcgctccccggtcccggcgaccggcgacgggcggcgcctcgtccagatcgccctcacggatatcggcgacaacaagcgctccgaggcgcgcctcgagatcctgagcctcaccgatccgctgaccggcctgcgcaaccgcctgggctacgcggccgagctcgaccggctcgaggccgaccggaccgtgccgacctccgtgatcgtcgcggacctgaacgatctgaaggtgaccaacgacgaccggggccacgaggccggcgacgacgtgctccgccggttcggggccatcctggcgcgccacagccccgtcacggcccgcccggcccggatcggcggcgacgagttcgtgatcctgctgccgggtctcgacgccgcgggcgccgccgcgctggcccggcggatcctggacgggatcgacggcgagaaccggtccggcgcggccgtcatcagcgccgccctcggctcggccacgtggcgcggggacgggtccctgaaggccgccgtggcgtgcgcggattcccacatgtacgcggcgaagcggcgctaccgcgacggcgcgtgggacggggagccgcccgtgccgggcacgtccgtcttcagccaggcgtcgctgcgctga

SEQ ID NO: 6429 - DNA, 744 bp, Methylobacterium sp.
atgggaccgggaccgacatccgcatcgtccgccacctgcgcgatcggcgtgatggcgaaggcgccgcgcagcggccgctccaagacgcggctctgcccgccgctgaatcccgaccaggccgcgctcctgagcgccgccttcctgcgcgacacgaccgccaacatcctggaggcggcgcgcgctgcgccgatcgctgcctacgcggcctacgcgccgcgcggcgccgaggcgctggtagtcccacacctcgcctgcggaacgcggctcgtcccggccgacggcggcattccggccccggcggcggtcgagggcttcggcctctgcctgctgcaggccgtcggaggcatgctcgcggagggtcatgcggcggcctgcgtgctcagcgccgacatcccgacgctgccgacgcgccgcctcgtccaggccgcccggatcctgctcgcgccgggagaccgggccgtgctcggcgcgtgcgacgacggcggctactacatcctcggcctcaagcaggcccatgcccgcctgttcgccgacatcgcctggagcaccgacaccgtcgcggccgccacccgcgcccaggcgcgcgagatcggcctcgcccttgtcgaactggagccctggtacgacgtcgacgacgcggcctcgctcgcccggctctccgccgacaaaaccggctacgccgccccggcgacgcgcgcggtcctggcgcggctcgcggagacgtcggaggccgtgccggcatga

SEQ ID NO: 6430 - DNA, 699 bp, Methylobacterium sp.
atgcatccggtcagcatcgtcatcccgaccctgaacgaggtcgaggcgatcggcgcggtgatccgcgagatcccgccggcctacgcggccgacgtcatcgtcgccgacagcggctcgaccgacgggacgcaggccatcgcccgggccgcgggcgcccgggtgatcgaggccgggtgcggctacggccgagcctgcgcgctcggggcggccgcggccgccccggcctcgcgcgtgatcgtctacctcgacggcgacggcgcggaccgcggcgacctgatcgaccggatcgccgggccggtgctcgccggcagccaggacctcgtcctcgcctcgcgcacccttgggagccgcgagcccgggtcgatgctctggcaccaggtgctcgccggccgcctcgccggcctcggcatcggcctgcgctacggcgtgcgctacaccgacatgtgcgccttccgcgccatcgaccgcgccgcgctgcgggccctcgacctgcgcgagctgacctacggctggaacatcgagatgcagatgcaggccgcgcgtgcgggcctgcgcatccgcgaggtgccgatgccctatcggcgtcggatgggcggatcctcgaaggtggccggttcgctcgctgggacgctgcgggccgctacgcggatcggcgcgacctacctgcgcgtcgccgccgggccggcgcggggcgcgtga

SEQ ID NO: 6431 - DNA, 588 bp, Methylobacterium sp.
gtggcatcgggacggcgcgcgctgaagatggaggaaacccgcgcgaggctgatccgcgcggcgcgtgcagcctttgccgagaagggctacgcagcggcgtcgatggatgagctgacggaagcggccggcctgacgcgcggcgcgctctatcacaacttcggcgacaagaagggcctgcttcaggccgtcatcgcgcagctcgacgccgagatggtcgctaaggcgcgggtcgcgcgcgagagggcgccaacgccctggctcggcttcctcgacgagggcgtcgcctacatcgagttggccctcgagccggagatccagcgcatcgtgctcctcgacggaccggcagtgctgggcgatccgtcgcgatggccgggccagaccgcctgcctgcgcacgacgaccgagacgatccaggccctcgtggaggccgggacggtcaagcctgtcgatgccgaggccgcggcgcgcctgatcaacggcgcggcgctcaacgccgcgctctgggtcgccgcgtccgacgatccaccggccgtcctcggcagggccaccgaggccttccggtgcttggcgaacggcctcctgaagtag

SEQ ID NO: 6432 - DNA, 1572 bp, Methylobacterium sp.
atgagcctgttcatcaccagcacggcgttctcgatccccgccctgttcggcgcgctcggcgccctcgccaccggcccggctgccgccttcctgggcaagcaggtcttcgtccgcgcgcagtccctggccgccaagggacgcatggacgacctcgtgatgatcggcctcagcgcgatggcggcagtcttcgggatcagtctgttcgccctgatgggctggtgcctcggccgcttcctcggccaggcgcacgattggtggggcaactgcctgctgccgcgccgggcgctcggcggcgcggacaccggcgcggatgccggctccgtctgcggcataaacccctacggcatgatcgtgatcctggacgtcgcggtggcggcaatcctggccggggccgtctggctgttcggccgcgtcaacgtcaaccgcttctccatgcacggcgtctaccgcaaccgcctgacccggggcttcctcggctcggcgcggacgcggcgcgacgccgatcccttcacggacttcgacgaggaggacagcccgcgcatcgccgatctcgggaccgagaagcggctgctgcccgtcgtcaacatgacgctcaatctgacggatctcctccacaccgagtgggcggagcggaaggccgcctccttcaccgcgacacccttcgcctgcggctcggcgatcctcgaccgcgccgacagggcgcgcgaccggcccggcaccgacggcccgcgcggggcctacatccgcacgtcgcaatatgccgggatggagaccccgggcgaccgtgtcagcgcgggccgggggccgctgctgggcggtctgctgacgatctccggggccgcggtcagcccgaactggggctatcactcgtcgcgcctgatcgcgttcctgatgaccctgttcaacgtccggctcggcgcctggctgcccaaccccgcggtggcccgccgggacgacctgaagctcgccaagccgaggaactccgtgctcgcgctcctgagcgagctcggcggccgcagcaccgatgtccggcaggcgatctacctctcggatggcggccatttcgacaatctcggcgtctacgagatgctgcggcggcgctgcgcgcggatcgtggtgatcgacgcgggccaggacgaacgctgcacgttcttcgacctcggcaacgtgatccggaaggccgaggtggacgggttggcgaaggtccagatgggcgagatgcgcattctcccccgcgcgacgatcgagcgcgagggcaagcgtgccggtgcgctgggctacgcgcggggtacgatcgcgtatccgggggcccgcgacgcggcatcgctgatctacatcaagccgagcttcctcgacgacatccccgccgaagtccgcgcctacggcgccaccagcccggccttcccgcacgagagcacggccaaccagtggttctcggagagccagttcgagagctatcgcgccctgggcttctaccaggtcagcaagatgttcggctcgcagctcacgaccttgtcggactggtccgtgtatctcgacagcgagatcgggcgccggaccgcggattcctag

SEQ ID NO: 6433 - DNA, 1215 bp, Methylobacterium sp.
atgagcgccagtgtcgcggacatccaggcggatgcctctccccaccatctgcccgccctgacgacgggccgggacgcgtggttcctcgacaccgagcaggcgctcgcggaggagatggatcatttctgcgggccgccggagcccggcgatcgcgcgccctggcaggcgcgggccgaccaggcccggctcgccgccctgtgcctctccggcggcgggatccgcagcgccaccttctgcctcggcgccctgcaggccctggccagccggcggatgctcggcgagttccactacctgtcgacggtatcggggggcggtttcgccggcggctggttgcagacgttcatccgtcagtgcggcggcatcgccgaggccgagcgccagctcggcggctcgggcaacgagatcttcgccaagctgcggcgctacacgaactacctgaccccggaggtcgggatcctgtcgcgcgacacctgggccggcatcgtcctctacatccggaacacgatcctcaactggttgatcatcttcccgctgctgctgttcgtccccctcgcgctgctcgcctaccggacggcgctcgaggctgcgagcggcagcacgctgtggctgcccctggtgctcggcagcgcggcgctgttcgtcgcgacgttcagcgcctgcaccctcctgccgagccatcggccgcggacgggcggcgtcacggcgtacgcgtccccggcgcggatcgcggcctgcatcatcgcgccgacctgcgtctgggccctcgcgctgccgttcacgctccgcgcgctgttcgagcagccgctgccgctctcgggcctctccctgtgccgcctgggcctcgcctacttcgccgtccaggtcgcggcctatctcagcggcctgatctggcagacctcgaagggccatccgggcctctggctgtacgagcggaatctcggtccctggctcgccagcagcctcgtctcggccgggctgatctgcgtctgcgccgacgcgtccatcggctggctggtcggtggctccgccgccggcttcgacgcggcgaaagccgaggtctctcaggtcctgacggtcgcggccccgccggcgctgatcgtcatccaccttctccaaagcgtcatcttcatcgggttccggaagagcgccgagtgcgccgacctcgaccgcgagtgggtcgcgcgggtcgacggccagctcctgctggccgcgatg

SEQ ID NO: 6434 - DNA, 711 bp, Methylobacterium sp.
ttgaaactcgtgcgcggcgaccgtggccggaacttcctgctgctcggcatcagcctcctcttcgtcgccgccggcctcgggataatcgccaccggcgcggatggcggcgtcacggcgacggtgttcttcggcgtgtgcgcggccgtcgccgtgtggcagctgcggccggacctgctcgaatcagagagccgttcggcggggtccctggcggcgcagttccccggccccgtgatcctgcgcgcgtcggtgcggaaactcctgttcctggcgctgatggccgccggcttcggcggcgtgacgctctggatggtgctgcacgaggcgccctccacggcgatgcaactgctgctctggccgggcgtcgtgctcttcctcggaggcgtccccttcctcatcctcacggcgatccgcggctcggcgctgcacctcgacgagacgggcttcaccgtcgtgcaggtgggccgcgcgcggcgcgtccggtggcgtgacgtgagcgtgttcgagccggtctccatgcccggttcgggacaacgcctcgtgacgttcgacgacgcgagcgccggcgcgacgcgcctcggggcgatgaaccggcgcctggtcgggcgcaacgcgggtctgccggacagctatgggctggatcccgacgcactcgccagcctgctcacggcctggcgcaagcgggccctgcagcgggaggacgatcgcttctga

SEQ ID NO: 6435 - DNA, 1716 bp, Methylobacterium sp.
atgtaccgcatctcgagttccggacttctcctgtgcctgctgtcgcagaccgcgatggcggcggacctcccgcggcgggcccttccgccggcggcgacggccgtgccgatcttctcctggaccggagcgcatgccggcctgttcgccggttacgggaccctcgatcgggccacgcagttcgtctgcacaggtccggacgggcagcccggagcccggaactgccctgtcattccatcgaagcgggcctcggacgggagcttcgtcggcggcgccgaggtcggctacgattggcaggtgagttccggcttcgtcgccggcgccgccgcggattaccaattcacccggctgtggggctacgatcgccgcgagggcgcctttccggccgcgggcggcggcttctatcgccgcagcgtcgcccattccggccagaggctggacgagctcgccaccctgcgcggcaggatcggcttcgccgtcgatcgcaccctcgtctacgccacgggcggcctcgccgctggcacagtccggaccgacaacaccctgtcgctggccggtttcccgctgttcgacgggcgccagggcacggtgcgcgtgggctacgtggccggcgccggcatcgagcacgccttcagcgagcacctctccgccaaggtcgaggggctctactacgatctcggctcccgggcggtcctcccggctccgtcgtaccccgtgctgaccggctaccacgccggcacgcgggtcgcgacggacggcttcctggcccgcgtcggcctcaactaccggttcggagccggactccccaccctggccccgatcgcgtcggcgggcccggccacctgggatttcgagggcggcctgcgctacttcttcagctccgggacaccgcgcgagaagctcggcgaccccgacgcgcccggccagctcaattcgcgcctgacctacaacaacacccaggcgcatgccggcgagagcttcgcacggctcgagcacaaccccaccggcctgttcgccaagggcttcctcggctcgggcggcgtcaccggcggccgcctcgccgacgaggacttcccgcccgccctgcgccgctattcgaagacgctgtcgccgatcaaggacggcgacatcggctacggcgtgatcgatctcggctacgacgtgctgcgccgggacgggtacaagctcggcggcttcctcggctaccagttcgcgtccgaactgtataacggctacggctgccgtcaggtggcgggtggggctccctgcgccagaccctacccgaccagcatgaagacgctgggcgagagcatgcagtggaacgcgctccgcgtcggcgtgatcggcgaagcgcggttcgaccggatccggctgagcctggaaggcgcctacctgccggtcgtgagcctgagcggcgtcgaccggcactggctgcggcccgacatcaatccgggcccggaaggcggccgcggcgacggctacttcctggaggggatcatctcgtacgacctgacgccgtccgtcagcgtcggcgtcggcggccgctactggcagctccaggccgacaaggcgcacacgacggccttcccgttctcgccgcccagcccgatgaagttcgagaccggtcgctacggcggcttcgcgcagctctcctaccggctggccgatttcggcttcggtgagacaggcgctccggcggccccgatccgcaaggactga

SEQ ID NO: 6436 - DNA, 792 bp, Methylobacterium sp.
atgatcgagatccgcaacctgagcgtccgctacgggcagggcaccgacgcggtcggcgcgctgtcggggatcgacctgaccatcggtcccggggagttcgtggtggcgctcggcgcctcgggctgcggcaagaccaccctgctctcggcgatcgcgggatttctggcgcccaccgagggccgcatcctcctcgacggcgagccggtccgggggccgggggccgagcggggcgtggtgttccagcgccacgccctgatgccctggctggacgtcgccgagaacgtggccttcgggccgaagatgcggggcgtgccccgggcggagcggcggcggatcgccctggcgacgctcgacctcgtcggcctgcccgactgcgccgaccggaaggtctacgagctctcgggcgggatgcagcagcgggtcggcctcgcccgggcactcgccggagacccgcgcgccctgctgatggacgagccgctcggcgcgctggacgccttcacccgcgagcagatccaggagctgatcctccggatctggcatcggaccggcaagatggccttcttcatcacccacgacgtcgaggaggcggtattcctcgccacccggctggtgatcatgagcccgcggcccggccgcatcgtcgagacgctggacctgcccttctcccgggcgttcgtcgagggccgcgacgcgcgggccgtgaagtcggaccccgccttcatcgccgtgcgcgagcgcgtgctcgcgcgcatccgcggcggcgccggcgcggcgcccgaggccgtccgatga

SEQ ID NO: 6437 - DNA, 375 bp, Methylobacterium sp.
atgcgcttccacttcgactcctacgtgctcacggccctcgtccccgtcacgatgccggatcacggctctccggggcgcctgatcatccacccgaacacccgcgcactgcgtcggagctacctccgcaacctcgtcgacaaggtgctggtcgacaatccgctcgcgcagaagctcctgacccgcgcctacgaccgcggcagcgaccgcgtgatccgcctgtcgctgaagccgggaagcctgtacttcttctggggctaccgctcgctgcacacgaacgagccctgcgcgtccgacgcgatccgggccacggccctgctgcactacgtcgatccgcacgcgggcagccggctcaagcgggtgctgcggcggcgctag

SEQ ID NO: 6438 - DNA, 678 bp, Methylobacterium sp.
atgccacgcgtcgcaggccaagccgtcatcgccgacgacgacccgttcttccggatcgcgctcgcgagcatcctcaccggccatcttgggttcgacggcgtccatcaggccggatcgctcgacgaggccctggagacgctggccgagaagccggacgtccgcttcgcgctgttcgacctcgcgatgcccgggatggagagcgccgccagcctctcggcggtgcgcgagtgttttcccgaggtcctgacggtcgtggtttctggctcgaccgaccgcgaggacgtcttcctcgccctgcgggccggggtgcacggcttcgttcccaaaggcacctcggtcgaggcgctgatccaggccttgggcatggtgttcaacggcttcgtctacgtgcccgcctttgtgacccgggtgcccggcgagggcgcgccgacggcgccggccgcttggcgggaggccgcccgcgacccgaccgcctccctcacgccgcgacagcgccaagtgctcgacctgatcgtcgccgggcaatccaacaaggagatcgcccgctcgctcgcccttggtgagggtacggtcaagatccacgtcgcggcactcctcaaagcgctcggcgtggccaaccggtccgccgccgcggcctgggccggggccaaccttggccgggtacgggcctcgccctag

SEQ ID NO: 6439 - DNA, 1068 bp, Methylobacterium sp.
atgcacgctatcacatcggacgccgtcgtcatcggcgtcgacacgcacaaggatgtccacgtcgccgtcgcgatcaacggactgggcgcacggcttgccaccgcatccttcccggtgacctgcgcggggtatcgcgaggtggccgcctgggcagccgcgcacggtgtcgtgcatgccttcggcatcgagggaaccggctcctacggtgccggcctcatgcgggccctgactgccatgggcttgcgcgtcatcgaagttggtcgggtcaaccggcagctccgtcgccgccagggcaagaccgataccgtcgatgccaagtcggcggcacgggctgttctggccggtgaggctatcgacgagcccaagctcggcgatggggccgtcgagatgatccgtcgccttaagatcgctcgcgaccccgcgctcaaggtgcgaacccaggcgatggtcacgctcaagacgctgctggtcaatgcaccacaagcgctacgcgagcggctcatcggcatcaccggcaagatgacgctcatccgcgcgatcgccgcgttgcggccgggagcgccggtctctaccaccgcatccgccaaggtggcgcttcgcgcactggccaatcggtggctggtgctggatgccgagatcaaggaacacgacgccgtcctcgaacaatcggtgcgtgcccaggccccagcgctgatggaagcgcctggcgtgtcgaccggtaccatcgccgagatgctcgtcgttctgggcgacaatctccagcggatccggtcggaagccgcattcgcgaagctctgcggcgtttgtccggtgccggcatcgagcggaaagaccagccgccatcgcctgaaccgtagtggcaatcgccgggcgaacgccgccctgtaccgcgtcgctgtggtccggatgcggcatcatctgccgacccgggaatacatccagcgccgaaccagcaaaggcaagccgcctcgcgagatccgccgatgcttgaagcgctacatcgcccgagaaatcttccgacacctgtgtatcgggtcggcttcagtgcccgacagaaaaaccgcttga

SEQ ID NO: 6440 - DNA, 429 bp, Methylobacterium sp.
ttgacgacggctggtcccggcctggagttgcagaccgaagtttcggcctcaaaaaacttaatccccctcgcgcagggctgctgcatgatgacgaatcccgtcgatgccatcgagatcacatatatccgtcggattcagcagcagcaggtcgaattgacccttgtgagggccgagcgtgacgccgtcatgcgcgagcgcgatctagctcaagcccggtcggaggcgacctccaccttgatcgaggcgctcatcggaagcgtgcgaccttttgggtttaatcgtaagcgcttcctagccgcgatccggaaatcggcgcgcgccttaccggatcacggaccagccgcccttcagcacacaatcttgctcgaaggttcgaaccggatccttgcggcctcacgcatgcccgatcaagcggcaacgcgcagctga

SEQ ID NO: 6441 - DNA, 186 bp, Methylobacterium sp.
ttggccgagcgcagcggtgtcgctgcgacgacgctcgcgcacttcgaggtgggaaagcgtgatccctatacccgaacgctggcggacgtgcgtcgcactcttgaggcggccggcgtgatcttcatttccgctgacgaggtcggggggcccggcgtccgccgcacccgggagaccaccgttgcgtaa

SEQ ID NO: 6442 - DNA, 336 bp, Methylobacterium sp.
atggtcatcggcacgcgcgtcctgacgatccggagcctggacgcggatatttccgtcccggtccggctctgcgcgcccgaatacgccgatgggcattggatctgccgctatacgatcggttggcccgagcatccgtgggacagcttcggagccggcgtcgatgcgttgcaggcgctccatctgacgatgcagaagatcggcatcgacctctacagtagcgcggcccacaaggccggcaccctgaagtgggagaagcctgcggatggatacggctttcccatcccgaagaatggccgcgatctcctgatcggtatggacaagatcttcgaggggtga

SEQ ID NO: 6443 - DNA, 345 bp, Methylobacterium sp.
gtgtcgatctcagacaagaccgacgacatccggccgaaccgcaagcgcagcgagacgaatctgccgccggtgctccgccgcgggcgcgagcaccggatcgtgcgctggatcggcgccgcgaaccgcaaggcgccgcgccccgcggaggagcccgcggccgcggacaaccgcgtgatcaagctgagctgggccgacacgttcggccgcccgggccgcgccgagcccggccgatccgagccgggccccgcacaggtgctgccgttccaggggcggcggagcgagaccgctccgcgcgcgaccccgcgccgcgccgccgatcagccgccggtgcccgtcctgcgctga

SEQ ID NO: 6444 - DNA, 1923 bp, Methylobacterium sp.
atggcagcgcccgacggcatccgcgcggtgaccttgtcgagcggcggcctggccgaagtgaccctggtccatgccgtcgacggcgacggcacgatcgggctcagcgtccggcccgagcaggtcgacgacatcctcaagagcctcgtcgtgcgcgatcccgtcggcaccgtcggcgccctgcgcctggacggggtggatcaggccgacgagaccctgcggacgatgccgttcaccgcggacgacctgtccgcgccggcccgcctcgtgggcaagctgcagggcgtcccgatccgggtccagagcggcggtcgcacgctcgaagggcgggtgctcggcgtgtccgagcggaatgccgggaccgagaccggcgacgtctcgatcctgaccgtcctgaccgcgaccggcacgctcgaatccgtgccgatcgaggacggcgcctccgtgacgatccaggactcggccatggcggccaagatcgccgaggcgatcgcggcggccgggaaggccaaggtcggcgacgcccaccgggtcgagatcgccgtctccgggcggggccagcgcgaggtccggttgacctacgtcgtcgccgcgcccgtctggaagacgagctaccgcatcgtcgatggcggcggccgcgcgaacctgcaggcctgggccatcatcgagaacgccctcggcgccgactggacgggcgtcgacgtcaccctctcgtccgggtcgccggtggcgctcctccagcgcctgcacaagcgctactggcgcaagagaccggaggcgccggtgatggtcgaggatgtcggcatgccggacctcgacccgggcacggtcgcgtcgaagtcggtcgcgcgcctgcgcgccccggcccccgccgccgcgccccttccggccccgatggcgcggatggacacccgcgacagccgcatggaggccgcggaaccgagctacgacgccgcggccgccaccgcgggcgccgccgccagcgagggggatgtcgcggcgaacttcacgctgccgcatccggtcgatctgcgcgccggcggcacgctgtcggtgccgttcctcgataccgagatcgaggccgagcgggtcgccctctggaagccgggccagggggttcacccgatcgcggccctccggatccgcaacagcgccggcgcgaccctgccggcgggcctcatcaccctctacgaccgcaaggccggctacctgggggacgcccgcctgcctgcgacgcccgtcggcgagcagcggctcgccagcttcgccctcgaccgcaaggtcgccgtccaggcggagaccgcgccgagcgacgccctgaccaagatcaccgtggtcgacggcgtggcgcgcgcgacggtgatcgcccgggaggtcacgacctacacgatcaagggcgcgccggacgccgcccgctccgtgatcatcgagcatccccgacgggatggctggaccctcaccgcgtccgcccgcgacagcgagacccccacggcctatcgcctcaaggtcgcggttcccgccggcgggacggccgagacacgggccgtgctcgagcgcgtccggatcgacgcgtacgatctggtcgacgccgacgaggcgctgctcgtccggtgggcctccctggcgaccgacccggagctgggcggcaagctcaagatcctctcccaggcccgcgccgaggtcgccgcggcgacccggaccgtcgaggagatcggcgagcgcgcggcgaaggtgcaggcggagcaggagcgcatccgcagcaatctcggcgccgttccgaaggacagcgagctggcgcgccgctatctcagccgcatgggtgcccaggaggacgagctggcgaagctcgatgccgcccggacccaggccgaggacgggctcagggcgtcgcaggcgcggatccggtcgctgatcgcggcgctctga

SEQ ID NO: 6445 - DNA, 1011 bp, Methylobacterium sp.
atggcggcggaggcgggcagggcggcgacgaggctggcgcggcgccaccggcaggcggcctgcgaccggcgccaggacgggctcggccgcgggcgcaagctcggacccggcatcgtccaggcgctggactcgctgccgcacggcctgtgcctgttcgattccgccgaccggctgctgttcgtgagcgacgggttccggcgcctgttcggcccgcccgcgaaccggatccggcccggcatgcatgcccgggcggtgggcgcggcgagcgccgcgggggcggtcccggccgaccgggatccctgcggcctctgggcggcgcggcggcggctcctcgcccggggcgcgaccgacgccgtggtccagacgctcgcggacgggcgccaggtcgcgatcacgctgcacccgcaggccggcggcagctggaccgccctgtgggaggacgtgaccgagcgccgccgggcggagtcgctcctgcgctacatggcccaccacgacccgctgaccggcctgccgaaccgccaccacttcgcggcccggctcgaccggaccctggccgacctcgacggcgcgccctgcgcgctgctgtgcctcgacctcgacggcttcaagccggtgaacgaccgccacgggcacgcggtgggcgacgcgctcctgcaacacttggccgagcgcctgcgggcggcgctcggcgcgggggattgcgccgcgcggctcgggggcgacgagttcaccatcctgctcggcgacgcggcgccggcgccggccctcggcttcgccctgcgcctccaggcgcgcctcgccgagccgtacgatctcgggaccggatcgccgatccgcatcggcgcggcgatcggcgtggcctgcgcgcccctccacgccacccgggcgcaggccctggtggagcgggcggacgcggcgatgtacgcggccaagcgcctcggccacccctacctgtgggacgacgcgctggatctcgggccggtcggtccgggcggcgcggtcccggcctga

SEQ ID NO: 6446 - DNA, 537 bp, Methylobacterium sp.
atgtacaggatctcggcgatgctcgtcctggcgaccagtcccgcgctcgccgcgccggccgcggctggcgatccgggtacgcgcgcgccgttcatccgcgagcaccgctgcgccgtcgtggagcgtctcgacgccatccacaggcgcgggccggtcgacgtctcgcgcgaccgcttcatcgtcgtcgcgccgcacggacaggcgcagcgctacgtccagtgcatcttccaggatcgggatacgcggatgttctgcgaggccgcgtcgggcgcctacgggccacccggccgaaggcgcctgcggctggatgcgacggcccggcaggcgctggcggcgctcggatacgtccaggcggacccggcggagaactacgcgcgcctcgtggagttgggaacgccgcccgacatgggcatcgtcgcggacctgatgctggcggcgctgcacgatgcctacggcgcccgcccgggcgacattctcgatatcgaggccccgcacggcggaatgccggggcggggctgcggcgcgcccgtatcctga

SEQ ID NO: 6447 - DNA, 1011 bp, Methylobacterium sp.
atgcagatcaaggcggcgatcgacaggattcccggcggcctgatgctggtgccgctcctgctcggggccctgtgcaagaccttcgcgccgggcgccccggcctatttcaagggcttcacgcaggggatcatgaccggcgtgatcccgatcctggcggtctggttcttctgcatgggcgcctcggtcagcctgaaggcgaccggcacggtgctgcgcaagtccgggacgctggtggcgaccaagctcgtcgccgcctgggcgatcgtgctggtggccgggctgttcatcccgcccgaggggatccagaccggcttcttcgccggcctgtcgatcctggcgatcgtctgcgcgatggatatgaccaatggcggcctctacgcctcgctgatgcagacctacggcagccgcgaggaggccggcgccttcatcctcacctcgatcgagtccggcccgctgatgagcatgatcatcctcggggcctccggggcggcgcatttcgagccgcagatcttcgtgggcgcggtgctgcccttcctcgtcggcttcgccctcggcaacctcgacccgaagctccgggccctgttcgctcccggcggccagctgatgatcccgttcttcgccttcgcgctggggaacacggtcgacctcaacaacctgctctcgccgctggcggggctcggcatcgtgctggcgctcgcggtgatcgtcctgaccggaatcccgctgatcctggccgaccgggcgatcgggggcgggaccggcacggccggcttggccgcctcctccaccgccggggcggcggccgccaacccgctggcgatcgccgccgtcgccccgcaattcgctccatcggcgcagaccgccaccgtgctggtgacgatctgcatcatcgtcacctcgatcctcgtgccgatcctgaccgggctctggtaccggcggttcggggcgggcgtggcggaggcccgggccgaggaggagggcggcgcgccgctggcggtcccggccgagtag

SEQ ID NO: 6448 - DNA, 159 bp, Methylobacterium sp.
atgccgccaggcacccgcatcgcactcgccgccgttctgctgctcggcctcgccgcctgcgatgacaagcaggcgcagaacaacacgccgacgaaacccgactccaccaagatggagccgcagaccgaccaagcggcaccgaacacgcagaagcgctag

SEQ ID NO: 6449 - DNA, 966 bp, Methylobacterium sp.
atgacggggcgcggaccggcccgcgcgacgcggcggcgtgtgctcgccggcggcgtgctggcgacgggcgcggcggcgtcgggcaccgtgcgggcggaggtccacccggcgcgggccggagaggtccgccacggcacggtccgggccgacggcgtggacgtcttctaccgggaggccggtcgccccgacgccccggtcatcctgctgctgcacggcttcgccaactcgtccttctacttccggcacctcatgcccaagctggccgatcgcttccgcctgatcgcgccggacctgccctccttcgggttcacgcacgtcccggaggatcgcgcctacgtctacgacttcgcgtcgctgtcgcgcacggcggaggcgttcgtcggcgcgctcggcctcgaccgctacatcctctacacgttcgattacggggcgccggtcggatgggacctggcgctcgcccatcccgaccgggtcgccggcatcgtgtcccagaacggcaacgcctatctcgacgggctcggcgacgcggcctgggcgccgctgcgggcctactgggccgcgccgaacgcggccgccgtcgcggcgatccgcgcccgcatgaccctcgacggcgtcagggccgcctacgtccagggtgtgcccgacccgtcccgcatcgagcccgaggcctacacgctcgacgcggccatcctggcgcggccgggcaatgccgaccggcaggtcacgctcaagctcgactacgagcgcaatctcgcgcgttacccgctgatccaggccttcttccgcgcgcgccgcccgaagctcctcgccgtctgggggcgcaacgacgcgttcttcatcccgcccggcgccgaggcgttccggcgcgacatcccggaggcgcgcgtcaccttcctcgacaccgggcacttcgccctggagacggacggcgacgcgatcgcggaggagatccggcgcttcttctga

SEQ ID NO: 6450 - DNA, 360 bp, Methylobacterium sp.
atggttgagccttcccgcacagaggaggaagggaaggcgcgcaccggcgcgtcctcctggcccgacaacctcccgccccgccccctggtgatcttcccgcgcggcgaggccgccctcgacgtgctctcgaccgtcccggaggggccgccccggcgcttccgctggcgcgcccggatccaccgggtcgcccatgccgaggggccggagcggatcgccgccgaatggtggcgcgcgcccggcgcggatcgcgactactaccgcatcgagtgcgaggccgggcaccggctctggctctaccgcgacggcccgcacgcccccgaccgcccggccgcgtggtacgtccacgggctgttcgcgtga

SEQ ID NO: 6451 - DNA, 168 bp, Methylobacterium sp.
gtgccgccgccggcgatgccgaaggtcgaacccgctccgcccgtgccggccccgccgccgtccgcgcccacgcccgacgcgaagggatccggcaacccgttctcggtggaggagatcgaggccgagttcgcccgcctcctcggtcgcccgctcgacaagcggagctga

SEQ ID NO: 6452 - DNA, 246 bp, Methylobacterium sp.
atgatctcacaccgcacacgcgccgccgcggccaccgcgctcgggacgctgctgacggtcctggcggccccaaccgccgcgccggcgcagccggtcccgcgcttcgcgcagcccgacgttccgagcgtcgcggcgatcgcccgggcacgcccgttccggacggatctggacctccgctcccccgccgtggagcgggagcattcccgggcgcagcgcatcatcgcccgcgtctgctcgcgctgctga

SEQ ID NO: 6453 - DNA, 930 bp, Methylobacterium sp.
ttgcgcatcctcgtcgccacagacttttcgacccgctcacagcgggccgtgcgacgcgccggcatcctggcgcaacagaccggagccgacgtcatgctgatgcacgtcgtgaacggagcgggttcccggcaggtcgcacgggacgttcgcgaggcgcagcgcatgaccgttgagcaggccgcggtcgtgccggaactcttccgcgtggactgccgctcgctcgtcgtccccggacgcctgcccgacccggtgctcaacgcggcggcggcgcggcaggtcgacctgatcgtggtcggctcagatcatggaaaggacgcgcaaggccttggccagacggtccgcgacctgatccgcgccgccccgtgcccgatcctcgtggtcaatcggtccgtcgtgggtccctacgccgaagtcacggtcccggtcgacctctcggccgcgtcggcgcgggcattgcacagcgtcgcgtcgctgggcctcgcagaccgcgcccgcgtcaccgtcgtccacgccttcgacgtgctgggcaagccgagattgtcggggttcggcattccgcgcgagcagatcgaaggctacgtcgagagttggcgctccgtgtacgcggaggagactgaagcctttctcgaagccgaggggctcgcaagacggaactgggtgaggcggacggaggaggggcgcccggacgaggtaatcgccagcctagcggcgcgaacctgctccgagctcctcgtcatgggcacgcgtggccggaccgggttcaggagggccctgctgggaagcgtcaccgaagccgtcctcgccgccggccaggcggacgtgctggtggtcccgccgccccggcccggctcatccagcaggtcggaacgatcaggatggcccttgtccgccaaggccgagcgcacggccctacaggtcgtcacggcgtga

SEQ ID NO: 6454 - DNA, 822 bp, Methylobacterium sp.
atgggcgcggccggccggggcgccgcgctgacgctcggcctgatgctcgccggaccggccgtcgcgcaggacgggccgccggcgccgcgggtcgcctccgccgtgaagggcctgcgcttcgtccccctcgccgagctgccgcgggccccgggcggggcgggccggcaagccggctgccccggtgaggtcgtgccggcgcgatccgaggcggcccggtccgtggccgcccgggactggttcgtcaccggcgaggcggccctcggccggtaccgggccgtcagcttcgccagcgacctgcagcaggggacgagcggcacctgcttcatcgcggacggcaatgtcggactgttcgcgggaccgcgcctcgtcgccctcgtgtacggcgccggccggaccggcgcggtcggacgcatcgcggcgcgctccgaaggcgcacgcctctgggacggcgacatcccgccggccccggtgggcgacctaaccctgcgcccggacgggaccgtgtcgctggagccgcctcccaaggtcgagtccgtctgcggcggccgcgggtcggtccccgcgatccgcggcctgccgatcgacgaggcccggacgtcgctcatcgccgcgggctggacgccggtgaagggcccaccgagcgacgatgcgcgggagcgggctctcgcccggcgcggcgtcacggaagtcgacggctgttccgggacgggtctcgcctattgcagcttccgctatgccggggccgccggcacgctctcggtgaccacgacgggcgacgccgaactgcccgaggtccacgagtacggagtcgcgtgccgatga

SEQ ID NO: 6455 - DNA, 1197 bp, Methylobacterium sp.
atgcggttcctggtggcgacgattgttctgatcggactgtgcggtcaggcgaatgcccagggcaaatcgaagaagccgcaacctcagcagccgtcgacccgctacctcagcttttcggaagggtccctggacggttcggcgacgtatctgatcgacggcgtcctgaagttgacctcgcagggcagccagatcaccgacgcgagcatcgacgtctgctacccgacaagcacgctgtcgcggcgcgtcgaccgtctggtgatcccgctgaaggccgacggcgcgaacttctcaggagccggagcaagctcggcgggggatcgggtcgccgtgtcgatcaagcggagcggctcgaaggacgagcagcagctgaacggctctctgaagcttccggaccatagcgtcgccatcgcagccaccggcctgacgttctcggaggaggatccgaccgcgctgccctccggttcgacggcagaggacgagcctgaagacgtgagcgacaagcccgtacccgatcccggaaccctctcggtgacgacgaagcttccgaacatcgtcgatctggtgaagctggtccgcactgaaggtgcccggatggatcccgccggtctggtcccgaactgcgccgacctgagaggcggcacctcgtcgatctcgatcgacgtcgatccggagagtgctcccgcgctcctcgagaaggtaaagaagctcccgggagtggcgactgcggaatacgggcaggtcgccgacaagtcccagctcgtcaagctcaaggcgaagccgggcgacgccgatctgatcgccgccctcggtcgcgcattgccgaaggccatccccgatgcgacgatcgtctcgtcgggcaaggacgccgggcgaggcgagatccagatggccctcacccgcaaggtgtcctacctggatccgatgggagctcaggaagcgatctcgctccgggctaccgcgtggcaggatcctcaggacaagtccgtctcctacgtccagctccggagtgtcgatgcgagacttgtcgataccggcaaggagaaggtcttctcggtaggggccgccgagtccgagggggaggacgccgtcgtcgcctccgatcttgacacggcggcagcacagcaggcgatagctgcggcattggcttctgatctgcacgggcaggcctgggtcgaagatgcgtgggtgtcgaagtag

SEQ ID NO: 6456 - DNA, 1173 bp, Methylobacterium sp.
atggtgacgaacgtcctgcccccgctcgatccggccgccctcccggccggaatccgggcccgcttcgtcgagggcgtcaacggcctgcgcatgcacgtgctggaggcgggcgacggcggtcccgaccgcccgctcatcctcctggtgcacggcttccccgagatcgcctattcctggcggaaggtcatgccggcgctggccgcggcgggctaccacgtcgtcgcccccgacctccggggctacggccgcaccgcggacgcgccggtcgccttcgcggacgacctcgcgccctaccggctgcacaaccttctcctcgacctgctgtgcctgatgagcgccctgaagcgcgacagggtggcggcgctcgtcggacacgattacgggtcctgggtctgcggctactgcgccctggcccggcccgatctcttcggcatggtcgccctcatgagcgcgcccttcgcgggggcgccagggctcgacgccctggcccgcggcctccggacgccggccgacgacccgatccacgcggcgctggccgccctgccgcgcccgcgcacgcactaccaccgctactacgcgacgcgccgcgccgccgccgacatggagcgcagtccccagggcctcgccgcgttcctgcgcgcctatttccaccacaagagcgcggactggccggacaatcgaccccgcgcgctcgccggctggacggccgaggccctcgccgagatgccgacctactacgtgatggatgaaggccggacgatgcccgcgaccgtggcgccggagatgccggagcggggcggcgcggactgcgcctggctgacggaggcggaactcgccgtctacgcggccgagtacgcgcgctccggcttccagggcgcgctccagggctaccggtgccgcatggatggcagcatcgaccgcgacctcgcgcggttcgccggccggcggatcgaggtccccctcctgttcgtgtccggcgcgcgcgactggggcccgttccaggcgccgggcgcgctggagcgcatgaaggaggccgccggcgcgggcctgctcggctgccacttcgtggcgggggcggggcactgggttcagcaggagcagccccgggccgtcgcggacctcctgctcgacgcgctcggtcgcggcggggccggatcccgccccggcgcgtag

SEQ ID NO: 6457 - DNA, 633 bp, Methylobacterium sp.
atgcatccctatgtctcggacggcctgcatgccgatcccttcgacgccttccgcgtccgcgcccatcgcggcccgatgggcggcgacccccgcggacggcacggtccccacggtcacccgggtcgcggtcccggcgagcgccggatgttcggccgcggcggccgcggcgacctcgcgcgcttcttcgcccacggcgacctgcgcctcgtcatcctccacctgatcgccgagaagccgcgccacggctacgagatcatcaaggcgatcgaggagcgggtcggcggcgcctacagcccgagccccgggaccgtctacccgacgctgaccctcctggaggaactcggccacgtcacggtgacccccggggagggcaccaagcggctgcacgcgatcacgcccgaggggcaggccttcctggacggcaaccgcccgaccctcgaggcgatcctcgcccggatggcggaggccgaggccgcccgggccgacggtcccccgccctcggtcgtgcgcgccaaggaggggctgaagctcgccctgcagatgcggctcgcccgcggtccgctcagcgccgagcaggccgccgccatcacggcggccctggaggcggcgaccgccgcggtggagcgggcgtga

SEQ ID NO: 6458 - DNA, 231 bp, Methylobacterium sp.
ctggccgagcgcgtcacgcacttggctgccgcgacgctctcggccaagcgccgcagcctggatcggcaactcggcgccatcctggctacgccgagccgctgtgacctgacccgcgacctgcaggccaagatcagccgcgcgcgcgatcagctcctggtgttcctcgcctatcccggacaggtcgagccgaccaataacggctccgagcggctgctgcgtccggccgtcgtg

SEQ ID NO: 6459 - DNA, 2034 bp, Methylobacterium sp.
ggttacgggttcgtggagcccggccccggatccttcatcgcgggcgctcagatcaccggcgggaacggcggtgccggcggtgccgccggcggtcccggcgcttccggcggtgccggcggtaacggcggcatcggactgttcctctacgggagcacgggcacgaacaccggccagatcacgggcggaaatggcggcctgggcggtgccgcgaacggtgggatggcgggcgtcgcgggccagggtggggccggcttgtccggcgcgaacatcgcgatcaccaacaccggcacgatctcgggcggcttcaccggcggcagcacaaccgtccgggccgtcgctatcaacgtcacgggcggcaccaacagcctgaccccgagcacaggaacgctgaacggcggcctcgggatcgccggcggcgccacgacattgcgcgtcctcggcaacgctcccaacaatctcggacccgtagccaacgccggcacgttcgacatctcggggaccacggccggcgcctcgatcaccacgctctcgggcaccggcgggacgacgctcggcgcgcagaccctgaccatcaccaatggttcgaccagctacagcggcgcgatctccggtaccggcggcgtggcggtcaacggtggcacgcagacgctgacgggggccagcacctactccggcggcaccacgatcggttcgaacggcggcgcggtgtcgagcacccttcaactcggcggtccgacctcggccggcacggggacgatcagcttcggcacgatgtcgggcacggcgacagcgcgcctggggctcaatgtggccgcccagccgaccaacggcggcaccttcgccaacaccatctccaacttcggttcggggaacgagatcgcgctcgccggcctgaccaactccagcgtcagctacaacagtgcgaacagctcgatcaccataaccggcacccgctccggtggcgggcaggtgagcgagaacttcgtgctgtcggccccccgaacgaccagcttcgcggcggtgtcggacggccagggcggcacgatcgtgcgcgccgctacggccccgaaccccacgaaccccacgaaccccaccaatccatctcagccggccaacccagctccctgctacgtgaccgggacgcggatccgtgtcctgcgcgatcgggtcatctcggacgtgccggtagagcagctcgcggtggacgatctcgccatcacggctgccggtacgccgcgcccgatccgttggatcggcacccgcgcgtacccgggatcgacggttcccccggccgagcgccccgtccgcatccgggccgacgcgttgggcgagggtgtgcccgcccgcgacctgcttgtttctccagatcactgcctgtggctggacgggctgttcgtggcagcgggacatctggtcaacggctcgagcatcacgcgtggcgagatggtggcggatctcacctactggcacgtcgagttggacacgcacgacctgctgctcgcggagaatgctccggcggagagcttcctggcggcacccggcgtgcgcgggggcttcgatggcgtacaggccctcgatgtcggcaccggacgcatgccctacgctgcgcgcgccgaactcggccccgacttggccgccctgcgcgggcgcttagccctccgcgctgtctcgttcgacggtgctgctgagccgggcccggtgcgcgcgtggctggaccgatgcgtcgtggcgggcgatggcctgctgcacgtcgggggctgggcgcgcgacgaggcgcaacccgacaccccgctgtgcttggacgtgttggtggacggtgtcgtcgtcgcgttcgcggtggcggccgagttcaggtcggaccttgccgcggccggtttcggcgacgggcgatgcggcttcgacctgggtgtggatgtacgcctcgcgccgcacgtgcatcatagtgtcgaagtgcgtcgctcggccgatggcctcttgatgtgtgccaagcggatggatgcgacaggggcttggaccgcactgttggcagcgtag

SEQ ID NO: 6460 - DNA, 156 bp, Methylobacterium sp.
atgatgcggcgcctggatggtttcgcccgcggcctcggtctcgacgaggcggccacccgccggatcgtcgagaagatcgtcgcagagatgccggaccggtcggacgaggagcggctcgacaccgcccgccagcacatgatcatcgcgtcggcgtag

SEQ ID NO: 6461 - DNA, 1581 bp, Methylobacterium sp.
atgggcgcgatctacaccgtcgagctgcaggcccataccgggtctgccgtcgagagcttctatgtggcgtcgggcgagttcaacacgggcccggccgacgtgccggcgcaccagcacttccacccgtcgctgcagaccccggccaacttcgagcgctccctgttcgggaacggcagtaccagcggcgcggccagcatcggcttcggtgagatcgtgatcgtcaacgcgcacggccggtacgatgcctggccggattacgccttcgacggccggccgtgcatcgtgaaggcgattccgatcgacgagcagaccggcaaggcggcgtgggcctacaaggatgcgccggtgctgatccgcggcacgatcgacagcctcgacatcaccgacgccttcacgacgatccggctccgcgtctacgatcgcctctcggacctggacaagccgctcctgacgcagcggtacggcgggacgacgctggcgggcgggcagggcgccgacggcaccgcggacctgaaggacaccctgaagccggcgatctacggcttcaaggccagcgtcagcccggtcacggtcaacccgtacgatctgatctaccaggtgtcgctgcgggcgtgcgtcagcatcgtggcgtacgacggcggcgtgcagctcaccaacgcgggcgacttcggcacggtcgctgcgctgctcgccgcgaccctcaccccgggcaaatacgccacctgcctcgcctccggcatgttccggctcggcggatcgcccgccttcgccgtgaccgcggacgtcacggcggccggggcggggaccgcggcggacatcgcccggcagatgctgctggacttcgggctcgccgggagcgacctggacacggcctcgttcagcgccctggcggcgaagaacccggccctgtgcggcgtcctggtgaccggcgacacctcggtgctgtcgtgcgtcagccaggtgctggcgagcgtcggaggctggatcatccccgacggccggggcgtgttcacggtcggccgcctcgagctcccgaccggccacccggtcgccctgttcgaggaatggcaggtcgaggagaagctggaacgcctcgcgcccggtgacagcaaccgcggcatcccggcctatcgcatcatcgtccggtacgggcagctcggtcggacgctcgcggattccgacgtggcgggttcggtgagccccgatcggacggccgcgctggcgctggagtggcgcgaggccaccgccgaggacggctcgatcaagggccgccacctgctcgcgcaggagatgaccttcgacacctgcctggtgaacgccgcggacgcgcaggcggaggctcagcgcctgctgtcgatctacggcacccggcgggacatctggcgcatccaggtcgacatgaccgacctggattaccgctacgaccagtcggccggcgatcccttcacgctgatcatcggcctcggcgccgaggtgcagctctcggcaccgcgcttcctcaacccgccaaagaacctgatcgtgatcgggcgggtcgaggactgcaacaagaaccgcattcagttcgatctctgggggtga

SEQ ID NO: 6462 - DNA, 1056 bp, Methylobacterium sp.
atgggccagacgacgatcaaggacgtcgcccgacgggccggcgtgagcttccagacggtctcgctggtcctgaaccacccgcagaaggtcgcccggaccacgcgcgagaccatcgagacggccatgcgcgacctggacttcgtgcccagcctcgccgcccggtccctgcgcaagaagccgagtcgcagcatcgcctgcgtgttcgctccggcgccggagcccgccgccgacgggggccgcccgggagaggcggccgatcacggccacgtcctccggaccttcggcaccgtcaccgaccagcagggctacaccctggtccaccgctgccgccgcgccgacgacccggacggcccgggccggatcgccggcctcgtcagcgaggcccgggtcgacggcctcgtggtcttcgccgaggatcgggacgacccgctgatcggcctgctccaggccaagcgatgcccgttcgtggtgttcggcctggacgttcccggcacgcactacgtcgcgctggccgagcgcgacgcggtccacggggccgtccgccacctgatcgcggccgggagccggtcgatctgcctgctcgcgggcgacgcgcgccggccggccgccgccaccgagcggttctgcggctaccgggacgccctcgcggaggcggggctgcccctgcgcgacgccctcgtggtcacctgcgacgggaccgccgcgggcggctaccgggccgcgcgggctctcctggaggccggacccggtgcccggccggacgccgtcgtggccgccagcgaccgggtggcgttcggcgtgctgcgggcgctgcacgagggcggcgtgcgggtccccgcggagatccgcgtcgtcggcttcgacaacctcagccagggggcctacgcggtcccgagcctgacctcggtcgatgtcccggtgctcgacatggtccggtccgccttcgcgacgctggtcgaactgatcgaggggacgcgggcgccggacgacctcgcccagacgctgttccccgcgcgcctcgtcgtgcgcgagtcgagcgcggtggcggcgccctag

SEQ ID NO: 6463 - DNA, 471 bp, Methylobacterium sp.
ttgaagaagctgctccgcaaggcgcatgtcaaaccgctcaagcaggtggcggcgctgccgttccgcgtcggcgccgacggccggatcgaggttctgctgatcacctcgcgggatacggggcgctggatcatcccgaagggctggccgatgaccggccgcaaggcccatcaggccgccgcgcgggaggcctacgaggaggcggggctcgaggggcagatcgccgcgaacccggtcggccggtaccactaccagaagcgcttcgaccacggccgcgccttcccctgcatggtccgcgtctacccgctgcgggtcgaggcccagcacgaacgctggccggaacaggcccagcgcaccctgcaatggttcccgcccgaggaggcggcgcgcctcgtccacgaggacgagctccaggaactcctgacggatttcgcggcgcggccggtcgagatccgcggcgacgggcgcggctga

SEQ ID NO: 6464 - DNA, 1509 bp, Methylobacterium sp.
atggcagaactccgagaggggccggaagcgacggcgccgcccgcgttctcgaagcgccggagcctggcctggatgggattctgccagggcgggctgttcctggcacagttcggcacctcgctggcgctcgcgcgcctgctgacaccgcacgagaccggcatcttcagcctcgccgccgccatcgcgggcctgctgtccacgctgcgctcctgcggcctgtcgagctacatcgtccgggcggagcgggtggacgcggccctgctggcgagcgtgttcacggtgaacctgatgctgtcgggcgcggcggcgatcctgatcctggccttcagcgtgttcggcagcgtcctgctcggtgacccggaggtccagcgcgccctggccatcctcgccgtcgtgccgctggtcggcgcgctggaattccgcccggccgccatgatcgagcggcacggcaatttccgcggcgtggccctcgtcaacatgctgcgcggtctcgtcgccagcggcgcgatgctggcgctggcgctcctcggcttcagctacatgagccaggcctacgggcaggccgcgggtgccgtcgcggcggcgctggccgcgaacggcctcgggctgcgctacgtgtcgctgcgcctgggcctcgcgggctggcgcgagatcctgacctacggcggtcgactcttcgccatcgcgggggtcgcggggatcgccggccggatgggcgacctcgtcctcgggcggatgctcgggctcagcgccctcggcctgtactcccgcgcggcgagcctcaacaccctgatgtgggaccacctgcacgtggtgatcacgcgcatcaccttcgtggacctcgcgaaccagcagcggaacgggcagtccctgcgcacctgctacctccacacgctgcggatgatcaccgtgctgctctggccggccttcgcgggcgcggccgtcctggccgggccgatcgtgcgcgtcctgctcgggccgggctgggagggcgcggcgctgcccttctgcctgctgtccctggccgcgatcgtcctcacctcgctcagcatgacctgggaggtgttcctgatccgggaccagaccgccctgcaggcgcggttcgagttcctgcgccacggcgccggcctcgtgatgttcagcatcggctgcctgttcggcctcgggggcgccggcgcggcccggatcggcgaggcgttcctggccgtcggcctctatcggccgcatctcgagcgcatgaccgacacgttcaggcgcgactacgcccccatctacctccacgccgccaccctgacggcggtcgccgtcgcgcccgccatcctggtgatgtcggcctggggctggtcggccgagacgccgctcccgagcctcgcggccgcgatcgccgcgggcatcgcgggctgggtctgcggcctctggtacctggaccatcccctcgtcgcggaagcgcgcctgctgctcgcgcacatgcgcccggcccgtccggccacgaccgtgtcggatctctag

SEQ ID NO: 6465 - DNA, 789 bp, Methylobacterium sp.
atggccatggtgacgatcagtcgacgccgcgcgctcggggcggtcgccgccggcgccgccgcgggcctcggccccgccgcggccgccgaggcgcagccggccccgctcttcccgctgccgcaggccaccgtcccgatcctgggcgaggcgcaggtcttcccggtccgccggatctactgcatcggccggaactacgcggcccacgcccgcgagatgggctccgacccgtcgcgcgagccgcccttcttcttccagaagccggcggatgccgtgcaggtcgtcgcgggcggcgtcgccgaccatccctacccgtcgctgacccagaactaccaccacgagatcgagctcgtcgccgtgctgaagtcgggcgggcgcgacatcccggccgcgcaggcgctcgaccacgtctacggctacgccaccggcctcgacgtgacccgccgggacctccagcgcggcatgggcaaccagaagaagccctgggagatcggcaagagcttcgaccagtccgcgccgatcacgccgatcctgcccgtcgcccgggtcgggcatccggcgcgcggccgcatccggctcgccgtgaacggcaccgtgcggcaggacgccgacctgtcggacatgatctggtcggtcgccgagcagatcgccgagctgtcgcgggccttcgagctgaaggcgggcgacatcgtcttctcgggaacgcccgagaatgtcgggccggtcgtccgcggggacgtgctcgccggctccatcgagggcctgccggacctgtcgatccgcatcgtgtga

SEQ ID NO: 6466 - DNA, 354 bp, Methylobacterium sp.
gtgcggcgattctggatctcgaccatcctgggactcgaactgctcctcggcgggaccctggcagcctccgcccggacggcgggggttccggacttcaacatccgggcgatctgcgcgccggagcaccgggcgggatcgaccgccatcgaccaggcgagctaccgcggttgcctgtccgacgaggccgccgcgcggcgcaccctgatcaagcgctgggcgacgttcgacgtggcggagcgccggacctgcgcgacggagagccagatcggcggcgccccgtcctacgtggcgatgctgacctgcgtgcagctcggaagcgacgccctgccgatcaacccgccgggtcagccctga

SEQ ID NO: 6467 - DNA, 2184 bp, Methylobacterium sp.
gtgcgggccagctcttctcggaaacgcaagatcctcgtcgccgaccttctatgcggtgccggcggatcgtcgaccggctgccagcgcgcgctcgccggcctcggcctggagatggaactggtggcggtgaaccactggcccaccgcgatcgccacccacaccctcaaccacccggccgcccgccactacgtccaggacatcgcgacggtgcgcccgcacctcctggtgccggagggctacctggacctgctcatggcctcgccgacctgcacccaccactcggtggcgcgcggcggcaagccgacctcggaccagcagcgctcggatccctggcacatcatcacctggctcaccgagctgcgggtaaagcggctcatcatcgagaatgtctgggagttcacgtcctggggcccggtcgaccaccgcaccggcaagcccgtggcctcgcgcaaaggcgagtatttcaacgcctggatcgacacgctgaagcgcctcggcttcaagccggagtggcgcaagctcaacgcggccgattacggcgacgccaccacccgctcccggttcatcctcatggcgcggtcggacggcaagcgtctggcctggccgacgccaacgcaccgccgccgcgacgagatggccggcgacctgttctccggctcgaagccatggcgcccggcccgggagatcatcgactggtcgatcaagggccgttcaatcctcggccggaagaagccgctggcgccgaagaccctggtccggatcctggccggtgccctcaagttcaagtggcccgcccccttcctcggcctgctgcgcgccgagctggagcggtcgctggcctatcacctgcgctggacgctgtcggtccgcaacgcgccgcgctcgcgcgtcgatcggcacaagcgccgcctgctcgcccgccgcctggtctcgcagctccggcaggctcgcgccgacgctcgcgcccccgcccagtcctcgcccgtcgccgacccgatggtggtcaccctgcgccgcaacggcgccggctccgacgtcggccggccgatcccgaccgtggcggcctgcggcacgcatatcggcctcgcccagcccgtcatcgtcaacatgaaggggcggtcgaccgcctcggacgcgaaccagccactgccgacccagaccgcgcacgcgccgcacctcttcgccgccgagccgatcgtcgtctcgaccgcgcatggcgtcgatgctggcgaggccgatccgcacagccgacgctcccgcagcgtcgacgagccgctgggcaccgtccacgcgggcggcggcaacttcggggtggccgagcccttcgtggtctcgccgcgccacagccgcgagggggccgggcccggaccgcgcgccgtcggcgagccgctgccgaccgtgaccgccggcggaagccaggtggctgtggtcgagccgctcgtgctgtcccgccacgcgggcggcgcggcccgctccgtcgaggagccgaccccgacccaggtcgccaagcactcccacgtgctgatctcgccctattacgggcacggctggcaggagagggccggcggcgcgccggcctgcctgaacggcgacgagccgcttccgaccgtgacctcgaagggccggttcgggatggtcgtcccggtgtgccagtccggcggcggcgcggccgcccgcgacgtcgaagacccagtgccgaccatgacgaccgccaagggcggcgagttcggcttcgtcatgccggtcacgcaccacgacggcagcgaccgggcacgcgatccggcttccgagccgcttccgaccgtcacgggcgccaaccgcggcgagctggcgttcatcgccgcccagttcggcgagcgcgagggccaggcgccgcgcgtccacgacatcgaccagccctcgccgacgctgtgcgcgaccggccgggtcaacctggtccagggcaccgagggctacgacattctgttccggatgctggagccgcacgagctggccgccgccatgggcttcaacgacgaggagcggcggtacgagttcaccggcaccaagaccgagcagatcaagcagatcggcaacgccgtctcggtcgcgaagatgaaggcatgcgtcggcgccatcatggccgacaccgtgccggccgcgcgggacttcccgctctctatgcccctgatcgccgcggagtga

SEQ ID NO: 6468 - DNA, 285 bp, Methylobacterium sp.
atgctctacatggtccacatgcaggtcaacattccggcgtccctcccggacgaggaggtggctcgcctgaaggccgaggagaaagcctacgctcagaagctccagcaagagggcagatggcggcatctctggcgcatcgccgggcagtacgcgaattacagtgtcttcgacgtggcgggaaacgacgaacttcacgaactcctgagttcgctaccgctctacccgtatatggcgatcagcgtgacgccgctggcgcagcatccctccgcgatcgcggcaaactga

SEQ ID NO: 6469 - DNA, 810 bp, Methylobacterium sp.
atgagcagcgcggtcaccgcgaccgggatcaccgggcggacccgggtctacgggatcctggcggacccgatctaccacgtgaaggcgcccgaggtgatgggggcgctcttcgcccggcacggcgtggacggcgtcctcgtcccgctgcacgtggcggcggacggcctcgccgccgtgatggacgggctccggcagctgcgcaatttcggcggtttcatcgccacggtcccgcacaagaccgcgatgaccggcctgtgcgacgcgctgacccgcgaagccgagcagatcggggcggtcaactgcgtccggcgggaggcggacgggcgcatggtcggcacgatgctcgacgggatcggcttcgtcgaggcgctgcgcggctcgggcctggagccgcgcggccggagcgcggcgctggcaggggccggcggtgcggcgagcgccatcgccttcgcgctcgccgaggccggtgtcgcccgcctgacgatcctgaaccgcaccgcggaccgcgcccgagcgctggcggaacgcctgcgcgctgcctatcccggactggcggtcgcggccgaaggcgtccaggcggagcacgatctcctcgtcaacggcacgtcgctcgggatgcgcccgcaggacgccgctccgttcgacctgggcgccctccacgccggccagttcgtcgccgaggcgatcatggatccggagaccacgccgctgctcgccgccgcgctgacggcgggctgccgcgtccagaagggcctgccgatgctggaatgtcagatcgcgctgatggcccgccacatgggcgccctctga

SEQ ID NO: 6470 - DNA, 1050 bp, Methylobacterium sp.
ttgcgcaaggcgaccgccgccttcggggcggacctcgtccacgtcgatgcgcccgctgccccgggcgcgggacgcgtcaccgtcgcggtcgccgcggccggcatctgcggaagcgacatccacgccttcgagtggaccccgggctacgggttcatgaccgccttcatgccggtcactctcggtcacgagttttccggtacggtccgggcggtgggcgacggcgtgaccgcgctcgcggtcggcgaccgggtcacctgctggccgacggtgccgtgcggcgcctgcgcggcctgcggagccgcgcggccgcaggattgtcagggccgacgcgtcgtcggcctgcacgccgacggggccttcgccgagcagatcgtcgtcccggccgacaattgccgccgcctgccggacgggctgccgctgaccgtcgcggccttggccgagccgctggcggtcgcggtcaacgcggtggacgtggcggaggtcggtcccggccaccgcgtggctgtgctcggtccgggcccgatcggtctctgcatcgccttcgtggcacagcagcggggcgcggacgtgctgctcgccgggctcgacgacgctgcgcgcctcgacctcgcccggcggatcggcatccgcgacacggtcgatctcgccggcatcggcctggacgacgccgtccggcgcgccttcgacggggaggccgatcgggtgatcgaggcgaccggttccgcccggtcggtcagtgacgggatggccgtcctgcgctcgggcggcgtgatggtggtggccggcatccattccggctccctcgacctcgacctgacgggtttcgtgcgcagcaagaagcagctgcgcgcggcccacgacacgacggcgcgcgccttcgacgccgcgctcgcgctcctcgcggcgcatgccgggacgctggaggcgctgatcacccaccgccgccccctcgcggatgccggggcggcgttcgagctggcgcgcagccggcaggccatgaaggtgctgcttctcccggaagcggcggcgagccgggaggcggagcaatga

SEQ ID NO: 6471 - DNA, 594 bp, Methylobacterium sp.
ttgctcgacctccgggaacgggccgcgcgcttcgcgcgagcgcgcgggggcgcgacggccgtggagttcgctctggtggccctgccgttcttcgcgctggtcggggcctgcctcgagaacgggatcgtgttctgggagcaggagatcctccagcaggcggtgtccgacgccagccggcagatctacacgggcacgttccagacgacgaacgccggcacaaccgaccccgcgacgctgatgagccgcttccggacggcgatctgcacgcagccgaacggcacgccccgggtcacgatcttcacctgcgccaacgtccgggtcagcgtgatgaaggtggccgattacgggtccgccaccccagtctcgccggtcgcgaccaacgccagcggtgcgagcgactggaatccgaacttcgccagctacgcctgcgccggaaactcggccatcgtgatcgttcaggccgcagtcgacatcccggtcttcttcccgctgctcggtgccgccgtgcccaacctgccgaacaagcggcgggtgctgcaggccgcgacggtgttcaaggtggaaccctacaccgcgccgtcggggtgctcgtga

SEQ ID NO: 6472 - DNA, 204 bp, Methylobacterium sp.
atgaaaacagtcgtcgccaccgtcgtggtcgtcttattctgcgccggcgcccgggccgacgaactgaacgacatgccggacatcgcgtgtgcccaagcttcgtccgccgtggagcgcgatcacatcgggtgcccgggcaccgacaaggcggccgcggggtcccgggcggccacctcgcccctcgaccacgcggaagacgactga

SEQ ID NO: 6473 - DNA, 417 bp, Methylobacterium sp.
atgccggcggccggcggctcgccggcaggcctgcgcctcacctgcaccgacgcggccggcctcttggcgcggatcgccccgcggatcggccgctacgccaccctgcgcctcgcgctggcgggcggcgaggccgtcctgttcgcccccgacacgggcccgggccggccggcgcttccctggtgcgcgacgccgctcgggtggctggcggccgacgggccgctgctcctgcccttcgggtgccgcctcgccgtgccggcgccctggcgcgccgaggtcgcccgccgcctgctcgaccggcacgggatgagcggtccggccctgctcgttcccgagggcgaaaccctgcgcctgctcgacctcgccggttcgcgcgccttgccggacatcgacaccggtcgcctgggagaggcggcgtga

SEQ ID NO: 6474 - DNA, 693 bp, Methylobacterium sp.
atgaacaagatcagggccatccagccggacacgctccggcaaaaggtcgaggacgccgtccgcgaggcgatcacgaccggcgtctacgcccccggcgagcggctgatcgagcgcgagttgtgcgaggggctcggcgtcagccgcgcctccgtgcgcgaggccctgcgccggctcgaggccgagaagctcgtccacacggtgccgcatcgcggcccggtcgtggcctcgatctcggtggaggaggcgcgtcagctctacgcgctgcgggccgtgctggagggctacgcggcgcacgaattcgccacccaggccacggacgcggcgatcgccgcgttcgggcgcgctgccggtgatctgcgcgaggctgccggcagcggcgacacggaccgcgtactgcgcgccaagggcgtcctgtacgacgtcatgctcagccattgcgggaacgatctggtccgcgagacccttcgcggcttctactcccggatcaacctgctgcgcgcgacgtcgctgatgcatcccgagcggctgccgcacagcctcgccgagatcgacgccctcgtggccgccttccagaaacgggatgccgcgcaggcggagcaactggcgcggctccacgtcaccaacgcgtgcgcggtcgccctgaagcagctcgcgttccgcatcgcgcagacgtccctcgacgcggtgagctga

SEQ ID NO: 6475 - DNA, 516 bp, Methylobacterium sp.
atgctcgccgtccgcctctcgaaggtcgccctcgtcggggccctggcgatgacctgcacgctggtcgtgtacggcaacgtcacggagccggcggtgaacctcgccttcgtgcagcacgtcctgtcgatggacacgatcctgccggattcgggcatcgccgaccgcgcgatcacggatccggcactgcagcgcggcgccttcgcgatgatcgtcgccgcggaggctgtgacggcgctcctgctctggatcggcgtcgcgctgatgctggcgcggcttcgggccccgcgcggcgacttcgaccgggccaagacctgggcgatcgccggcctgagcgtcggcttcctggtctggcaggcgggcttcctgggcatcggcgccgagtggttcggcatgtggatgtcgaaggtctggaacggccagcaatcggccttccgcttcgccatgacggtcctcggcgtgatgatctacgtcgccctgcccgaggccgaggatccggaggcgagcggcagaggctga

SEQ ID NO: 6476 - DNA, 1218 bp, Methylobacterium sp.
atgtcccgcacgtccccctcggccatcgaccgcgcgcccgtcgccgaccggtcgggcaccggcaatgtggtcaggctggccgtcgcgcaggccctcgccggcgcgaactcgaccgtcgtgttcgcgacgggcgccgtcgtcggcaacatgctcgcgcccagcaaggtcctggccacattgccgatctcgatcttcgtggtcgggatggccgcctgcgcccttccgaccggcagcatcgccaggcgccacgggcgccgcaccgccttcatggtcggcaccgggtgcggcgtgctcgtcggcctgctctcggcctgggcgatcgtcgcggccagtttctggctgttctgcgcggcgatgttcctcggcggcgcctacgcggccgtggtcttctcgttccgcttcgccgccgcggattgcgttccggccgaccgccgcccgcgggcgctgtcggccgtcatggccggcggcgtcttcggcggggtgatcgggccgcagctcgtcacccacaccatgaacctgtggcctccctacctgttcgccgcgaccttcctggcccaggccgccgtcgccgccgcggccgccctgatcctggcgggcgttcgcctgccgcggccggctgccgggtccgtctcgggcggacgaccgctggccgtcatcctcgcgcagccgcgcttcgtgatcgcggtgatctgcggggccgtgtcctacctcctgatgaacttcgtcatgacggccgccccgctggccatgcgcctgtgcggccacgcgcaggaggatgccaatctgggcctgcagtggcacgtcatcgccatgtacggcccgagcttcttcaccgggcggctgatcacgcgcttcggcgcgtcccgcgtggtggcgaccggcctaaccttgacgggggcggccgcgctcgtcggactcgcgggcgcgcacgtcgggcatttctggctgtccctcatcctcctcggcgtcggatggaacttcggcttcgtcggcgcctccgcgatggtgctggactgtcatcgcccggaggagcggacgcgggtgcagtcgatcaacgacttcatcgtgttcgggatggtggcggtcggttcgttctcgtccgggggcctgctcacgagctacggctgggacacggttctctgggtgtccttcgcgcccttggcgctggccgcgacggcgctcgcgctcacgacagggcgcagcgcgaaggcgtggtag

SEQ ID NO: 6477 - DNA, 678 bp, Methylobacterium sp.
atgaagaaccggaccatcgcgggttcgatcgggaccgagatccggcggcgcatcctcgacggccgctatccggccggctcgcagctccgccaggacggcctcgcggcggagttcggcgccagccggatcccggtgcgggaggcgctgttccagctcgaggccgagggcctcgtgcggatcctgccccatcgcggggccatggtggcgccgctctcgccggcggacgcggccgaggccctcgagctccgggccgccctcgagccgcgcctcctggccctctcggcgccccgcctgaccgacgacgactacgcccgggccgacgccctgctggaggagtacgccgcggccctgcgggcgggcgcgacggcgcgctggggcgccctcaacacggagctgcacctcctcctctacggccgggcggagcggccccgcgccctcgggctggtcggctccctgctggccgagtgcgaccgctacacccgcctccagctctccaccgacagcgcggagctggagcgggccgaccgcgagcaccgcgagatcgtccggctctgcaggaacggccacgcctcggccgcctgcgccctcctgacggaccatatcgaccacgtcgccgcggcgctgatggcgttcctcggcgccgcgccgggcccggcccgcgcgacagatattgtataa

SEQ ID NO: 6478 - DNA, 333 bp, Methylobacterium sp.
atggctgcgggctacgtggtcgcggcgttcttggaggcggccgggctggccggcctcgtgatcgccgtgctcaagatgcggacggagcggcgggcgcgggccgcggacttgcggagcttccttcgctccggacagatcccgaccgtcgagatcggggtgacgcgccgtcccgcggacgctgccgcgcggctgatcgccgtcccgtacacgaccggccggggcggcgctccggaggctcggccgtcggccgcccgcgcggcgctccgacgcgccttcacgtccggcggcgcggcgccgcgggccgggctgaccggcgcgatcagcgcaggatga

SEQ ID NO: 6479 - DNA, 2862 bp, Methylobacterium sp.
gtgacgggcaccgtcttctcgcgttccctgcgcgcgcgcctcgtcggcgccacgctctcgacggccgcgatcgcgctggcggcgttggttttcctggtggttctgcgctccggccagacgctccgcgagcaggcgcaggaggtctcgacctggtccgaggcccagctctccgaccgcctgctgagcgacgccaagctcgccgcggcgcggctgcaaatgcagcgcgaggacgtcgagcggcgcttcgccacgatgtccaagcgctgggacgtcgcgaaggcggtcttctccggcaacacggtggcggcctcggagcttctgcggccggcgctcgccctcgccgatctcgacggcgccatcgccttcgacctcaatctccgggccttgaccgccgaccgcgtcgaggcggacctcctcgccgccaacgcggctttccggacgtcgcccgtcgcggcgtccctgcgcgccgtgctcgcccgcaacgatcgggagcacgcggacggcttcgtgatgtcgctgcgctgggacgacgcgctcgcccgggcgctcgcagccaccgagagcggcacagtcgccgacgtcttcggcgagccgctgttcgacgatttcggcgaggtgatcggcggcctcgtcgggtatcgggtcctgcgcgcgcacgagccgaccctcacggccttcgcgtccctcagcaaccgcgacgtcctgatcctcgccgaccagagcctactctcctcggcgggctcggaggtctccaacgcccagctcggacccccgtcgggcgctgagctgcacgacgtgctcggcgccgagaaggtcgcgcgctgcatcccgcagccgcccgacatccgcctctgcgtcgcggcgccgctgcgggagctgcagcaactcaccggcaaggtcgtgggcatcggcgaggagagctcgcgctcgctgctgcggacgctcagcgtcgtcgccggcctcacactgtgcctcgtcgccgtcgtcatgctctttctgtcgagccggatcacccgtcccctggtgcgcatcacccagacggtctccgaggtcgcacgcggcaactggcacgtcagcgtgcccgatatcgaccgcgccgacgaggtcggcgatatcgcgcgggccgtcgtcgtgctcgagcattccctctcggagcgcgatcagctgcgcgacgacgtgttccggcagaacacggtcctgacggagcgcgagcggcagctgcaggagcagaacgagcgcttcgacgccgccctgaacaacatgtcccagggcctctgcatgttcggcgtccacggccggctcaaggtctacaattcccagttctgccgaatctacgggatcgccccgggcgtgctggatctcgaaccgacacaggatgaggttcaccggctcgccggtctcacggactggtcggccgcggagagcgggccgatccgccgaaccctcacccggacgctcgccgacggccgctgcatcgagatcacggtcgagccgatggccgatggcggctgggtggagacccacgaggacgtcaccgcgagcgtcaccgcgcaggcgcggatcgcgcatctcgcgacccacgacgcgctgaccggcctctcgaatcgagcgctcctggccgaccgcctggccgccgccttcgcggaccatgcggtcggcggccgggcggtgaccgtcatctgtctcgacctcgacgacttcaagggcatcaacgacaccctcggacatccggccggcgacgaactcctccgacaggtcggccgccgcctcaccggactgtgcccgtccggcggcacggtggcgcgcctcggcggcgacgagttcgcgatggtcctcttcgaggcagacctgccggacggcgtcctcgccctggcggagcagatcctgatccagctcaggcggccgttcttcctcgccggccagttcgtggccgtcgacgggagtctcggtatcgccgtctccggcacggaggatgccgacggcgacgatctcctgcgccgcgccgacgtcgccctctacgccgcgaaggccgacggcggtcggcgcgtccgcgtcttcgagcaggagatggaggagcgtcagaaccagcggcgctggctggaacgcgagctgcggctggcgatcggcaccgcgcagatcgagctgcactatcagccgctgttcgacctggcgacgaacgcggtgacgagcttcgaggccctcgcgcggtggcaccacccggaacgcgggatgatctcgcccggcgagttcatcccggtcgccgaggcgacggggctgatcgacgccctcggcgcttacgtgctcgaacgggcctgcgccgatgccatgacatggcccggctccctgcgggtcgccgtcaacatctcgccgatccagttccgcgagggcaatctcgaccggtttgtcgaggaggtcctgctgaagaccgcgctgccgagccaccgtctcgagctggagatcaccgagtcggtcatcctgagccaggatcaggcgagcctcgagatgctgagccgcctgcgccgcctcggcgtgcgattctcgatggacgatttcgggaccggctactcgtccctctcctcgctgaacacgttccgcttcgacaagatcaagctggaccagtccttcgtccggaaccttctggagaaggacgaggcagcggcgatcgtccacgtcgtcgccgaactcggccgcagcctgaagatcacgacgacggccgagggcgtcgagaccccggagcagctggcccggctgcgggcgagcgggttctcggaggtccaaggctacctgctgagcaagccgattccggccgccggcgtggcggccttcatcaacgcgcaggagcatatccacgtcgcggcctga

SEQ ID NO: 6480 - DNA, 810 bp, Methylobacterium sp.
atggcactgttattcacgtctcttcggcgcgtcatcgcgggtggaatcatcctccttgccctgccggccgccgcgcgcgcggacgacctcgcggtcgtcggcacgggcgacgggatcgagatgctccaggccgtggcggccgcctacaatgccgagagcggcgacgcacgcgtgtcggtgccgccgagcatcggttccggcggcgccgtcgcggccgtgggcggcgagcgccagaggctcgggcgggtcgcgcgcccgctcaccgaggccgagaaggcccagggactcgtggaggtgccgctcgcccgcatcccctcggcgatcttcgtccatcagggcgtcggcgtcacgaacctgaccagcgcgcagaccgccgcgatcttcgccggcacggtcgacaattggagcgccctcggcggccccgatctcaagatccgcgtcgtccggcgcgaggagacggacagcacgctcacggtcctgcgagccaccatgccgggctggcgcgacctcgccctgaccagccgctcgaagaccgcgaccacgacccaggacgcgatcgccacggtgcgggagacgcccggcgcgatcggcttcggaccgtactcgccggcgctcgcgggcgatctcgcggtcctgacgatcgacggccgggccccgcgcgatccggcctatccgagcgccgtgaccctcgcgctgatctacaaggccgccacgcgcgacgccgcggcgtcggcgttcctcgccttcgcgacctccgatcgcgcgggacaaatcatggcggagcggggcggcaccccgctcaggccgtga

SEQ ID NO: 6481 - DNA, 1038 bp, Methylobacterium sp.
atggccgatcgcgtcaccctcgtcatcaacggaaggcgggtcagcgccagcgccggccagaccctgctcgacgcgggtctggcggccggccaggcgatcccgcacgactgcgccaccgggcagtgcgacacctgccgcgtccggatccatgcgggcgcggtcgacgatgcggggacgcgcatcggcgagaccgtgcaggcctgccgggcccgcctcaccaccgacgcggtcatcgagttcgacgaggttccggaaaccgtccggcggaccggcaccgtggaccgcgtcgtcgatctcaccgccgagatcgtcgaggtgacggtcgcgctgcgcaagcggctgacctacctgccgggccagtatgtccgggtctccttcgccgggctgcccgcgcgggactacagcccgaccctgcgcgcggacggatcgggcgaactgaacgaattgatcttccagatccgccgccagcccgacggcgcggtctcgccgctgctcggtggcaggatcggaccgggaaccgcggtgaaggtcgagggcccgttcgggaccgccttccaccggctcgggcgcggccgtctcgtgatcgtctcatcgggcgtcggctgggcgcccgcctgggcggtcgcccgcgcgagccggatgcgcgagccggagcgcgacctgctcgtcgtggccggcgctcggcacccgcagaacctctacatgcgcccggcgctcgactggctgcgcgagcggggggcgacgacggtcctgacctgcagcggcggcaacccgcctccggatgcccggcccgggcggccgacgctccacatgccgatgctcacgcgcgacgacaccgtcctcgcggccggcgcccccgagatggtcgcggctgtccagttcctcgccgcggcaaccggggcgacctgctacgccgatcccttctacgcggccgcgcgcggcgcggacgggaagccgccgtccgacacgaacttccttcagcgcttccttcagcgcgtcgcgggtcatcggaccgctaaaacggagcctgtcgcctag

SEQ ID NO: 6482 - DNA, 1773 bp, Methylobacterium sp.
atgtcggaaccgctgaccctcgcgccgcatccgcccggcggagccgagaccgcccccagctggcgcagcgcgcccgccgtgcaggtcgaccggcatccccgctccgatgtcgggacgatcgtgatccactgggtggtcgccatcgccatggtggcgagcctgctcacgggcctgcgcatctcggccgacgcgcccgtggcacggaccgcgaagttcctggcgcccctgcttccgcaaggggaagtctggaccgtccacttcgtggcgggcctgaccctgttcttcggcatcaccgcctatctggtctacctcgtgcgcgggcgtctcacggatcgcaacggcctgtcgcggctccgcgccctccgtgtcagcgggcgaagcagggccgcccggaaggcccggtggggcggcatcaacgtcgcgctgcactggctgatctacgccgtcacgctcgtcctgacgggtaccggggtcgcgctctacctcggctacggcggctgggtggtctggctgcacgccacctgcgccctggtcgccctggcctacattgcggtccataccctcgcgcacttcatgtacggcggcctgtggcagctcctgcggctgttccgtccggcggccctggcggacggtgcggcgcggcggcgacgcccgctcctggcggcggccgtcatcggcctccccgtcgtcggcggcctcgccttcgcggacgtgaagggccgttccacgctggtgatcgacaaggtgacggccgggcccgacctgtcgaagctcctcgacgacccggtctggcgcaccgcgcgccccgtctcggtccggacgatacagggagccaatttcggcgggaccggtgagacgaccgtcgagatccgcgccgtgcgcgacgcgacgaacgtgtatttcgccttccgctggtgggatccgtcgcgctcgctcaagcgcgtcccgatgatcaagaaggccgacggctggcacctcctcgacgcggacgcggcgcgcgcggacgtgaccgcctactacgaggacaagctggcggtgatcttctcgcggtccgacgcgttcggcagcggcgggtcgacccatctcggcgcccggcccctgcccgacgcgcccgccccgctcaacggccgcggctaccactacaccaccgacggcagctacatcgacatgtggcagtggaaggcggcccgcggcggcatgctgggcgtcgtcgaggacatgcatatcggcccgcccaccgaccccaccgccgccgagcgggccgtgaagggccgctaccaggccggttactggggcgatcccggcaccagcgcgtaccgctacaacttcaagttcgagggccccggcggctacgcgggcgcggtcgagccgctgcggcttcccaaggattggcaggcgacggtggccaagctcggcaccgtggatctggacttcgatgccagcacgtcgccgggctcggcgtggtggatggtcgagaagaccgagacggtgccgtactcggcggccgccgacgcggagatcccggtcgggaccgtgatgccgggcgtgctcatgaccgacggctatacgggggaccgcgccgggatctcggctgccgccgactgggccgacgaccactggaccctggtcgccgcgcgcaagatcgcgaccggcagcaagtacgacgtcgatttcctgcccggaaacaccttctacctgtacgtctcggccttcgatcacacgcagacgcgccacacgcgtcacatgcggccggtcgaagtccttctgcgctga

SEQ ID NO: 6483 - DNA, 2289 bp, Methylobacterium sp.
gtgaacgcccacgcccgcaccgtccggaccgcctatgccgtcgcgttcctgcaacggctcgacctgcatggccgccaccacctcaccgcgctcgatccggagacgggcgagatcgaggcgcgctatttcccggccgagagctggggcgagatcgccgcgtggatcgaggcgcgggcgcatcgcaacctgtactattcggtgaacgagcccatcccggacgcgccccacgcgaagctgcggaaggagcatattgctcgcatccgagcgatcgtcgccgacttggacccggcgggctcgacgcccgaggagacccaggcctcgcgccacgagctgctcgaccgggcgcacgagctggccgacgacagcgagcacccgccgacgctcacggtggacagcggcaacggcgtgcagttcgcctggatcctgcgcgagaagctcaacccggcgatctaccggatcgacgcggaggatctcggcgccggcatcgcggccgcgctcgacggcgacgcggtgcagaatatcgaccgcatcatgcggctgcccgggacgatcaatcactcggcgccgaagaagcgcgcccgcgggctgatgggcgggccagtcacgattctcgacgactgctcgcacccggaccgggtctacacgatcgaggagctggagaccgagtacgatccgatcaccggcgcggaccagaaggaccgggacgcggccgtccaggctgcgatggacgatctggactggaacaccgccgaggccgggccgggcgccgagctggtggcgcgcatgaaggccgacgccgaggccgacccctacttcaagggcctgctctcgggccgcttatcgagcgccccgggcgacggctcgggctcggcgtggcgcgccgccctggccggcgccatggcgcgcaagggctacgagctgaacgactatgcggccgtggccttcgtctacccgccgggccagcccggcaacggcggcccagtaacgctgcgcatggtcgcccgggattgggcccgcgtcggcaaggccgcccaggccgcggcgcccaaagcggccgagatgttcgtggcgatcgaggccgagcccgacaccagcatgttcccggcgcccgtgccggagagcttcgacacctacgacctgctcgccagcaccgcgccggcccccgtgatccagttgatcgacccggccgactggtatgggcgcgagcccaatgtgaaggagtggtacgtcgaggccttcgtcccgcgcggcgaggtcacgatgctcaccggcaagggcggcgtcggcaagagcctgctcgcgctccagctcctgatcgccgtggcgctcgggatcccgttcctggggctccagacgcgccgggcgaagtgcctgggcttcttctgtgaggacgatccggacgtgctgcacgcccgcgtgcgggacatctgccgggctctcggccgcgacgagcgcgagctgtcgggctggctctatcttgtctcgcgcaagtacgacgacaacctgctctgcaccttcgaccgcaacggctctggtgtcgttctccgggcgacgcccctgttcgaggagctggtgcgggtcacgaaggagctgggcgtcgagctgtcgtgcctggacacgatcgcggacatcttcggcggtgatgagatcaaccggcagcaggtccgccagttcgtacagggctgtgcgggccggctggccgcagagacgggcggcgcctgcctgatgctcgggcatccgtcccgggctggcgagcagaacggggagggtacgtcgggctcgacggcgtggcacggctccgtgcgctcgcgcttctacctcgaccacatcggcgacgaaggcgggctctaccgcgagctgacgaccaagaagtcgaactacggcccggccggggcgaaatggaagctgatgtggaaggcgggcgtcttggaggtggtgacggcgagtagggccggttcggagggggccccagagatcacgggatcgctccaccgcattgtgcttgacgccgtggcgaacgccaacagcgacggcgtgcgcctgggcctgggcaagacatcgaagttcaaggccgagccgactctgcggcgccgcgagcctgggcccttggcgccctactcggccgaggaggtcgaggaagccctacagcagctcgtcgcgctgggcgcgatcgtcgaggccgagatcggtcgggacagctcgcgacggccgatcatgtcgctcaaggcggtggccgagacggccggtgaggcggacatttcgtccgaagaaggcggcctgttcgactga

SEQ ID NO: 6484 - DNA, 2253 bp, Methylobacterium sp.
atgtccggcctggagatcgacttcgagacgcgctcgcccgtcaacctcaaggtcgagggcgtctaccgctacatggagcacccggagacggcgcccctgatggcgagctacacgatcgacgggggcccggtccgccgctggcgcccgccggagccgtgcccggccgacatcgtcgcccacgtcgagaagggcgggacgatcgtcgcgcacaacgccggcttcgagcggctcctgtggcagatgatcctgtcgaagcgctacggctggccggcggttcgcctccggcagttccgctgcacggccgccaccgccgccgccctgtcgctcccgcgcgacctggatgggcttggagtggtgctcaacctgtcggtccagaaggacaagatgggcaagacgctgatcgaccgcttctcgaagcccaggaaggtcacgaaggctgacgtggagcgctaccagggcaggcccatgccggcgctctttcacgagccgggcgacttcccggaggagttcgagcgcttccacgactactgcgacgtggacgtgctgacggagcaggcggccgatcggcgcatgatgccgctccggaccgaatgccaggaggcctactggcggtccgagcagatcaatgaccgcggcctgcggatcgacgtggagagcgccaaggccgcgctgctcctggtcgaccgggcgaagcttcggctcgatcgcgagatgcggcacctcacggaaggggaggtcgaggcctgctcccaggtcgccaagctcaaggattggtgcgcggtccggctcggccagggcccagcgatgcaggcggccctggagttcttcgacggcgtgctgccggaaggggagggcgaggagatcgccagcctgggcaaggccgacatggacgacctgctggagcgcgaggatctcccgccggccgtccggaaggcgctggagctgcgccgcgactacgccaaggcctctacggccaagatcaaggcgttcctgtcccgcgccggccaggacggccgcatccggggcgcgttcctgttccgggccgccggcaccggccgctacagctcgacgggcgcccaggtccacaacctgccgcggccccgcaaggtgttcgacgacgcgcacctcgacccgcgcgacctgttcgaggcgatccggaaggcgaacgtcgagtggctggagatgctctacggcgaggagctgggcaagccgctcccgctgctctcggacagcattcgcggtttcatctgggccgacccgggcaaggagctgctcgctgcggactacagcggtatcgagggtgcaatccaggcgtggtttgccggcgaggaatggaaggtcaaggcgctattcgacctgatcgccgacccgagcctgcccgatatgtaccggcgggccgcggccggcatcttcaacacgaccacggatctgctgacgaagaaggacaagcgccggcaggtcggcaaggtgtccgagctgagcctgggctaccagggcggcgtcggcgccttccggagcatggcccggaactacgccatgaagctcgggcccatcttcggccctgcctgggaagccgcggacccggagcgccgcgagcgcgccgccaagcgctacgaggagtgctgcgaacgcggcgagctgctgacgaagcagctcacccgggaggagtggatgggcgccgagctggtcaagatcggctggcgcgccacgcacccggcgatcgtcgcggcctggaaggccctggaggaaggcacccgcgaggcggtctcgagccccgggacgcaggtccaggtgctcaaggtgtcgttgctggtcgcccggggcttcctctggtgcaagctcccgtccggccggtgcctcgcctacggggcgccctcgatccgcgaggtggaggtgccgtgggccgacaaggccctgacgccggagctgcgcgagaagcgcccggtcgtgacctgcctgggcgtcgacagccagacccgcaagctggtgcgctacgcgctctacggcgggctcaccttcgagaacatcgtccaggccatcgcgctcgatctcctggacaacgggatcgagatcgccgagcgcgccggctaccccgtggtcgggcacgtccacgacgagatcatcacggaggtgccccggggctggggcgatctcgcgtggttcgagaaggcgatctgtgaattgccgggatgggcgtgcggtctgccgctgactgctggcggatggcgcggcaaacgctacagaaaagactag

SEQ ID NO: 6485 - DNA, 243 bp, Methylobacterium sp.
atgcccggcctcgccgaggatgactggctgatctactacgaccagcgtgtccgcggtttgcccgatgagtggatcggacagctctgcgttgtgtggatctcggaggacgaggtctatgtgaagaaggtgtttcgcggacgcgacagtggcccgtatctcctcgtctcgacaggcggattgccgcctatcgaggtcgaggaaatcaactggtccgctaaggtcgcgtggatcaagccgcgctag

SEQ ID NO: 6486 - DNA, 966 bp, Methylobacterium sp.
atgaccgcagctgccgcgacgatgccgtcctcggccgccgggatcacgcgatccgccctcgatctgatcggcaaaacgccgctcgtcgccctcgaccgcgtccatcccggtccgggccgcctcctcgcgaaggccgagttcatgcagcccggcggcagcgtcaaggaccgcgccgcccgcgccatcctgctggccgcgcgcgcggacggccgcctcgccgcgggggcgcccgtggtggagatgaccagcggcaacatgggggccggcctcgcggtggtctgtgcggccctggggcacccgctcgtggtcacgatgtcggccgggaacagtctccagcgcgtgcggatgctcgaggcgctcggggcggaggtcgtgcgggtgccgcaggttgacggcgtcccgggtcaggtcaccggcgccgacgtgcgggcggccgcggacgcggcggagcgcgtcgcgaccgagcggggcggcttctacgtcgaccagttccacgcgcctgagggcgtgcgcgcgcatcgcgagacgaccggaccggagatctgggcgcaattgtccggccgggtcgatgcctgggtggcggccgtgggcacgggcgcgaccttcctcggcgtggccgcggccctgcgcgcgcgcaacccgtccctgatctgcgccgcggtcgagccggcgggctgtcagcccctcggcggattgccggtcacgaagcaccggcacctgatccagggcaccggctacggcagcgtcccgccgcactggacggccggcctgttggacctgtccatcccggtgaccgacgcggcggccgaggagtggcggcgggccctggcgacgcgggagggcctacatgtcggctactcggcggcggccaacgtcgcggcgacggtcgcgctgctgtcgtccggacacctcccccgcgacgcgaccgccgtgaccgtcctctgcgacaccggactgaagtactag

SEQ ID NO: 6487 - DNA, 786 bp, Methylobacterium sp.
gtgtcgtccatgaacttcgtgaccgggaagacgacgtccgtccgcgccgccgagccgggccgcaagcgggcgcggaaggccgtgaaaggggcgtcccagggggcttcccaggaggcctcccacgccgcgggcggcgacgacgatctgcccgacctgacgctgaccgaccgggcctaccagcagctggaagagatgatcacgaccctggtgctcccgcccggcctcgtgctcggcgagcagaacctggtccaacggctcgggatcggacggaccccgattcgggaagccctccagcgcctcgcgcgcgacgggctcgtcgtggtcatgccgcggcgcggcatcctggtgtcggacatcaacgtgcgctcgcagctgcggctcctggagacgcggcgcgtcctggagcgcctgatcgcccgcctcgcggcggagcgttccacccgggaggagcgtgaggtcttcgcggggctcgcgcaggacatgcgcgacgcggccgcggcgtcggacgatctggcgttcatgcgcctcgaccggcagttcaacgagctgatcgcgacggcctcgcgcaacgagttcgccgtgcgctcgctggagagcatggcgggcctgtcgcggcggttctggtaccagcactacaagcaggcggccgatctgccgctgaccgccaacctccacgcggacgtctgcgaggcggtcgcgcgacgcgacgtcgaggctgccggcgccgcgtcggacaagctcgtcgactacatcgagagcttcgcccgcaagacgttggatctctga

SEQ ID NO: 6488 - DNA, 558 bp, Methylobacterium sp.
gccgagccggtggcggcgcttcttcgggattggaccgcggccaacggcctctgccgcggcggctccggcgacgatccgcgcacgcaggcggcctgcgagcggcgcgacggcctcgatcgccggctcgccgccgcgggctggtgctacggacgcccggccgacaccggcgcccagagaacctggcagccctgcggcgtcggcacgcgacagcctgcacaggccgggacggagaccccgcagggcgcggcgcggcgcgccctgctcgatgtcgcccgcggccccgcggaggccgggcggggacagccggtgcagttcgtcgtgcacgccctgaaccgagtcggcccctgggccttcctcttcgcgcggatgcagcggcccgacggtcgacccctccctcgcgccgcggacgatctggactcgaacgactacgccgcgctgctgcgccaggacggaaacggctggcgggtcgtcgacttcgtcgtgggaccgaccgacgtcgcgtgggaaggctgggaccggcgctacggggcgccggcctccgtcttcgcggtccgctga

SEQ ID NO: 6489 - DNA, 1293 bp, Methylobacterium sp.
atgaagcgactggacgtggccgtcatcggcggctcgatcgccggactgaccacggcgtgcctgctcgcgcggagcggccacgccgtcacggtgttcgagcggtcggcggccgcgctcacgggccgcggggcggggatcgtcacgcatcccggcctccgggcggtgctggcgcgctgcggtgctccggccggggcgggcgatctcggcgtcaccgtcgagggccgccgggtcctcgaccgggacgggaccgtgatcgcgcagcggagcctgccgcaggtgctggcgagctggggacggctctacggcctgctcctggacgccgcgcccccggacagcgtccgctacggcgcggcgctcgccgcggtcgagcccgacgacgcgcgcgtcgtcgccttcttcgaggacggtcgccggatctccgcggatctcctcgtcggcgccgacgggcagttctcgacggtgcggtcacggttcctgagcggtgtcgcgccgcgctacgccggctacgtggcgtggcgcgccgtcgtcgacgcggcggccctcgcgccggcgacccgggaggcgatcggcggccatttcgcgttctgcctgcctccgggcgagcagatcctcggctatcccgtgcccgggcgcgcggacggggccgccgccgggcggtgcttcaacgcggtctggtacaggccgaccgaggaggccgcgctcgccgcgctgctgaccgataccggcggcgtccgccacgccctctccatcccgccgggccgcatcaaggccgcggtgctggactcgatgcgcaccgacgcggcgcggatcctcgcgccgcccttcgccgaggtcatgctgcgcgccgagcagccgttcctgcaggcgatcctggacatcgagacgccgaccatgatcccggcgcgcggcgtcgccctgatcggcgacgccgccttcgtggcccggccccatgtcgggatgggcgcgaccaaggccatggaggacgccgccgccctcgcggacgccctggacgcggccggcggcgacgtggacgcggcgctcacggccttcgaggcgcgccgacgcgcctacggcgcggccgtcgtggcgcggggacgcgatctcggcgcgtacctgcaggcgcagcagcgcggcgcggccgagcggacggcggcggagcggttccgcagccccgaggcggtgatggccgggacggcggtcccgcttaggccgcgcggcgggtcgcctccgcgcgcacggcggccgggagcgcgaggggcgggttcgcgctgtccaggaactcgacggtggtga

SEQ ID NO: 6490 - DNA, 324 bp, Methylobacterium sp.
atgccgaagcgcctcaccatcaccgtcccgcacaaccttggagctgccgaggtccggcgccggatcgaccggcatatggactgggcatttcggcgcctggagaaggagaagatccaggttgaggccgaggactggttcggcaatcggcgcgcgttctccgggacgggctacggccagaaggcgagcgtcgcgatccaggtggccgaggacgcgctagaagtcgaagcgctggtgccttggatggtcggcatgttcgccccggtcatcgaagcgatcggacggcactacgcggggcggctgctctccgacgaaggcgcatcctga

SEQ ID NO: 6491 - DNA, 321 bp, Methylobacterium sp.
atgccgaagcgcctggccatcaccgtcccgcacgacctcgggacagccgaggttcgccgccgcatcgacctgcacatggactgggctttccgccgcctggaggcggagaagatccgcgtcgaggccgaggactggctgggtaatcgccgctccttctcgggcagcggctacgggcagtcggcgcgcgtcgccatccaggtggcggatgacgccctggaggtcgaggcgctggtgccctggatggccagcctgttcgcgcccgtcatcgaggcgatcgggcgccactacgtcgggcgcctcctgtccgacgaggccgcctga

SEQ ID NO: 6492 - DNA, 987 bp, Methylobacterium sp.
atgatcgaattctgggccgccgccctcgccctcaccctgatgctctacgtgctgctcgacgggttcgacctcggcgtcggcatgctgttcgggatcgccccggacgagaccgcgcgccggcacatgatgcaggcgatcgcccccgtctgggacggcaacgagacctggctggtgctcgccgccacgatcctgttcggggccttcccgacggtctacgcgctgctgctctcggccttctacctgccgctcctcctgatgctcgcggccctgatcctgcgcggcgtcgccttcgagttccgctacaagtcccggcggctgcggcgggtctgggacgcgggcttcgtcggcggctcggtctgcgcggccttcgtgcagggcgtgacggtcggggcgctcgtgcaggagctgccggtccgcgacgggctctatgccggcggggcgttcacgtggctcacgccgttctcgctgctctgcggggtcggcctgtgcctcggctacgcgctgctcggcgccgcgtggctgtgcggcaagaccgagtccgacgtgcgcgacctcggcttccggctgctgccgcggctcctcctgggcgtgctggtcttcctcggcgctgcgttcttctacgccctgtcgatgaacctgcgtgtgctgcaccgctgggtcgagcggcccgagatgctggtcctgccgctcgtgggggccgcggcctgcgccgggctcctctacgcggcgcggcgccggatcgacgccctgcccttcccgctggtggcgctgatcttcgccgccgccttcgccacgctcgccgcctcgttcctgccctacatggtgccgttcagcgtgacggtgaccgaggcggcggcgccggaggcgagcctgtccttcatgttctggggcgcggggatcgtggtcctgccgatcaccctgatctacaccctggtggtctaccgggtgttcaaggggaaggtcgacatcgccgagcactatgactga

SEQ ID NO: 6493 - DNA, 1413 bp, Methylobacterium sp.
atggacatctccgccctgatgctctcgcgcatccagttcgccttcacggtgtcgttccacatcatcttcccggccttcacggtcgggctggcggcctggctcgccttcctgcaggcgcgggcgatgatctcgcgcgagccggtctacgaccgcctgttcgacttctggctcaagatcttcgccgtcgccttcgggctcggcgtcgtctccggcatcgtcatggcgttccagttcggcaccaactggagcgagctcgcccgccgcaccggcccgatccaggggccgctcctcggctacgagagcttcacggccttcgcgctcgaggcctcgttcttcggggtgctgatgttcggacgcaggcgggtaccgcgctggttctacctgttcgcctgcctgatggtctgcctcggcaccagcctgtcgtcgttctggatcctcgtgaacaactcgtggatgcagtacccgaccggcttcgcccagcgcccggacggcgtgttcgtgccgacggactggtgggcgatcatcttcaacggggtcgtctgggtccgcttcccccacatggtcctggccgcctacgtcaccaccagcttctgcgtggccgcgacgggggcgtggtacatgctgcgcggcagcgaccggatcgaggcccgcgccatggtgcggatggggctcggcctcgccgcgatcctggtgccgctgcagctgttcttcggccacctcaccggcgactacgtcgtcaagcaccagccctcgaagatcgccgccatcgagggtcactgggagacgcagaagccggcaggcgaaatcattatcgcctggcccgacgaggaacaggagcgcaaccattttgaattggctctgccagcccctgtcggcagcctgatcgacgcgggcaacaccacctcggccgtgatcggcctaaaagcgatcccgaaagccgaccggccgccggtgctgatcccgttcttcgccttccgcatcatggtcggctgcgggctgctgatgctggcgctggcctggggcgggatggcgttctacgccaccgggcggctggaacgggcgcgctggctgcaatgggcgatcttcctgtcgttcccgctcggcttcgtcgcgaccctgaccggctggttcaccgccgaggtcgggcgccagccctggacggtctacggccagctgcgcaccgccgacgcggcgacgccgttcctggccgcgccgcaggtggcgacctcgctcgccgtgttcggcgcggtctacgcgctgatcttcgcggccggcaccgtctacatctaccgcatgctcaaggccggcatcctgccgaccccggccggtgcggggagcgccgccaaccccaaacggccgctcgccgtgccgggcaatagtcccggaacccccagcagcacaccggcggagtga

SEQ ID NO: 6494 - DNA, 1347 bp, Methylobacterium sp.
gtggacgggtcgatcgcggccgtcacgcggcggctcgattccctgccgatgacgcggcttcacgcggcggcgctcgccgtctgcacgctgggcctgttcaccgacatcgccgaggtcgccctgagcaacgccctggcggccatcttcctcgcgccgccccacaacatgccgcggggcagcctctcgctgctgctcgcctccgtgttcgccggcggggccgtgggcgcgcccgtcttcgggatgctgggggatcgcctcggccgcaggcgcgcgctccaggcctccctcgcgctgatggccgccggatcgctggcggcggcggcgagccaggggctcacggcgctgacgatcgcccgcacggtctcggggttcgcgatcggcggggtcccgcccctggtcgccacctacctcgccgaggtgacgcccgcgcgccgacgcggcgcgacgctgctggtctgtgccggaatcgggctcctcggcggcctggccgccatcggcctggtccagatgatggccccggccgcaccgctcgggatcgagccgtggcgctgggcgctgatcctcgggggcgccctggcggcgctcggcggcctcctgttcgcgcggttgccggaatcgccgcggtggctcgcctcggtcgggcgctccgccgaggccgacgccgcctgccgccggttcgagcgcgcggccggccggatgcgggtcgccgcccccggcggcccgcatccggcgccggccacgaccgggcccgcggggttccggggcctgttcgccgagacgcgccagctgcgccggacggccctgttcgtcggcctctacaccctcgcccccctggcgacgatcgccttcccgctgctcagcgccgtcgtgatggtggagaagggcttcaaggtcgaacaatccctcgtcttcgccgcgctgtcgatgctcggcccgcccctgggcaccctgctgaccgcgctggtgatcgaccggctggagcggcgcgctttcctgacggccctggcggcggcgatggcggccctcggcacggccttcgccgcgagcggcacgttcctgaccctggtcctggtcggcatcgccttcaacacggcggcggcgacctacggcagcatcctcgccgtctacgcgacggagctgctcccgacgccgctgcgggcctcggccatgacctgcgcctgggccggcggccgggtcgcggccgcgctggcgccgatcatcctcctgccgatcctctcggcctacgggccgcacgcgatgttcgcggtgatcacgctcgtcctcgcggcgagcgcggccctgctcctcgccggaccgcgcggcctgtccggtcgggccgttgcttag

SEQ ID NO: 6495 - DNA, 408 bp, Methylobacterium sp.
atggtggctgcccccggaccgatcctggccggcgccctcgtggtcgccggtctcgggttcgcctccgccgccgaggcgcagatgccgacgcgggtcggcacgtgcgcggcgaccaccatcgcgctgatcgggacccggttcagcgacacgctcgtgaagccgaagggcgacgggatcggcgacgggacgagcgtcgatctcaagaacggcgtctacggcgtctcctacgcgtatgtcgaagcggtcgcgcggtcacgggtcggcgaccgggtcatgacatgcctcgttctcctgccgacgggctgccccaagggcgacgatcgcggcaagatgtacacgacgaccaacctgcgcacgctggattcctggactttgcccgactcccagcacatgtgcggcggggcctga

SEQ ID NO: 6496 - DNA, 1281 bp, Methylobacterium sp.
atgcacgacctctccgatcccgtcaccctcccggccggcaccgtcctgttcgaggagggggcgatcgggcactgcgcctacctgatcctgagcgggcgcatcgcgatcttccggcggcgcgacggcggcgaggccgtgctcgcccggcgcggcgccggcgagatcttcggcgagatggccatcctggacgccctcccgcgctccgccggcgcgcgcgccgaggcggatagcgtgctcgtcccggtggacgcggcgcagatccgccggcggctcgccggcgccgatccgatcctgcgcctctgcctcgaggggctcatcgcccggttccgcgagaccctgccccgcctcgggccggcggtcgccgaggggcttccggcaccgccgtcgcccgccgcccgcgccgatttcgacgcgacggtcgcgtcgctcgcgcaggagcgcgccctgcggcgggccctggcccgggacgagttcgcgctgttcctgcagccgatcgtgcggctcgccaccgggcgcctcgccggcttcgaggccctgatccgctggcacgatcccgagcgcgggctcgtgccccccgccgccttcattccggccgccgaggcgaacggcctgatcctggcgatcaccgcctgggtgatcgacgcgatcggccggatcgtgccccgcatcctgcaggccggcctgcgcgcgcccgcctccgtcgagccctccctgttcgtgagctttaacgtcacggcccaggatctcgcccgcgcggacataccgggcctcgtcgacgcgatgctgcgccggaccggcctcgcgcccggcgccctcaagatcgagatcaccgagagcgcgctgatgcaggatccggccggggccgcggccgccctcgcgcgctgtcgcgccgccggcctcggcatcgcggtggacgatttcggcaccggctactcctcgctcagccatctcagcaccctgccgatcaccacgctcaaggtggaccgggccttcgtccgggcgatgctggcggagccgcgcgatcgccggatcgtccagaccatcctgcggctcgccgaggagatcggggtggtggcggtcgcggagggcatcgagggccgcgccgaggcggaggccctcgcggcgatgggctgcgccctgggccagggctaccatttcggccgcccgatgccggaggccgacgccctcgcggcggcggcggcctggaacgccgaggcgtggcgcgtcgggctctccggggaggctgatccggggcggcacgggttccacgcccgggcctga

SEQ ID NO: 6497 - DNA, 192 bp, Methylobacterium sp.
atgtccgacgacgacggttttgaccgcatggtggaggcgacgatcctggcccatcaactcgtggccgcgcacggcacggcgacgatgcagctcctgtcccgattgctgctcatggagatcggtacggagatcgcggcgcggcgcgatcccgatccggccgccaacgacaatccggacgccctggaggattag

SEQ ID NO: 6498 - DNA, 1284 bp, Methylobacterium sp.
atgagcgtacgcgagaccctcgaggcccggctggcccggatcgccgcgggggacccggcggtcttcacccgcctctacccggagcaggcccgcgcggcggcggacgccgccgatgcgcgtcgccgggtcgggatctccctcggccccctcgacggcgcgatggtctcgatcaaggacctgttcgacgtggcgggcgagacgacgcgcgccggctcggtcctcttggccgacgcggcgcccgcgcggaccgacgccccggtggtcgcccgcctgcgccgcgccggcgcggtgatcctgggcaagaccaacatgtcggagttcgccttctcggggctcggcctcaacccgcattacggcacccccggcaacgccgccgatccggcgcgcatcccgggcggctcgtcctccggcgccggggtctcggtggggcaggggacgagcgacatcgcgatcgggtccgacacgggcggctccgtccggatcccggcctcgctgaacggcgtcgtcggcttcaagccgaccgcgagccgcgtgccgctggagggggcgttcccgctgtcctacgccctcgattccctggggccgctcgcccggacggtcgcggattgcgcggccgccgacgccgtgctggcgggcgaggagcccgcgccgatggaggcgctcgccgtcgccggcctgcgcatcggcgtgccgcggggcctgctgttcaccgagacggaggcgccggtcgccgaggccttcgagcgggcgctgtcccgcctgtcccgggccggcgcccggatcgccgatcacccgatcgacgaccacctcgccgccatggacgcggcgctcccggacggctccctcgcggcgatcgaggccgcggcgatccacgccgactggctggacagcgcggccgaccgctacgacccgcgggtgcatcgccgcatcgtggccggccggaatgcgacggccgcgggctacatccggacgatgcgtcggcgggccgcgctgatcgccgccttcgaccggcacctcgccccgctcgacgtgctggcgctcccggcgaccgccacgacggcgccgctcaccgccccgctggcggcggacgacgcggccttcctggcggccaaccgcctgatgctgcgcaacacggccttcggcaacttcttcgatctcaccggcctgtccctgccgatgccggacctgccccggccggcgggcctgatgctgctggcccggcacgggcaggaccgccggctcctggcgatcggggccgggatcgaggccgcgctggcggggtga

SEQ ID NO: 6499 - DNA, 291 bp, Methylobacterium sp.
atgtcgcgttcgagggttccggaggcgcagagccgccccgacgggacgggggtgatcccgtcccacgacacggcgatcctgggatcgggcgccgtcggcgcgggggcgatcggggcgtcggccctgggcgcgctggccctcggggccgcggccctcggcgtcgtggcggtcggcgccttcgcgatcggccgcctctcggtgggccgcgcccgggtcggcaccctggaggtcggttcgctggagatcgacacgctcacggtgcggtcggtgcggatgccggaccgcggctga

SEQ ID NO: 6500 - DNA, 288 bp, Methylobacterium sp.
gtgacgatgcctgatctccgctggaccgaggggccggtccactgcaccgacctcgtcgatgggaccggaaaggtcttcggctacgtcggtccctgcgccgcgggcacccgcggctacgtcgtccagtccgggtcggaatggccgccgcgccccgccgccttcgccgatcaccccgcggccgcggcggcccgcgcctgggtcgaggccgccgtttccgcgcgcgccttccggcccgtccgcatcctccgggaggaggttgctcgggaggacagcgcgccggaggcctga

SEQ ID NO: 6501 - DNA, 450 bp, Methylobacterium sp.
ttgtccaagtggtatctctacggcatcgccctcgtggccggcgtcgcgaacgccatcgagccgggccagaacgccaccctggcgaaggtcacggggcagccgatgctggcgggcctgttctgcttcggcctcgcgatcgcctgcttcctcgccgcgatggtcgtcgcccagctgcgcggccggactcgggccgaagcggccacgcccgtcccctggtgggcgtggccgggcggcatcctcggggccgcggtcgtcctggcgcagctctacatctccgagaaggtcggcgcggcgccgttcctgggctgcgtgatcacggcgggcgtggtcggctccatcatcctcgaccatcacggcctcgtgggcttcgcgcgccaccgcgccgggcgctggcgcatcctcggcggcgcgctgatggtcgcgggcgtcgccctcgtggcggtgttctga

SEQ ID NO: 6502 - DNA, 456 bp, Methylobacterium sp.
atgacgggcgctcggatcagcagcacggagatcgcgatccccgcgcgggccggactggtctggtccgtgctgacggacctcgattcctacccggcctggaacccatacatccgcaaggcggagggccgcctgcgcgagggcgcgcgctggcgcctggagcggaccctgaacggccgcgcctaccgggcgcgccaggtgacggtgacctgctgggagcccggccggcggctcacgtggcgcggcggcatcccgacgccgcccctgctcatcggcgagcacgaggtccggattaccgagaccgccgacggcgtccgcctcgtccaggccgagaccgtcgcgggcctgctcgcccccggcctgttcccgtggctgcggacgcgcatgcaggcccgcttcaccgcgatgaacgaggccctgcgcgaggaggtcgcgcgccggctggccgagagcgcctga

SEQ ID NO: 6503 - DNA, 231 bp, Methylobacterium sp.
atgacccgcactctgaccatcgcggcgctggccgcgctcctcgccgttccggcggtccaggcgcaggcccgcccgcggcacacccccgccaaggcgcagcccagcgccgcgatcaaggcgcgccagaccgtcctgaacgatttcaacgcgcggatgagccgcctggacgcgctcatgggcgccccgagcacgtcgtcggtccgcgcgcgctcggccgaggccggccgctag

SEQ ID NO: 6504 - DNA, 1416 bp, Methylobacterium sp.
atgctcgcctctaagacgctgcgcggcgccggatggagtgtcgccgcgcggatctccgcgcgcgcgatcgatctcggcacgctgctcgtgctcgcgcggatcctgtcacccgcagatttcggcctgacggccatcgccgcgtccctgatctcgatcgtcgagatgatcctcgagatcccgctggttcaggccctgttgcgtctgcagaagatcgagacgtcgcatctggatactgcattcacgctgggccttcttcggggcggggtcatcgccgttctgatgatggccgccgcttggccggtcgcccacatctacgacgacgtccgactgatccccatcacgctcgcgctcgcgtcggccccgatcgcgcgaagcctctacagcccggccatggtacacctgttccgcaagatcgacttccgtgcgtcgtttctcgcggatttttccggcaaagtggccgcagccctgatctcgatcgggtctctctacttgggagccggctactgggccctggtgatcaatccggctgcatccgcgatcctgccgaccgtcctgtcctacgtgctcgcgccttaccgcccgagactctccctggcgcggctgagtgccttctcggccttcacaggctggttcacatcctctcagatcctcgctgccttcagttggcagttcgatcgcatgttcctcggctaccacgtcgacaaggccgtactcggccgctacggggtggcgagcgatttctccgtcctcccgacccagagcgtcatcggtccggctatgcggccggtcatggccgcgttcgcgacgatggccaatgaccgcactcgcctacgagccgccttcctgaaggcggctcgactcacgatgatcatcgcgctcccggcgggcgtgggcattgcactgaccgccgaccagatcgtgagcgtcatcctcggtgcgcaatggatttccgcggcgccttatctgcgctggctgtcgctggccatcatgttcaccgcctattatcaaccggtctcgacgctctgcctcgcgatggacgagccgaacgtgatgctcaagatcacgctcctcgagtcggtggtgaaggtctcgagcatggcaataggattttatgtcggcggcgtgatgacgatgatctacgcgcgcctcgtcacggccctgtttcacttcctgatcagcgcgatctacgcgcggcgtctcgtcggtgccggtgtggcggggcagatccgtaatctctggcagattggcctctcgtgcgcggtgatggcggccgtcgttctcgggctgcgggacgccttgagccgcctggatatcggctcggccgggcttctcgcggccctgatcctcggcggcgcggcggcctacagcgcgagcatgctgttgctcggctttcgcctgcggaccctgcgtccatga

SEQ ID NO: 6505 - DNA, 327 bp, Methylobacterium sp.
gtgccgatcatgatgtttgctgtccccgccctgctgttggagctggcgttgacgacaccggtctcggacaagatgccggtcttcgacgttcgcggcagctgccgggcggcgacgacggcgatgaccctcgatcccgttcggcagaagctctgcctccaggacgaggggtcggcccgttccgaggtggcgaagaagtggtccagctacccggcggtcgaccggacgcgctgcgcggcggaagcccagctcgacggcctgcccagctacgtcgatctgctggagtgcctgaccctcgcgcgggaagccaaggccgaggacgatcagtag

SEQ ID NO: 6506 - DNA, 117 bp, Methylobacterium sp.
atggagacgacgatgacctggaccaaccgcatcgccctggccgcgaccctgatcgccggcgcggtcgccctcgtgacctacgcgcaggccctcagcctgccggcccatttcgcctga

SEQ ID NO: 6507 - DNA, 786 bp, Methylobacterium sp.
atgcaggcgatgttcgcggatggccaggtcgcggtgaccctgtccggcgagggcccgcccctcgtcctgctgcactcgctgctcgccgaccggacgagcttcgaccgggtcaccccggcgctcggccgcgacttccggctcctccttcccgacctgcccgggttcggcgcctccgcgcccgcgccgggcggccttgaggccgtcgccgaccgggtcggcgcggcattgcgcgcggcggccgggggccggccggcggccgggctgggcaacggctacggcggcttcgtgctgctgctctgcgccctgcgccaccccgacctcttcgaccggctcgtcttcgccgattgcggcgcctgcttcccggagcccggccgggccgcgttccgcggcatggccggcgcggcggccgagaaggggctcgcggcgctcgccgacacggccatgcgccgcctgttcgcgcccgcgttccaggccgcgcacccggacctgatggccgagcgccgggccgccttcctgcgcacggacgtcgacgtgttccgggccgcctgcgcggccctggccggcctcgacctgcgcgcgcggctctccgagatccgcgcgccggcgctggtgctcgtcggggaggaggacgaggcgaccccgccggccatggcgcgcgagctcgcggccgggctgccggacgcgcggttcgtgacgctgccggactgcgcccacgtcccgcagctccaggcccccgagctgttcgcccgcgaggtcctggcgtttctccggccaggttccgcctga

SEQ ID NO: 6508 - DNA, 1131 bp, Methylobacterium sp.
gtgaccgaagcgaccgggccgtactggccgacggaggactgggcggagcgggacccgggcgcggcggggctcgatgccggccggctcgcggacgcggtggcgttcgcgcaggcccacgagagcgcgtggccgcgcagcctgtactatcccgacgggcgctacgtcgggatcgtcgagtggaacgagacggggccctggagcgccgtcgacgggccggtgcgcccgcgcggcggcccggcgggcgtgatcctgaagggcggccggcgcgtcgccgcctggggcgacacggcccgcccggacatgaccttctcgatcgccaagagctacctcgcggtgctcgccggcctcgcccacgacgacggcctgatccccgacgtcgacgcgccggtgcgcgacagcgtccccgacccgctcctcgacggcccgcacaacggcgcgatcacgtggcgccacctcctgcagcagtcgagcgagtggcaggggacgctgttcggcaagtccgatcaggtcgatcatttccggcagatcggtccgggcgccgacaacagccgcaagggcgaggcgcgggcgctgcggcgccccggcacctactacgagtacaacgacgtccgggtgaacctgctgtcgtactgcctgatgcgccgcttcggccgggccctcccggaggtgctccgcgagcggatcatggatccgatcggcgcctcccgcgactgggcgtggcacggttacgacacggcctgggtcgcggtcgacggcgcgcgggtccagtcggtccccggcggcggccactggggcggcggcctgttcatcggggccgacgaccacgcgcgcttcggcctcctcgtcgcccgcggcggcgcctggaacgggcggcagctcctctcggagcgctggatccgcgccatgctgacgccgtccccgacgctggacagctacggctacctctggtggttgaaccgcggcgcggccgccaagccgcagctgccggcctcggccttcagcgccctgggcgcgggcaacaacgtgatctggtgcgatcccgagcacgacctcgtcgcggttctgcgctggatcgacaaggcggccctcgacggcttcctgctgcgcctcgtggcggccctgcgtccctag

SEQ ID NO: 6509 - DNA, 318 bp, Methylobacterium sp.
gtgaggctccccgcgcgcctcgccgcggccctgcggccgcccgcgcgcgccggcgtgcagcacctgccccggcgggtctggcccggcgaggaggcggcttggcgcgacgagaacggcgtccgccacccgcgggcggtgcgccgtgccctcgcggcgctggccgccctcgaaccccgcggtcgctacggcgcccggatcgagggacggggcaaggtcgtgaccggcccggccagcgcgctcgtcctgcgcgacgcggaggcggagatcgggttcgtcctcggcctcacgcccgacgggtacggcgcggagccgttctga

SEQ ID NO: 6510 - DNA, 864 bp, Methylobacterium sp.
atgaaacccgcgcccttcgcctatctgcgcgccacgtccgtggacgacgccctcgaagccctgcgccagcacggccccgaggcccggatcatcgcgggcggccagtccctgatgccgatgctcaacatgcggctgacgaagcccgccgtgctcgtcgacgtgatgcgcatccccgctctcaaggagcctcgcctcgacaagggggccctcgttatcccggcgggcgtgcggcaggcgatcctgctcgaccggccggggctcgcccgggacttgccgctgctggccgccgccctgccgtgggtcgggcacatccagacccgggcacgggggacactgtgtggctccgtcgcccatgccgacccgagcgcagagattcccctctgcctcgtggcgctccagggcgaggtgcatctgcgcaaccggcgaaaggtccggcgcgtcgcggcggagaccttcttcgctggcatgatggccactgaccgggccgacgacgagatgatcgaggccatcgcctatccgctgcggcgggagggcaccggcacggccttcgctgagatcgggcggcgacacggcgactacgcgatcgtcgcctgcgccgccgtggtggacggcacccggatgcggctcgctgtcggcggcgtcgccgaccggcccacagcccgcgacttcccccacctcgacggctcggcgctcgacgatgccctcaacgccttcgcctgggacctcggcgcgggggacgacctccacgccaccgcccgctaccgccgcgacctcgtgcgcagcctcggccgccgggtgctggaacaagccgccaaggtcgcccgcggcgacacccatcaggaggccgtgccatgccacagctag

SEQ ID NO: 6511 - DNA, 666 bp, Methylobacterium sp.
gtgcagcatttcggcgtcacggtccagaacatggaccgggctttcgccttctacaccgaggtgctcggcgggaccgaggtcatgcgggacggcgacttcaagggcgagccggtccatttcacgctgatggccgatcaagagatcgtcgcccgcgagcgccgcgtcgatcctcgcaccatcggcgtcccggacctgaagggtggctcccagcggctcgatgtgcgcttcgttcagttcgagaacgtcgtcatcgaactcctgcagtatcgcgacgcaacgcagccgatgggcggcggcgacagctgggctgagccgcgcgaccacatgagcccggcctacccgcgctcgatgcacatctgcttctacgtccgcgatgacgtgaacttcgacaagttcatcgctgatctcgaggcagagtgcgcccgccgcggcatgacgcaggtcagggcgaaccgcaccgtacccgtgcactccgaagagcagcgccgcgcggcgccgagggataccaattcgatcaagatccacgaaggtccgtcgaacggctggtcgatcatctactgcaagggccccgagggcgagcagctcgaattcgtccaagtgctcggtcccgtcaaaaagacgttcgctgacgccgccgaggcgcgccgggcgacgaaccggggctga

SEQ ID NO: 6512 - DNA, 516 bp, Methylobacterium sp.
atggcctatcatcccgttccggtgacgcatgtcggcctgaccgtcaccgacatccgggcagcaaccgagtggtacaccaaggccttcagctgccgccacatcatcggccccctgcacatcaggcacgacggctcgcatatcggcgaggtattcaaggggatcttcggtgatcgcttcgaggagggatacgtgtcccacctcgccaccgcgaacggggtggggatcgaactcttcgagttcgtcacgccgaagtcggaagctgtggatgacaacttccgctactggaagaccggcgtcttccacttctgcctggtcgacccggacgtcgagggcctcgcgcggcggatcgccgagatgggcggcaaacagcgttcgaaggtctggacactgttcgagggcgagccgttcaaggccgtctactgcgaggatccctggggcaacctgatcgagatctactcgcactcgacggagctcatgtacgccaatcggagcacgacggccgcccgggcggagtga

SEQ ID NO: 6513 - DNA, 303 bp, Methylobacterium sp.
atgcgcggcacacagtcttcgacgggcgctccgaaggccccgctggccgatcctcgaaggggatgtgacctgccccgcttcttcctcaacgtccggcggcacggcacgctgatcgccgatcgggagggcgacgagctgcccgatcggacggcggccgagcacctcgcgcgcgacatcctgcgcgagatgcgccgcctgccgcacgtctacggcgcgccgcgcggctggcgcgccgacaccttcgtcatcaccgacgaggccggcgcggtggtggccgaagtcccctacgccagcgtgctctga

SEQ ID NO: 6514 - DNA, 789 bp, Methylobacterium sp.
atgagcggcaccttgctggagacggtcgacgagcgcggggtcgccaccctgacgctcaaccgtccggagcagcacaacgccttcgacgacggcctgatcgccgccctcaccgcgtccctgcaccggctgggcgccgctcccgggatccgggcggtcgtcctggcgggcgcgggccagagcttctcggcgggcgccgacctcgcctggatgcgccggatcgccggccagtccttcgacagcaacctcgccgacgccgccgggctcgcggggctgatgcacagtctcgaccggctgccgaagccgacgctcgccctcgtgcacggggcggcctacggcggcggcgtcgggctcgccgcctgctgcgatatcgccatcgcggccgagagcgcgcggttctgcctgagcgaggtgcggctcggcctgatcccggcgacgatcggcccctacgtggtcaacgcgatcggcccgcgttgggcccggcgcctgttccagaccgcggaggtcttctccgccgagcgcgcccgggcgatcggcctcgtgcacgaggtggtgcccgacgaccggctggaggcggccggcgcggaggtgctgcgcgacatcctccggggcgccccgggcgcgcaggccgaggccaaggacctcgtcttcctgtgcgaggggcggccggtggacgccgacctggggcgcgagacgggccggcgcatcgcccggcgccgggcctcggacgaggggcaggccggcatagccgccttcctcgacaagcgcttagccccgtggcggcgggactga

SEQ ID NO: 6515 - DNA, 360 bp, Methylobacterium sp.
atgcccgtgacggaggggctgacccacctgacgttctcgatcatccgcctagctatgttcgcgccccgttctatctgctcaccgtgcgggcggagcggcagaatggcgagacggggcgtcttcgtgcgggccgaggaggtcgccttcctggaggaggcgcggcgctggtggcagcgatgcgtcttggtcctcacgagggccaagccgcagggcccgctctacaacgcgacctcgaaggtgatcgacgcgatcgacgacgttgccgaggtggtgaccggcgaccggcggaccttctaccagagggatgcgaccacaccgggcgagaacctaccgcccatgaagtggcgcacggtggagtag

SEQ ID NO: 6516 - DNA, 237 bp, Methylobacterium sp.
gtgcgggccgaggaggccgcgttcttggaggagatccggcgctggcgtcagcagtgcgtcctggtcctcaccagggctaagccgcaggggccgctctacaacgcgacctcgaaggtgatcgaagcgatcgatgacgtcgccgaggtggtgaccggcgatcggcgggccttctaccagcgtgacgcgaccacgcccggcgcggccctgccgcccgtgaagtggcgcacggtggagtag

SEQ ID NO: 6517 - DNA, 216 bp, Methylobacterium sp.
atggtcagcgagccggttgggccagaagggtacaagcgccgggttcggtacgagaagccccacgcctcgatctatgcgcacccaaaggtgttcaaggcgctccgtgagatcgcggcggccaccgactgcaagccgcacgacctctacatcgaggggctccggatggtgctgcgccagcacgggcgtgacttcgatgccctaaatcggggcgagtaa

SEQ ID NO: 6518 - DNA, 1359 bp, Methylobacterium sp.
atgacccggcttctcgccagccccgtgcgccggctcgcggctctcggcctcgcgctgctcgtcgtgaatgtcggcgcgctcgcgatccacgtgccgggcgccgacacggtgggctcggtcacccgcgccaacgtcttcgtcggtgtcgtggtggtcggcctcgggctctacctcctcgccgtgggcctcgtgctgcgggaacggttgccgcgcgccgccctgtggacgatcctcggcgtcgccgtgctgatgcgggccgcgctgctgccggcgccgccgttcctgtcgagcgacatctatcgctacgtctgggacgggcaggttcaggctgccgggatcaacccctaccgctacatcccagccgatccggccctcgaacagttgcgcgatccggcggtctacccgctgatcaaccggaaggattacgctcgtacgatctacccgcccgcggcgcagatggtcttcgccgccgtgggccaggtctcgcacggcgtcaccgcgatgaaactcgcgatgctgggcttcgaggccctgggcgtgctggcgatgctcgcgatcctgcgcggtgccggcctgccgtcggcccgcatcctgatctacgcctggaatccgctcgccctgtggtccttcgcctgtgacgggcacgtcgacgccgtagcgatcggcctcctcggcctcgcgctgctcgcccgcacccgccgtgggtacgggctcgcgggcgcgctgctcggcgcggcgacgctggtgaagctgctgcccgtcgcggtggcgcccgccttcgtgcgcggtggccggctgtggcggccgatgctcttcggggcggccgtgatcgcggtcctctacctgccctatctcggcgccggcacgaacgtgctcggcttcgccgggggctacggggccgaggaggggtacgagaccggcacgggctactggctgctcgccgggctcggccacctgggcctcagcactcagggcctgctgcggacctatctggtctgcgccggcctgacgctcgccgcgctcgcgctccggatcgccttcggccgggaccgggcgcccgcgcgcgacgcggtcgcgctgtgccgcgatgccgggctcctcgcagccctcatcacctgcgcggcgagcccgcactacgcttggtactacccctggctggcgctgcccgcggtggtcgcgccggccccggccctgatctggctcggcgcggcgccgatcctgttcctgatcgatccgttcaacgaccgcttcctctggccggcgctggtcttcgtcccggccctcgtcctggccgcccgcgcgctgtggcaggcccgcaccgcacccctcgccgctctcccggaaggaaccgcccgatga

SEQ ID NO: 6519 - DNA, 1182 bp, Methylobacterium sp.
atgacagccgcacagcccctctcgacggacccgttcctgcccgggccgcgcgtgcgcgtcgccggatccgcgacggggccgctcgccggcctcaccttcgccgtcaaggacctgatcgacgtcgcggacactcccacggggggcggaaacccggactggccgcgcatctacccgacgccggcccgccatgccggcgtggtgcagacgctgctcgatgcgggcgcctcggtcgtcggcaagacggtcaccgacgaagtctcaatgggaattctcggcgagaacgcccacgacggcacgccgctcaatcccgcagcgcccgatcgggtgcccggcggctcgtccagcggctcggcctccgcggtggccgcgggcacctgcgacttcgcccttggcacggataccggcgggtccgtgcgcgtgccggcgagcttctgcggcctctacggcatccggccgacgcacggccgcatcgacttttccgggatctgcgtccaggcgccgagctcggatacctgcggctggttcgcccgggatgcggcgaccttcgcgcgggtcggcgaggtcctgtttggccaagccatgccggaccgcccgccccacacgctgctcgtggccgcagacgcgctcggcttcgccgatgccgccgtgcaggaggcgctggctccgcagatcgaccgcttggccgccctgatcggcaaccggcgcgacgtgaccatggcgccgcagggcttgtccgtctggcagcgggcgcagcgcgtcctccagagcagcgaggcgtggcagaccttcgaaccctggctcgatgcctgcaatccacgaatggccttctcggtcgcccgatcgctgatccagggctcgatgatgatggacgccgagcgcagcgccgcgggcctgatgcggatcgaggctcgggcacgtctcgcccagcttctgctgcccggcaccatcctgtgcctcccgaccaccccgttcccggcacccctgcgcgggctgccgctcggcgcgctgcatcccctgcgcgagcgcatcgcctgcctgacgagccacggcggcctcaccggcgtcccgcaggtcaatctgccgggcgcacaagtcgacggcgctccgatcggcctgtcgatcctcggtgcgcgaggagccgacctcgacctgatccgcatcgcggtcgccctggaggcctga

SEQ ID NO: 6520 - DNA, 261 bp, Methylobacterium sp.
atgacacgtttgccgattatcgtcctcgccaccctcgctctcgggggaagcgccgtcgccgccgagcagggggcctcgtccaagactccgggccacgagatgcaggatcgcgggagccgggccgggagcccgggcgcgtcgggttacgcgccgggccacgagatgaagtccggcgggacggactcgtccggttcgacgtcgcgaagcggcggaagcacgacgggcaccaccggcaccagttcgaccggcacccgtcgctga

SEQ ID NO: 6521 - DNA, 954 bp, Methylobacterium sp.
atgctcgacaccgacgatctccgcttcttcgtcgcggtcgcggccagcccgtccctggccgccgcggcgcgcagcctgaacgtgtcgccacccgccgtgacgcagcggctgcgcagcctggagaagcggctgcgggtccatctggtggaccggtccggtcgcggcctcacgctgaccgacgagggggagctgctggccgagcgcggccgcgacctcctcggcgccttcgacgatctcgccgacgccctggccgagcgcgtcggcgcggtgaccggacatctgcgcgtcgtcgccccgctcggcttcgggcgccgctacgtggccccggtcgtgacggcgttccggctccggcatccgggcgtgcggatcgacctgctgctctcggatcgcctgggccgcatcccgtccgagacctgggacctcgcgatccacgtcggtgagatcagggaggcgaccccgagcctgaccgtgcgcgccctcgcgccgaacgaccggatcctctgcgcggcgcccgcctacctggcccggcagccggccccgcgcgtgccggccgacctgcgggatcacacctgcatcgcgctgcgcgagaacgacgaggacgtgacgctctggcgcttccgcgcggcggacggcgccgaggtccgcgtcagggtggacgcgggcttggtcagcaacgacggcgacgtggtgcggggctgggccctcgcgggcctcggcgtgatcgtgcgctcggaatgggatgtcgccgacgacctgcgcgcggggcggctggcgcgcctgctcgaaggctacgccctgccgtcggcgccggtcgtcgccctgctcggctcggaacggcggtcgcgcgcggcccggacggagcggttcctcgaggcgctccggcgctcgttcgatccgctcccgtggcgcccgcccgcggggccgggcgcggcaaccggcgatgctgcgccttga

SEQ ID NO: 6522 - DNA, 321 bp, Methylobacterium sp.
atgtcggctcaaactgcaatcgccattttggattcgatgttcgacctgttcaaggagatgggcagcggcatcgcccttgatctcaactggttcgcgatcactagtcgcctccagcaagttcgcgcggaagccgtgtggtcggccgatctcgacttcgtggccgtcaagctgaaggcgtacgccgcccattatgccgccacctaccgcgagccactcggttcagaggcgatcagatacaaaaacgccgagaggttggacgaagtcgtccgacactactcgattcttcgggcgcacctagagcagcaaatgccggcctcctga

SEQ ID NO: 6523 - DNA, 621 bp, Methylobacterium sp.
atgatcgatctctacgcctggaacacccccaacggccggaagatcagcgtggcgctggaggagatggcgctgccctaccgggtcatcccggtcgacatcacgcaaggggcgcagcacgcgccggacttcctggcgatcagcccgaacaaccgcatccccgccatcgtcgatccggacgggccggacgggtccccgatcccggtgttcgagtccggcgcgatcctgctctacctcgccgagaagaccggccgcttcctgcccgaggaccggcggcagcgcgtcgccgtcctggaatggctgatgtggcagatgggcggtttcgggccgatgcccggccaggtccaccacttcctgaccgtcgcggagcccgaccgcgcctacgggctcgcccgctacagcaaggagacgcaccggctctacggcgtgctggaccggcgcctcgcgcaggtcgcgtacgtcgcggggccgctctcggtggcggatttcgcgatcctcggctgggcgtggcgccacgagcgccaccaggtcgacctcgccgattacccgcaggtccggcgctggtacgaccggatgatggagcgccccgccgtgcagcggggcttcgccgtcccgctgagctga

SEQ ID NO: 6524 - DNA, 861 bp, Methylobacterium sp.
gtgggtcagtcgaaccttgccctgatctacgagaactattcggaccgcgcgactctgtccggcggctcgtggcagcccggatcgctgcggctcacgaacctgcagaccccctacatcgcggagaaggcgcgcacgacctcgaccgatccggcggccacgcagttcaccgtcgacttcgggcagccgtacatcatcggcggcgtgtgcttcggtccatctaacgtgcgcccggacgcgctctgtcggtaccggatgtatgacagcgtcggcctgctctacgacagctcgatcatcccgttccccggcacgaccgtcgactcggcctcgctggattgggaggataacggcttctgggagggtgtctccaccgagttcgacgacctctacaagggcgtctacttcatcgacttcccgaccctgccggtctcgtgcgagcggatcaccttcgagatcttcgatgccaacaacccggcagggtacatcgagatcgggcggctctactgcggcaaggtctggcagccgcagtacaattacgattacgaggggcacagcctcgacttccaagacaagaccgacatgcaggagagcgtgaacggcacgcgcttcttcaacccgcgtccgctgcggcggtcgttctccttctcgttcagctaccttcccgaggccgacaccttcagggacgtctatcggatcgcgacccgggccgggacctatcggcaggtggtggtggtcccgaaccccggcgacgtgtcgaccttcgtgcgggaggccttcctcggcacgctcggcgcgctgccgtccctccgccggccggccttcggctacgccgccaccgccttcaagatcgaggagaccctgtaa

SEQ ID NO: 6525 - DNA, 231 bp, Methylobacterium sp.
ttgagaaagccttcgggtccgtcgggtccgaagctgttcctcgacacgcaggtcgtgccgctcgccgccaatatcgcgggaagcctcgaggtggcgctcgaccgcgcggcggcgcgcacgggcgtccggcccgcgctgatcctggcgggcgcgaccggcctgatcggcctcggtctggtccgcctgttcacccctcggggcgccgcgaagggccggttcgagcggatgtag

SEQ ID NO: 6526 - DNA, 243 bp, Methylobacterium sp.
gtgcgtgaggcgatcgaggccgcaggagcgcggctgctctacctcccgtcatacagccctgatttcaacccgattgagcaggccttcgcaaagctgaaggcgctgttgcgcagcgtggccgctcgcacgatcccggatctctggccggcgatccgccaggccttcacgcgcttcactccacaggagtgccgcaactacctcgccgcagctggctacgaggacgacttggctgtcgctacctga

SEQ ID NO: 6527 - DNA, 372 bp, Methylobacterium sp.
atggacgacctgcttcgcgagtttctgaccgagagcggggagcatctcgacacggtcgatgcagaattggttcgattcgagcaggatccgaacaacgagactattctgcggaacattttccgactcgtgcacacgatcaagggaacctgcgggttcctcggcctccctcggctggaagctctggcgcacgccgccgagaccttgatgggtcgcttccgcgacgggctgcccgccacgtcggattccgtcaccctgatcctgctgacgctggaccggctgaaggcgatcctggccgatctggaggccaccggcacggagcccgcgggctcggacgacgacctcatctccgccctggagcgcatggccgagggc

SEQ ID NO: 6528 - DNA, 270 bp, Methylobacterium sp.
atggccctcgaacacagcggcgcccgcatccggctctcgggccactgcccggtcgaggaggccgagccgctgctcgatgtcctgcgcgccaccccggaggccgtcgtcgacctcaccggcgcggcgtggctccacacggcggtactccaggtgctgatggtcgcggcgcccgccctccgcggccggccggccggagccgtgccggcggcctgcctggccgcgctgcccgaggccgacgcggaacccgccgcggagaccgagcgcggatga

SEQ ID NO: 6529 - DNA, 1143 bp, Methylobacterium sp.
gtgggcgaggtctatgcggagagcacgccggtgcctgataccggcgcaacctatatcaacacgacgatcacgatcctccgcggcttcaatctcatctatgacgccgatagcgggttcgcgggttaccagcgcattgcccccgaaagtgcagatctcattgcccagccgatgatcgcactgcagggaagcttgagcttggcctcgcaattcacgaccggccttcccgtcttcctgatgagtacgacggcgctgaacccgctcgatgttgcgagcctcggcggcgacgtctccgggcctggcggcctgattaaggttgggctcggcaccctcgaacttgccggcaccaacacctatgccggcggcaccaccatcctcggcggcaccctggccgtttcccgcgacgctaatctcggcgccgccggcaccggcctgaccctcggcggaggcaccctcgaggtcctcgcagacggcttcgccaccgcccgcccgatcacgctcgccggccccggcaccctgcagatcgacgtcggcaccgccaccttcgcggggccgattgccgacggcagccagccgggcgtgctgatcaagtccggctccgggaccgccgtgctgtcagccgccaacacatttaccggcggcgctgtcatcagcgccggcactctcgccctgactgccaccggcagcctcatcgcgccggtcctcgtcggtgcaggtgcgagctttctcaatgccggcctcgtcgccggcagcgtcggcaacttcggcgtgctcgccaacagcggtaccattaatggcgcggtcgccaatgccggtatggccgtcaacgccggtaccatcgccggcggcacgaccaacagcggcagcctggtcaacaccggcaccctcgcgggcggtctgaccaacaccggtaccgccctcaacaccggcaccatcggcggtggcgtcatcagcagcggcatcctgagcaacagcggcgccatcggcggcggcgtggccaacaccgggctcctcgccaccagcggcacgatcagcggtggcctgaccaatgccggcaccgtgctcgccagcgctggccgcatcgacgggcccatcgccaacaatgccggcctgctcgccgtctccggatccgtggccggcaccggc

SEQ ID NO: 6530 - DNA, 1302 bp, Methylobacterium sp.
atgaaggtcctcctctgctcgacgcccgccacgggccatctcaatcccctcctcgccatcgcccacatgctgatcgcggacggccacgaggtcatggtcctctcgggctcggccttccgcgaccgcatcgtggcggccggcgcccgcttcatggccctgccgggcgcggcggacttcgacggccgtgacctccgcgcggtcgtgccggaactggccgagatcgcgccgggaccggactggctgcgcgtcgccatggagcgcgtgttcgtcgaccgcatccccgaccaggcgcgcggcctgcgcgcggcgctccgggccttcccggcctcgctggtgatcggcgacgacatgttcttcggcgccctgccgctgctgctggggccgcgcgcggagcgccccgccatcgtcctgtgcggcacgtcgatcctgcactgcgcgcggcccgaccgggctccggccttcctgggcctcccgccggccgagacgcccgagcaggcggccgcgtacggccgcatcgccgaggcctacgaggcggcggtcgaccggccggtcgggctgagcctcgccgccaagctggcggaactcggccgggccgccccgccctggccgctgttcgacgcggtggtgcggctcgccgacacctacctgcagctgaccgtcccgagtttcgagtatccgttcccgctgccgccgacggtgcgcttcatcggggcgctgccgatcgtcccggggcaggcggcgctcccgccctgggcgggcgacctcgacggcgcgcgcaaggtcgtgctggtcacgcagggcacggtcgcgaaccacgatttcggcctgctcgtcggccccgccctccgggccctcgccgatgagcccgacatcctgaccgtggtgacgggcggcggccgggggctcgacgccatcccgggcccgatcccggccaacgcgcggctctcgccctacctgcccttcgagtggctactgccccggatcgacgccatggtgaccaacggcggctacgggagcgtgaaccaagccctgagctacggaatccccctcgtcgccgccggcctcaccgaggacaaggccgacgtgaacgcccgcatcgcctggtcgggggccgggatcgacctcgccgcgaacgacccgacgccggaggcgatccggaaggcggtgcggaccgtgctcgacgcgcccggccatcgccgggaggcgcggcgcctcgccgccgagttcgccgcctacgacgccaaggccgagatcctgcggctcctgtccagccacggcggccgcgcgcgcagcgccgcctga

SEQ ID NO: 6531 - DNA, 198 bp, Methylobacterium sp.
ttggtcgaggctcgagagcgagcgggcctcacccagcaccaactcgccgagcggcttggtcgatatcagtctgtcgtcgcagctatcgagggcggcggacggaggatcgacctcgtcgagtttttggagattgcggacgcgttggaactcgaccccgtgcaggtggtcgtggccgtgcgcgcgatgccaccccggtag

SEQ ID NO: 6532 - DNA, 399 bp, Methylobacterium sp.
gtggccgccctcgccttcgcggccatcctgctgttcgccgccgccaccgactacgtcccggccttccgggacgcggagggccgcgtcttcggcctgttccggctcgacgtctacaaggacgcgctccacctcgcctccggcctgtgggcgctcgccgccggcctgtggtcgcgctccgccgccgtgaccttcctgcgggccttcggggcgatctacctgctcgacggcgtcgtcggcgtgctcaccgggtcgagcttcctcgacctgtcgctgttcctgaagggcttccaggacagcccgctcctctccaacggcccgcacctgagcctcggtctcgcgggcgtcgtgctcggctggtggccgtggcgcgcccggaccgcggccggggtcgccgcgtga

SEQ ID NO: 6533 - DNA, 1170 bp, Methylobacterium sp.
gtggccgtggcgcgcccggaccgcggccggggtcgccgcgtgagcccccggccccccccccgccgccggcgacgggtcgtccgctgggcggtcgccggcctcgccgttctggccctcgcctgcgccctgcccgtcgcggcgatcgaggggggctgcacggtcaggcccgatcccgccgggccggggcgctcggcgggcggctcgcgcttcgggatcgcccccgagggctacaagcgcgcggccggcgacagctacctcaccttccccgaatgggacatcgtccacgcctacgcggacctcgccggggtgacgcggtccgcctcggaatcggccttcgactactgggcggcgacgacgggcttctggacgagcctgtgcggggcgacccgggcggccgggcgcaccggcgacgtcaccgcgggccagaaggtcaccaactacgtgatcggcctgagcttcacggccgagatgctgatccagggggcctacgagcgcaccctcggggcgctgaccgcgcggtggcgggggcccgaaccgaccgacgaggaccggttcaacgcccggctgctcgcggattacgccgcgttcctgcgccagaccccctggtaccgctacccgttcgacgcggagctgtcccggctctggcacgaggtcccgttcacgccgtccctgcgggcggtcgagcggcgcggcgcgctcacgctgcaatacggggtgaaatgggcctacgcccaggggatcgcgtggctcgccgggatggacccggccggcctgacgatccgcagcgtcgtggcggggctcgatgccggcgatgcggccgccgacccgcgcatcaccctcctcggccccgtcccggccggcgacggcggcccggccgccctgatggagacgccgcgctaccgggccttcacggagatcgtccggggcctcggcgcgcggggccggaccgtgctggagatcgccggcaaccaccggatcctcaccaccgtcctcctgccgccgggcccgacggtcaccctcgccggggccgagccgctgttcgcgatgccgatccagtccgagccgggctggcagcgcgtcggctacgacaccgcggtggagcagctcgtcgcgcagatccgcgccgtggaggccgcggggggccggttcgagcatgcctacgattactga

SEQ ID NO: 6534 - DNA, 300 bp, Methylobacterium sp.
atgcctacgattactgatcggcgcccgcggcgcggcctgccggtcggcgccgtcgcggcggcgctcgccggggggctcggcgtgaccgcgctgaccgccctcgcggtccagccggagaccgtggtggcgctcgggaaccccgccgccctggcggccgccgacgacggggccctggtctcggccggccgcgcgtacctggtgctccggcccgccgggccgggtgcggtccggcgcctctacgcgggcggcgcctggctggtcctgccggcgcccaggaccggctgcctcggcacgcgctga

SEQ ID NO: 6535 - DNA, 207 bp, Methylobacterium sp.
atgagtccggaagagaccgagcttgagatggtccggcggcatatccgtgagggcgaggggcacctagccaaacaacgggctctcattgctcgcctgaaagcatcccatctgccgacagaagaggctgaggcgctcctcggcaccttcgagaactcgcagcaccagcacgaagcacacttcgctcgcattaggggcaaccaggagtag

SEQ ID NO: 6536 - DNA, 1140 bp, Methylobacterium sp.
atgcaggatctcgaggcgtattcggttctggtggggtcgatctacgaccgcgtcggccagccggaggagtggtcggcgctcctggaggatctgaccgatttcgtcggcggccgggtcggccagctcgccgtgttcagcctcgacgggaaccgcaagccgctctgggcggtgtccggtttcgagcggtcgcggtaccgcgagttcctctaccggcacgccaccgaggatccgcgcctcccctacatcctgtcgaaccagggcaaggtcatccgcgccgaggagggggtcgacgcggtgcagttccgcgagtcggccctgttcaaggaggtcgtccagcccttcgagatcgagcacagcctcgtcacctacttcgccaaggaagccgacgtcatggcgacgctcgcggcgatgcggggcgaggagggcggccccttccggtccgacgaggtccggcgcctggcgatgctcgtcccgcacctgcgccgggccttcgagctgtacgcgctgatgcggcaggcctccgagcgcacgtccgatctcgcctccgccctggacctgctcgacgccgccgtgatcctcacggattccgacctgcgcgtcgcgcacgccaaccgcgccgccgaggcgctggcgcggtcccggaccggcctgtccttcgtgaagggcagcctcgtcctcaaggacagccagaccgggcggcggatcgcccgcgcggccggcgaggcgctcgcggccgcgagcggcgacgtcgcgatcacgcaggccgaccacatcaccgtgacctgcggcgagagcggcatgccctaccgggtgtcgctgcacccgctgtcgaagcggccggccggcaccgggtcgaaggtgcgggccgagctggcgatcgtgatccggaccgggaccccgaaggtccaggggagcaacgccgcgcggctgcagaagctgttcgggctgaccgtcgccgagtcgatcctcgccaacgcggtcgcttcgggacggtccctcgacgaccacgcccaggaccgcggcatcgcgatctcgaccgcccgcacccagctgcgcgccctgttcgccaagaccgagacgcaccggcagggcgagctcgtggcgcgcctgcgcgaggggctggacgtctcgctcaactga

SEQ ID NO: 6537 - DNA, 267 bp, Methylobacterium sp.
atggccaacgagcatttcgcccacgcctccacgcaccgggcggccaccatccgcctgggcagcttcgatgtgccgtgcacagtgcattcgtctactgatgcgtcggcccacgtgcgcgtggtcaccgccgacggcatcccggagtatctgatcctcgtgcgtgacggcgaggctcggcgcgcccacgttgcgatgcgcaagcagggtccgttgggcctcgacctctggctcgacctgcaggtggcgcaggacgctcgcgcggcctga

SEQ ID NO: 6538 - DNA, 1428 bp, Methylobacterium sp.
atgctgccggttctcgttgcgcggaagggcgctcgcatcgggatgctcctggcggtgctcgccgtcccggtcgcgggcgaggccggctggaaggggccggaggcgcaaccgctgttcgtcaacgaggccaatccggccggctacaactacgcgccgagcgtcatcaccgagaacgggaccaccgacatctggtggtgcggccagggcaagaccgacgtcatcttccatcgctcctacacgccgcagactggcttctcgccggcgcggatcgtgttccagccgacgcccaactcctggaaccggcagtacgtctgtgatcccagcgtgatccggggccgcttcgtcaacccggcggacgggcagacctacgcctacgcgatgtactattcgggcgccgacaacctgcccggaaacaacaaccagaccggcctcgccttctcgaacgacaaggtgacgtgggtcgactacccggaaccggtcatcaagccgatcaacccggtcgtcgcgcggggcaattacggcaccggccagccggcgatcttctcggacggccggtcaggcctgttcgtcttcaccacggatctcaccgggccgcagggcgtgccgggcttcggggacctctacgtccggcacacggccgacggcgtgcatttcggggcgccggcgcgggtccccaacgccacgaccgacggctcgaccatcaacccgaactcggatttcgcctacgatcccaagaccggcgaggtctacgtcatcaccgggctgccgggccgcgcgtgccagcaggtggcctgcaaggatccggggcgcaatcccgaccgggaaacctaccagatggggctgttcaggatgcccctgaaggctgtcctgagcgggtcgccggcggcgtggacatccctgggctacctgaattccgacgtcacgggcttctacctgaaccacagtcccggctttcagcgcgacggagcggggtacctgacgccgttcctgccggacatcacggtcttcttctcggggggtgacccctatcccggcacgtggcggatcgcagaggcgcggcggccgaagggcaccgaccgccttcccctgcggcgcgccttcgggcccggaggccactgggtgacgaccggctatatcgggccgggctacacgatcgagcgcagcctcggcaccgtgttgacgctcccggcgcccgggaccgcgatgctgatgagctgcgcggcgggacaggaccacttcctcagccgggacccgcgatgcgagggccagacgccgctcgggcagaccggctacgtctacgaggcgcacaggccggggagccacccgatctaccgttgcatcgccgggggccgcgatcatttcgtgtcgaccgccccggactgtgagggacacgcgtccgaagggatgctcggctacgcgctggactga

SEQ ID NO: 6539 - DNA, 297 bp, Methylobacterium sp.
atgaagttcggcgtcctgatcctggccggcgcctgcggcgtcctcgtcgggatcgtcatcggatacgtcgcgggggcgcgactcagccaggccttcgcgcagttgccggtgacggaccgctcccccgccgcgcaggcgctccggatcgtggaccgcatcgcgaccgagcacggcctcgcgcgggacacgctgctccgggcgatgctcgaccagcagggcggcggaacggggaccgcgcgtcccggcgaggagccgggcagggtgccgggcacggccccgggcgaaccggcccggtag

SEQ ID NO: 6540 - DNA, 216 bp, Methylobacterium sp.
atgacggcggcgctcgccgcgccggtcacgcaggtctgcgccttcatgctcggctgcgcgctgatccacgccgcccgcgcccacgccgatctgatcacgcggctcctcgccgtcacggcggtcggcgtggccgtgctggtgcttctcgtcgcgtccctcgactacgcgcccgagggcggaaccttcgacgaggtcacggtctacgcggcctcctga

SEQ ID NO: 6541 - DNA, 456 bp, Methylobacterium sp.
gtcgacgacgccctcaacgccacccgcgcggcggtcgaggaaggcatcgtcccgggcggcggcaccgcgctgctgcgcgccaagaaggcggtcgccgagctgaagtcggagatcccggacgttcaggccggcatcaagatcgtcctgaaggcccttgaggccccgctgcgccagatcgcccagaacgcgggcgttgagggctcgatcgtggtcggcaagatcaccgacaacacctcctcggagaccttcggcttcaacgcccagaccgaagagtacgtcgacatgatccagtcgggcatcgtcgacccggccaaggtggtgcgcaccgccctgcaggacgcggcctcggtcgccggcctgctggtgaccaccgaggcgatggtcgccgacgcgccgaagaaggacagccctgctccggccatgccgggcggcggcatgggcggcatggacttctaa

SEQ ID NO: 6542 - DNA, 198 bp, Methylobacterium sp.
gtggaaagcatcacgccccggccggcgaactgggagatcgctggcggtggcattcgcctggtgttcccggtgcaagccggccagagccacgcgctcattcggttcaccgggtcgccggctttccgcggcggggtcaacctcaccgcccggctcgatgctggcgagatgctgtcctggtctcagtacgcggtgccgtag

SEQ ID NO: 6543 - DNA, 459 bp, Methylobacterium sp.
tcggacgacctcgacgagctgctgaccctggtctggaagaagcccgccttcttcgtggcccatccccgcgccatcgcggccttcggccgggaggcgacccgccgcggcgtgccgccggtcgtcgtccacctgttcggcgcgccgttcatcacgtggcgcggcatgccgctggtgccgagcgacaagctgccgatcgacctcgacccggtgaccggggccgagaccacctcgatcctgctgctgcgcgtcggcgagggcgagcagggcgtggtcggcctgcagaagtcgggcgtgaccggcgagatcgagcccggcctgtcggtgcgctacatgggcaccaacgaccactcgatcgcctcgcacctcgtgacccgctacttctcggccgccgtgctggtcgaggacgcgatcgcccgcctcgataacgtgctgctgggcaactaccatgactacgcctga

SEQ ID NO: 6544 - DNA, 429 bp, Methylobacterium sp.
atggctctgcgctcgacctccatccggatcgcctcgctcctcctcgccgcgtgctgggctgcgccctcgctcgcggagcccgccgcggtcgcccggccgaagatgctcgtttacggcaactattgcgggctcgggaacaacgcgccgctgccgccgatcgacgtcctcgacgccgcctgcgcccgccacgacgactgcaccccggacactgacctgccaacaaaggcgtgcaacctccggcttgagcgggaagcgatggtaatcgccaacgatccgcaccagccggacggcctgcgcacgatggccggcttcgtggcggccttcgccgaggcgaacccgtcgcaagtcatcccagacctcgtgccggtcgtcgtaacggtgaatgcccctgcccgcgcgcctcggaccgcctacacgcggctgcggtga

SEQ ID NO: 6545 - DNA, 384 bp, Methylobacterium sp.
atgttgactcgcaccgtcatcgggctcgtcgcccccgtctgcctcgccgccgcgtgggccacgccgtccctggcacagccggccgccaatggcgggccgaagttcctcatccacggcaactactgcggccccggcaacaacgcgcctctgccgcccatcgacgccctcgacgcagcgtgcgcccgccacgacgcctgcacgccggatatcggacttccgacaaaggcctgtaaccttcggctggaacgcgaggcagccgcggttgctcgggatccgcggcagccggacaatgtgcgctccctcgccggtttcgtcgcgtcgttcgcggcgtcgaacgcgtcgagcccggcgccgacggtgctcccagcgagactggcgcgctga

SEQ ID NO: 6546 - DNA, 267 bp, Methylobacterium sp.
gtgacggccgctgacgccgagctgccgaagcaggatgaaatcctcgctttggcggcgatgctcgcggagcagatactcgctgcacaaagcgaggagcagcccttcactcagcctcaattcaacgcgctggtgagtgccacccggttccttcacgaaaacaacgtgccttggccgccgatcgtccaacaggccctggacctgttcgcagagcagatcgaagcgaccaagcttgatccgagggaggacgaggctcagcgttgggcctaa

SEQ ID NO: 6547 - DNA, 267 bp, Methylobacterium sp.
atgacggccgctgacgcagagctaccgaagcgggacgagatcctcgctttggcggcgatgctcgcggagcagatactcgctgcgcaaagtgaggggcagcccttcactcagcctcaattcaacgcgctggtgagtgcgacccggtttcttcacgagaacaacgttccatggtcgccgatcgtacaacaggctctggatctgttcgcagagcagatcgaagcgaccaagctcgatccgagagaggatgaggctcagcgccggccgtag

SEQ ID NO: 6548 - DNA, 1533 bp, Methylobacterium sp.
atgtcgacgtatcacctgtcgcaatcggagtttgagcagcagctccagagtgtcgatccatccatccaacagagagttgaagccgcactatccgctgccggtgtggatattgccaaggatggtgtgaccctggaaacgggcccccaggggaacgtttctgttggctcgagcgtgaacctgttcgaggccgtcgctgctggcaagtacacgatcacggcgggtgacaagtcgatcatcgcgaccggcaccaacaaggtcacggttgatctggctggatctgggcagaacaccgtcatcgtcggttctggcggcgctaacgtgacgaccaacggtggggacaccgtcattggtggcagtggcagcagcgagtttgtagctaagggcgggggcaacgtcctgtacggcggttcggcccaggacacgctggcagcggtggacgggaacaatactctgtatgccggctcgggccgcaacaatctgaacggcggcgcgggcaacgactcgctgtacggcggcggacagagcgctctgtacggcggccgcggtgaccagcagctcgtcggcggcgccaacggctccgcgcgcgacacgctcgtcggcggcaatggaagcgacgtcctgtttgttcagcacggcaacaatacgctgatcggcaatagcggtgacacgttgtacggcggcaccggcaacgactcgctcagtgcggtgggcggcaacaacacgctgtacgccggctccggcctgaacaccgtacagggcggcgctggcaccgactcgctgtatggcggcggccagagcagcctggtcggcggtaccggcaaccagcagctcgtcggcggtgccaacaactccgcgcacgacacgctcagcagcggcgctggcaacgacatcctgtacgttcagcacggtaccaaccagctcatcggcaacggcggtgacacgctgtacggcggcaccggcaacgacacgctcagcgcgaccggcgggaataacacgctgtatgctggctcgggtctgaatttggtgcagggtggctcgggtcgggattccctgtacggcggcggccagagcagcctggtcggtggcaccggcaaccagcagctcgtcggcggcgccaacagctccgcgcacgacacgcttgtcagcggcgccgggagagacgtcctgttcgttcagaacggcagcaaccagctcttcggcaatggcggcgacacgctgtacggcggcatcggtaacgatacgctggcgaccactggcggtgacaactacttgtatggtggtgggaagaccgcgtttgagctcagcaacacgggcggcaacgatacgatcgttggtagctccaccgattcgctgcggatcgacaacgctggtctcggaactgcgtcctataattacaaccaggtcgataattccaccacgattacattctctggcaactcggccatgtctgttactgtgagtggcctgactcaggttacgtacagtgatggaagctcgcatagcctgggccagcaagtcccaccacacccataa

SEQ ID NO: 6549 - DNA, 144 bp, Methylobacterium sp.
ttgtttaacaccatcctggcgcttctcgccgtcctcgccgttatgaccgcccatgccctctacaagctcgtgcggctgcccttccggctcgtgcgcggcctgtttcgacacaaagccccgcgggcccagctgacggcgcgctaa

SEQ ID NO: 6550 - DNA, 144 bp, Methylobacterium sp.
ttgttgaacacgatcctggcgcttgtcgccgtcctcgccgttatggccgcccatgccctctacaggctcgtgcggctgcccttccggctcgtccgcggcctgtttcgacacaaggccccgcgggcccagctgacggcgcgctaa

SEQ ID NO: 6551 - DNA, 1500 bp, Methylobacterium sp.
atgcgccttgccgtcctccagttcacgcacgagaccgtcacgttcctgccgaacgacacgacccgggacgacttcacttatcccggctcgccggcctccggggccgcgctcctcgccaccgatcccaagggctacatgggcgggttcgtgcaggtggcgcgggagtacgacggcgtcgagttggtcgggatcacctcgccgctctggccgcgcaccggcaccgcctcgggctggatcaccgccgacgcctacgcgcatttcctcgggcagatggtggcggagctgcgggcgctgggcccgttcgaaggggtctacctcgccctgcacggcgcgatggcggtgcgcggtgtccccaggccggaggccgacatcgcccggcaggttcgcgccgcggtgggtgagggggcgatcctggtcggaaccttcgacctgcacggcaacgaggacgccgccttcctcgaccacgccgacatggccttcgcggtgaagtacttcccgcactacgacggccacctgcaggggcagcgggccgcccgcatgctggtgcgcgccgtgcgcggcgacttccggccggcgcaccggaccctcaaggtgccgatcctctcgccgaccgtcgtgcagtggaccggcgccgcaccgtggtccgacctcgtgcagcgggcgcttgtctgggaggcgcgcgagccggacgtgtacgtcaacgtcttcttcggcttcccgtggggggacgccccggacggcgggatgaccgtgcaggcgatcaccaacgccgacccggccctcgccgagcgggtggcgcgggacgtcgcggatctcgcgtggcggcagcggcgcgcgctgctcgagacgacgcggatccacacgatcgccgacggtgtgcgccgcgcgcgggcggcggtggcggagggtgccgccccggtggtcctcgccgaccacagcgaccggtcgggccgggcgacctggctgctgggcgagatcctgcggcagcgcctcgcccgcaccctggtcgccacggtggcgtcgcccgacatcgcggcggggtccctcgcggacggcgacccgttcgacgcgccggtcggcggcggcggtgacccgtccgcgggcgagccggtgcggatcaccgggaccgtgctgcgcgtcgtcgccgcgccggagcccggcgtcgccggcagcggtggcggcggcacctggatctgcgtcgcgttcggggtcggcaacgtcctcgtgctgagcccgcagctcgcgcagatcgtcgagcccgacgagctgtggcggctcggcctggacccggcggatttcgacgtcgtggcgatcaagtcgcgggtgcatttccggcgcggcttcgacgacagcggctacgcccgcacgatcctgctggtggagccgccggagccgtttctcggaacggtgcggctcgatcacctcgcctacgcgcagatgcgggccgccgacttcttcccctacggcgacccgcccgggcccgtcccgtccgacccgtga

SEQ ID NO: 6552 - DNA, 291 bp, Methylobacterium sp.
gtgaccttcacctggcgccggacgttcccgggcactcaccacgacttcgtggccgaggaggccggccagcacgtcggccgcatcaagcggatggacggcggcccgcagaacggtacgtggacgtggagctgcaccggctgccagcgcggccacgaggccgagggcgtccggccgctgaacggcatggccgacacgcgggacgaggcgatcgaggcgcttgctgccgcctgggcgcgggcgaaggcttggagcgcgcgcagctggcagccgctggtgccgggtggctcatga

SEQ ID NO: 6553 - DNA, 156 bp, Methylobacterium sp.
atggaatgggtttatcgcggcttcgagacctcgatgctcggtctcgctctctgtctcggactcggcgcctgcctcacgctcggaaccgcgcgcgtgccggccggaacgctctccgtcaccctgccgatgctcacggtgaccgcccccgcgccctga

SEQ ID NO: 6554 - DNA, 2535 bp, Methylobacterium sp.
gtggccgatgaaatcctccgcatgcaggccgaggtgcaggaccgctacagcggccccctgaaggcccttcgggcccagctgcttgataccgcccgcaccggggccgaccacagcgcgacgttggcgaaggggttcaaggcggtcgaggggacgatgcagtcgacggcgcggactgcgtcgagcgtcctgaacccagcatttgcaggtctcggaataacaggtctaacggcaggcgccgccgtgactggcatctcgaatgcgcttaacaaattgaccggtagcatgctgagcgtgggccagctcagccgcgaaactggtgttgccgccaaaacgcttcaagaattctcgtctgttgctggtcgcttcggcgtcgagcaggacgcggtagcctccgccaccaagaacttcgccgcccagatgcggaccttctcgatcgggaccggggaggcgttccgatgggtgatgcagcaaggccgggacgcgtctggccggaaggcgttccaggatttcgccaccgacctgcagcgtacctccgacgagggcgagaagctgaagaaggccctcagcttcatggagaccatcaaaaacccggtggagcggggcattttcgcccagcagttcttcgggaatcaggacctgggccggatcgccgatgggcacctcgggcgggtcgtggacctgttcaagaaggcgcgagagaagctcggcgagttcaggccggaggacatcatcgatgcggagaagttcgaccggtcggtgagcagcctcaagggctcgatgcagcggctgggcacgacgatcgcccgtgaggtgctggggccggccaccgagctgacaacgtgggcggatgatctggtttccggcaagcgtgccgacgtgaccaagtcgctccgcgaaggcttgcaagagctgaagaaagagctcggcgagatcaactggaagcagttcggagacgacagcctaaccgttctgcgtgagtcgactgcgctggccggcaagacggcggcggccttccatgcaatcgccgaagctatccacgcgatccgtgagggcaactacgccggtgcggcccgcggtctcgacggcgcgtcaggtccgctcgctcgccggctggcgccgcgggtcggcgatgatgagatcgcggcgaaggagcaggttgagtcctggaagaaggcgcttgccgaggccgagtatgaccaggagaccggcggcccggcgatcgacttcaagtcgcgggagccgctcctgcgcaagcggttgaaggaatcggaggacgtgctttccggcctccagggccgcacgcccgagcagcgccagaaggactttgaggccacggagaagctgcgcaaggcgctcgacgcgaacacggaggagctcaaggccagccggaacggcgccacggtgcagaagcagtccatggacacgcagggcggcctgttcggcggcgccacggtgcagacggcgggcttcggcagcggcttccggcggttcggcggttacggcggcggctctgggccggggtatgcgggtgagcagggcccggcaggcggcggcgctggtcgaagtctcggaggtggaggccggttcaacggactgggtagtagccgacccagcgtcgcgccgatcgggcctcgccccacggtcccacagcttgggggtccagccgagactgacgagcaggtgaccgtccacgggcacaaatggaatcccggtgccagcacctcggcaggtaaggctcgggttcaatcctggctgcagttcttccaagcccccgtggatcagggtggcctgggtgcggatgccggcacagcccgcgccatggtcgcgatgatgcagggcgagagcggcgccaacctgaaaccggacgctgaaggcgactacaaggacccggtcaatcgtcgcaatccgaccgcgttcggcacggcgcaatggcggcttgagcgattccaagcgttgaaggacatggcaggccgcatgggtacccaatggaccgatgttggcgcgcagcagcagcactttcggaacgaggtactgaacggccgttaccgcggtgtctggcgggacatcctgaacgcgccaaccgaggagcagaagctacggctgggcatcggtgggttcgagcgcccaaagtatccaggactggcctacgatttccggcttccgaacctgcgtcggcttcagcgtggcgctgcggcgaccggaggggcgaccgccgagcgtgccgatggcagcagcgccgcgctaatgcgaccagagcgcgccgacggcgccggctgggcggcccgtgaggcagcccggaagacctttgaagcgcagcaggcggaggcagcaggtcttcgtgccagcggcgcacgtgtggcgtctgcggcggctcaggcgggcgtggtggccatgccgaaggtcgaggtgaacggtagcgtcacgaacgtcgtggagcggcccggcccggacacgcggatccggactaccgccagcggcaagctcttccaggatgtggtccagcggagcggtgctcagatgaggcgagctgactga

SEQ ID NO: 6555 - DNA, 2031 bp, Methylobacterium sp.
atgtctcaggacgaagctctccgcatggccgccgtcgtcaccgacggcttcacgggtcccctcggcaagttgcgtgacacgctccgaacgatcggacgcgagggtgggcagcacaacgacgcgctcgccaagggcttcaaaggcgtcgagaccgcgatgcacggcgtcggccggaccgcctcgacggtggtcagcccggcgctcagcaccatcggcgtcacgtcgctgtccgtcaccgcggccgtgctgggtgtcggcgcggccatgcgcagtttcgtgagtgccggcgcctcgctcgggcagatgagccgtgagaccggcgttgcggccaacgagatccgcatcctttcgagcgtggcgggcaagttcggcgtcgagagcagttccgtcgagggcgcggtcaagaacttcgccaaggcgatgcgcgagatgcacgcgggttcgcgcgagaccatgaactacctgatgacgcaggggcgcacggccgaaggtcggaagttctttcaggatctcgcgcgcgatatcgacagcacgtccgatcagggcgagaagatgaagaaggtgatcgaggcgatggaggccatccccgatcccgtcgagcggggcatgttcgcccagaagtttttcggcaacgaggatttcggccggctcggcgacaagcacctcggcaagatccaggagatctggaaaaagacggctcagaacctcgggccgctggatccgaaggcggtggagagcgcggagagctttgagcgctcgatgaaaagccttcagaccacgatgtcgaagatcgggaccacgatcgcgagcgagctggtcgggcctgcggagcagttctccacgttcctgtccgaggcggtgtcggagcagcgtggcggggccatcaaagcgatccgcgagggcatacagggcatcgggaccgaattgggccggacggactggcagaccgctggcaaggacgccaaggcgttcctgagcgagacgacggcgctcgcgaccacgctggccggcgccctcgcgcgcattgccgagacgatccactcactccgcgaaggcaagatcgccgacgccttccggtcagcggacggcggcagtggcccgttggctcgcaagctcgctccgcgcgtcggcgatgaccagatcgaggcgcaggaaagcgtcgatcgtctgcgcaagctcctcgacgtgtctaaagaagcgcagcagcacgtcattggtcgggctcagatcggcgcaggcctgctggatgcccctgagaaggtgcagcgcgatctggaggccgccgaggctcggctgaaggtgcttcagagccgcacacctgagcagcgtcagaaggacttcgaagcgtcggaacggttgcgccgctccgtcgacagtttgaccgaggagatgaaggcagcgcgcggaagcgggaacgctacggttcagcagcagtccttcgatggggccggcgccgggttcggcggggctcgcatccagacggcgagcctaggtggggctgccgccgcagcacgggttggaaacatccttggcggccgaggcggtggcatttacgcgccgggcggcggtgaaggtgccgtgtcgcctccgctcgatcccaacgaccccgttgtgcgccgtcgatttgatgcgttccgggaaaaccggggcggtggccgttcgttcggcgagcctgcgaccccggccgagagggttggcgaaaggcttcggggcgaaggcgctagcggtgccggcgaccccggcatgctggacctgatcgcccgcgctgagggcaccactcgccgcggctacgacgacagcttcgcccatcaggtgtctggatccctcacggacaagacccttggcgagattgagcagatccagcgtggcatgcgcgggtcctccgcgatcggcaggtatcagttcatgcgcaagaccctgtttggcgggcgccggggcgacaccggcctcgtgggtgagttggggctgagccgcgacgacaagttcacgccggagctgctgatcctccctcggcatcgcggacacctctga

SEQ ID NO: 6556 - DNA, 1728 bp, Methylobacterium sp.
atgtccgagatgtccgagcgcgccaacatgaccggcgcccacgccctcgcggtcgcgctccaccggcacggcgtccgcgacgtgttcggccagagcatcccctcggcgctgttcctggccgcgccgcaccacggcatccgccagatcggctaccgcaccgagaacgcgggcgccgccatggccgacgcctacgcgcggatctccggccgggtcgcggtggtcgcggcccagaacggtcccgccgcgaccctgctggtgccgggcctcgcggaagccctgaaggcctcgatcccggtcgtggcgatcgtccaggacgtccaccgccgcttcaccgaccggaacgccttccaggaactggaccacctcgccctgttcgcgggtgtcgccaagtgggtccgccgggtcgcggtcgccgagcgcatcgacgactacgtcgacatggccttcgcggccgcggcctccgggcggcccgggccggcggtgctgctggtgcccctggacctcctcgacgagcggccggacttcgaggccgccgcgccgcgccggtcggcgagcctgggcacctaccccctcgaccgcacggtcgccgacccggcccggatcgccgaggccgcggacctgatcgccgccgcgcggcgtcccctcgtgatcgcgggcggcggcgcccattcctccggggcctacccggaactcgccgccctgcagggcctcggactgccggtcgccacaacggtgatgggcaagggcgccgtcgccgagaccgacccgctctccgtcggcgtcgtcgggtacttcatggcgccgcgggcgcgctcgtcccacctgcgcagcctcgtcacggaggccgacgtcgtcctcctcgtcggcaaccgcaccaaccagaacggcacggacagctggtcgctctacccggcggacgcccgcttcatccatctcgacgtcgacgggggcgaggtcggccgcaactacgaggccctgcgcctcgtcggcgacgccaagctgaccctcgccgccctcgccgaggcgcttcggcagcgcgacctggcgggattggagggccgccgcgcgccgctcaccgacacggtcgcccgcgcccgcgaggcccaggccggcgacatggcccgcctcgtcgacatggaggccgcgccgatccgcccggagcggatcatggcggagatcgacgcggtcacgaccgccgagaccgtcgtcgtcgccgacgcgagctacgcctcgatctggatcgccaacttcctgacggcgcggaaggccggccagcgcttcctgacgccgcgcggcatcgcgggcctcggctggggcctgcccttcgccctcggcgccaaggccgcccgcccggacgcgcccgtgatctgcgtgaccggcgacggcggcttcggccacgtctggtccgagctggagacggcgcggcggatgcggctgccggtcatcgtcgtcgtcctgaacaaccagatcctcggctaccagaagcacgcggagctgagcctgttcggcgacttcaccgacgtctgcgacttcgaggcggtcgaccacgccgccatcgcgcgggcctgcggctgtgccgggacgcgggtcgagcgccccgaggatctcgcaccggcgctgcgcgacgcgctcgccggcggcgccgtcacggtgatcgacgtgatcaccgaccagcgcgcctacccgccgatcaccagcttcgagggcaaggacgccctcgcctactga

SEQ ID NO: 6557 - DNA, 669 bp, Methylobacterium sp.
gtgccggactgggtccgtccgatcgtcaaggagagcctgagcgagcgggcctaccgcgagctgcgcgtcgcgctgatgcgcgggcagttgcggcccgacacgcgcctgcggctccggccgatgtcggcccggttcggcatcagcgcgactcccatgcgcgaggccctgctccggctcgtcgccgagaaggccctcgcactcgacgcgcgcggcagcgtcgtcgtgccccgcctgaccctggatcagctcctcgagatcagggcgatccgcaccgacctcgaggggcgtgccgccgccgctggggcagccaggcgcgcggccgaggtcgacgacctcgaggcgatccacgcgcagatctcgcactgccacgcgagccgcgacttcgcgcgggctgtgaacctcaacaccgaatttcacctgacgctgtgcagactcgggcagatgccgatcctgtacgagatcgtggagttgctgtgggtgcgctgcggcccgatcctgtcgcacctctacgatgacggcgtccccgactgggaaccgcacccccatcgccgcatcattgacgccctgcgccgcggcgattcggaggcggcccgggatgccgtgcgcgaggacatcgagcgcggcgggagcggcctgttcgcgcatgtccgcgcggccgccacagggtga

SEQ ID NO: 6558 - DNA, 648 bp, Methylobacterium sp.
gtgctcgtgatgggtagcctgccgatcggcctgggccacttccgccgcgatgagcgcgggatcgccgccgtcgagttcgcgctcgtcctgcccctgctgatcgtcctgtatttcgggaccgccgagctgacgcgcgtcgtcgacgcgacccggaaactgaccctgttcgcgcgcacgctgggcgatctgtccggacgggtggacaacgctctggccacccagaacgggatggctctggcgacacaggacgggatgacgaagatcaccagtgcggcgaccgcgatcctgcgcccgctggacgcgtccggcctgcagatcgtggtcaacgcgatgggcgtggaaacggtcaacgggtcgctcaagggcttcgtctgttccagctggccgcagaacgccacgcagcggccggccaaccaggccaacgggagcaacggactccccgccacgccggccgcctatcagttcgacggggcccgctacatcctggcggaagtcacgatgccctacaccccgatcatcggaagtgccctgtaccgctggatcttcggcggccgcggattgaccttcacgcggcagatcccgtggtccgagcgcacccccagcgagatcgtcatgccgggcggcaccgcctgcccggtctacaactaa

SEQ ID NO: 6559 - DNA, 636 bp, Methylobacterium sp.
gtggggcaggcgatcctcgggaccgcggcgtgcgccgatccgacgctgacccggctggagacggaactcgacgccgcctacgaacgggcgcgggagcgtgtagccggggaaccggctctcgtagaagcgttgcgcggcgagcaggcgatgtttgccgagggccgcgcggccgtcgcggcgttgcccggtgcgagcttggccgactacctggcgtcgtggcgatcctggctcgacgcaatcggtccgccgaggccgggctgggacggcatctggctcaccggagccggcagcctagagatcgcgccgcggggagacggcgtctaccgcatcgtggcccacgcggacgagccgacgcgcggcgcgtacacttgcgcgttcatcgggatcggccggttaaggggcgacgcgatcgaggtcgagtgggacgcagcggacggcggcgacggagcggacggctggacgctgacgatccggcgtgccgaggatctgatgcatgtcgagcagcatcgcggcggcagcgaagcggtgacgccgccgttctgcggccaccacggcagtctagatggtcactatcttccggcgctggtgaagcccgggtccgtgaccgcctggggtcccgcacgggcgacgccctga

SEQ ID NO: 6560 - DNA, 2970 bp, Methylobacterium sp.
gtgcctgggcgcctgaggccgccgccggtccccgatgcccgggagccgctcgcggccctgcgcccgcgcggctgggtgcatgccggcacgatccccctcgacgggatcctgatggcgcgcggctccgtggggccagactggcgcgcccggctccttccctggctcgagcacgccgcggaggtgcgggcacgcggcgatcgcgtgctcgtgctgttcgccgcgcccgtcacgcgggactgctcggccctgggaccggtcctgccggtcgtgcgcagtgccgggatcctgaccgccgtgcccctcgccgagccggaggcgcccgtcgccgcggccctgcgggaccatgtcgtccacatgacggggggacgcctcgccgccgagccgctggcggccttcgccagtctcgacatcgccggctggtgggatctcgacgcgatcgcggtgcatccggccgaacgcctccccgtcctgcgaccggcgccgccggcgcgccgcctcgtcagcgcccccgccctcgtcgccgacgcggatcccctcgcgccggtccgcgacgccgtgagccggcggccgcggcgccggacgaagcacgtcctcggcgatctcgtcacgcgcggccggcgcctgatcgtcggcgcgttggggctcctctggaccgcctacgtcgtcctgctggccttcatcatggtcggcgccatggtgctcggcttcgccgagaacgtccggacgacggcggagcacggggccgccgcggcccactggggcagcctcgcgctgccggtgctggtcctgctcgtcctcgcgtggttcgcgttccggcgccgcggagcgcgggccgcgcgtgagggcgccgcgccctcggccatcccgcccgccggcaccgggcgcacgcccatctggcgccgggcagcggcgtggctcgcgtggcgctcaccctatgcggcccatcttcgccgcctctatgcccggcggctcaccgaggtcgagcggctgttcgcggcggggcgcgtcgacgaggccctgtaccgggcgatcggtctcggcggcgaggcgcggcgcgggagcgccttcgccgacctgcccctgaccgggcccgggctgcgcaggagcctcgacctcgatctcgggccgcagcgagcgagcggactgagcctcgcgcccgcggacgagatccggctcgcggcgctctaccgcgcgcaggccgtggcgatggccggacgcggcgacacggatcgcgcggccttcgtgctcgacagcctggtcgggaacccgcacgaggcggtgcgcctcctcgcggaatccgggcgcctggagaccgcagcccgtctggccgaggcgcgccgcctcttgcccgcgacgacagtcccgctctggttccgggcggggcagaccgagcgggccctggcactcgccgcccgccacgacgcccacgcggagctctggaaggaactcggggccgacgatccgttccgaccggtcctggccgaggcctgggccgcgcgcctcgtcgggatcggcgccctggatcgcgccgccgcggtcaccttcggcctgcccgctctggccgagcggcgactggactggatccggcaagccctcgacgccgaggcgccggtgcaggccgagcccctcgcccgagcgctgcgggccctgccctgggagggacgggacggcaaccggctgcacgccgccttcgcggatctggtgggcgcgaccggggccgaggcggcggggcgccggagcgcggtcgccgcgctcctgctcgacgcgcagttcgagggcggtccggagcggccgccgacgcccgccttcgcgctcctctgccgcggcctcgcgcgccgcctcgccaccgatgacggcatcctcggccacgatgcggagcgcgcccggctcgccgggcgcctcgcggaagccggcggacaggtcgccctgcgccagcatctccggcagctcaggacgcgctccgcaccgtccgcctcccggctgagcggcccgctcgtcgtcccggacggcccggcgctggccgagatcgccgatgccgcgctcctgtcgggcgggcggctgctcctgggctaccgttccggtctcgtgcgcctcctcggccgagccggccgcgagcgctggcggggacaggtggatggcctgacgggcttcgcgcgtctcggcgcgggcgaccgggccatcgttctgcgcgagacgctcgaaggccccgacgtccagctcttcgacgccggcaccggacggctcctgccgctcggtcctctgccgatcacgcactggcatggtcaggcggacgagaccggctggctggtcttcgacggagaggcgctcgtccggctggacaccgcctcgctcctcggtcgcgcgggcggcgcgcccggctccgacggcgccctggcgcaccattggcgcctgcccatgaccgaaccgggccggccgctgctgctcgccgccttcgcggacgcgagcgccctgatctatgcccggcacgacggcctgatcgagtggtggagcctgtcctcccgcaccctggcggtgacgtgccggttctggaccccgcccgatcgcggcagcggcgtgctcggcctgacggaggccgtcgcgtggtctctcgaggggaccggcgcgaatccgcacctgcgtgcgcatccccacgttttcacgacggccacccgggagcaggagcgcgcgttggtcgaggccgccgcgcgcgcggaggccgcggatccgccgcgcctcgtcgcggcggagaacgaccgcctctgggccgcgaccgccaccgaggaggggacgctctgggccggcgtgcccggcgcgaaccggatccgcggaccggccgtgctgtggcagggcagcgggagcctgcgcgcgcgcttcgctccggagggcgacgtcgcggccatcctcgacgagcgtggccgcctgatcgtgttcgagaccgtcaccggacaggtgaccctgcgcctgatctga

SEQ ID NO: 6561 - DNA, 1914 bp, Methylobacterium sp.
gtgagcgccgcgtcgtcgagtctgcggaagaccctgccgccggcgctggcacagtggacggcgctcttctccgacatggcggaaccggatctgcggatcctcgcggcgctggtcgaggcgctgcggcccctcgtcgagccggccgacggcgcgggcgggcaaccgcagggcgagatcgacgggctggggggcctcggaacacgcggcgggatcgagcgcctcgtcgcctcggaatggctctggcgcgacctcgatccggacgccttcctgcagcgcgcggccgagcgcgacctgctgaccctggagccggtctaccgtcaggcggcggatgcgggcgccgtgctggtcgtggtcgatgccgggccggaactcctcggcgccccccgcctcgtggccttcgcggcgctgctctgcctggccggcctcgcccggcggcgcggggcgcgccttctctgggcctcgaccgccacgccggagcggcgctggctcggcgcgttgaagcggtccgacgccgcgatccttctccgcgagagcgccgccacatccctcgacgcggtcgaactcgaacgggtcctggccgagccggtcgcgacccgcgcgggcgggcggcccggcgccagcctctggctcatcggcgggtccgacctgcccgaagcggcgcgaccgtgccggcggatcaccatcgcggagcggccgcgtctcggatcggacggcctcgccgtggccgccgacgtcgcggtcctggacgccagcggccctgtcgccggcgcgcgcctggacctcccgccggagcgcgaggccgtggggctgttgcgcgacccgttccggccccgtccggctcccggacgcccgccgccccggcggtccacgcccgaccggagcgcggcgcctccggactgggcgccccgcgggctggccttcgcgccctgcggcgagcacctcctggtggcgcggcccgacggcatcctcatcgtccccgtcaccggcacatccggcgcgctgcgcctgccggtcgcgccctacgagcgcctcgtggggctcgacgtcggccggtcgcggatccgcgccgcgtgcctcaacgtctacgccgacgacgcgcgcctgacgctccgcagctggaccttcgaccgctcgggcgccgctgcgacactcgaccggcggatcccgcgggaccatcccctggtgagccggcgcctgccgaaggcggttctgccgcccctcgggacgctaaaacgccgcaaccggtcctggctcctggcggccgacggcacggccttcctggtctccgagaagcggctgatcgagtacgcgccgctcgcgggcgaacttcccctcgcggtcacgcccgcgggtctgctgatgcgcgatcgcgcggacggggtgatcgcgcggcggccgtccgacgggaaggtcgtggcgcggttccccagccgggccgagtcgctgcggccgggcggcggcctcgccctctgcgcggtgcgcgggcagcccaccctggggatcgagcaggcgggcgggcactgggacgtggtgaacgccgcggacggaacggtcgggcacctccggccgcagggccggatcatcggcatcgtgccccagtacgacggcgtgcgcggccaggccgtcgagggcctcctcgccctccatctcgaccgcgaggaagcaggctcggcgcgcctgacgttccggaccccggacggcgtggcggcgggcgatcccctgacgcttccggacgcgaccctcgacgcggtgcgcgtcaccgtcgatgccgatgccgtcccgtgcatcgcggccgcgcggtgcgacgccgcgggcttcgttgacgcgctcgccttcagccagctccaccgcggatggtcccacctgacggatctcggcgcgttcgcggaaaccgtcccgtgcctgggcgcctga

SEQ ID NO: 6562 - DNA, 1077 bp, Methylobacterium sp.
atggtccacctcgcgctggtggcgcgcgagcatctcctgctgatcggaccgcccggcaccggcaagtcggccgcggtgcgggcctgcgccgccgggaccggggcgcgctgcttcgagtacctgatcgggcgcttcaccgaaccggccgaactgttcggcccgctggacctcgaggcgctacgcgcggggaagctgcggccggacatctccggcatgctgccggaggccgagttcgccttcctggatgaggtcttcctcggctcgaccgcgatcctgaacgcgcttctcggcgtgctgaacgagcgccgctaccgccgggggcatttcgacaccgccgtcccgctgcgctgctgcgtcggcgccagcaacgccctgccggaggatcccggtctcgcggccttcgccgatcgcttcctcgtcacggccttcgtcgatcccctggccgacaccgacctggaggccctgctcgccggcgacccggtcgcgtccgtcgaacccggcgacggggatgcgccgctgacgctcgcggagatcgacgccctcgccgaggccgccgcgcggatcgacctcgcgccggtccggcccgcctacgcgcaggtggtgcgcaagctccgcgcccgcggcgtgcggctgagcgaccggcgcgtggtccgggggcagtcgctcgtcgcggcggcggcgctcatcgcgggccggacggccgcggaggaggccgacctgtggccggtgatccacctcgttcaggaccggatcgcgcaggacgaggcccgcgacctgctgcgcgtcgagctcggcgccgcggcgagccccgtcctgcccgcggccgccaaggcggcgggctacggtccggccgcccgggccgcggacctcgccagggagggggaggctctggccgcctccgccccggacgaccgcaccgcccccaccttcgaggcctggctggtccgcgccgaatccttcctcgtgcagatcgacgccgccttcgggacggaggagcgcccgccggccctcgctgcggcgcgggacgcgctgctgacgcgctgccgggcaccggtcccgggcatgaccccggcgtga

SEQ ID NO: 6563 - DNA, 2346 bp, Methylobacterium sp.
atgatccgcgggttcgggaggtccgggatcgcgcgccgcgtcctcgtggtcggcgcgatcccgatcctcgtcgcggccgccatcgcgctgggcgcctggatcctgctctacgaggccgagcgggcccggaccggcgccgtggtggcgaccgagaccgcacagacgctgacgtcgatgaaccgggcgcgggcggacgctgtcagcggcggcaccgcgcggcgggacgaggccgagcgacgcttcgacgagcgggccgccacggcggccgggcagctcgaacgtctggacggtctcgcgcgcacgcgcggccagtcggctctcgtggcgaccgtcacgggcgatctgaactcgcaggcgacgcgcatgcgctcgctcctgctctccgagcggacggcgaacgcgacgatcgccgatatggcccggcgggcggacgccctggtggcgctgaccgacgtcgcgcgccggcgccagcagcaggacaacgcccaattgatcgccgtcctggccgtcaaggatgccgagctggagcggaaccagggcgtcgtcacggccctccgggagctccgggaggcgatcagcaccgcggagctgaaccgggcgcgcatcggccgcccggtcttcccgatcgagttcgatgagctcgccgccgacctacggcagctcgatgcggtgggcgaccggctgcgccgcgtcctgcgggtcgacggcgaggcgggggcggcggaccgggcgacggagctcctgaaggcgtaccgcgaccggagccggaccgaggacggcctgaaccgggtgctctccgagggcttcgagctgacccgcgcgacccaggccggccgcgtcctggtcgagtggtgcgaccagctcgtccaagtgaacgtcacccggcagaaccggctctacgaggaggtcgcgctcctgatccgtcactcggtcctctcgaacgaggccgagctctccgcccaggacatcgccctcacggccctacgcctggcccggcggacggatgcggccctggcgcgccgggatactgcggaagcgtcgcgggtactggaggcgggcgcggagctgtcgggcacgtcccggacgctgctcatcccggtgagcatccgggacgagatggcggaggcgatcgacgggtggcgcacgcagctcgccgcgacgatcgagaagatcggcgagcagaacgagacgatcgccgacatggacagccgcgccgccacgatgagcgccaacgcgcagaccctgagccgggccttcatcgacgatgccgaccagttcggcagcgtgatccggcagctgctggtcgtgggggcggtcggtgccctgtgcctggggatcggcgccgccgccgcggtggcgcgctcgatcacccggccgctgcacgcgctccagcacagcatcgtcaccgccgccgccgcgcccgccccagaggatatcggccgcgacagccacctgctcacccgacgcgacgaactcggcgacatcgccagggcgaccaacgcgttcctggagcagatccgccgccgcgaagcggaccggcgcaacgcgtcgcagcgggccgacgacgcgctcacgaacttgcggcaggcccaggaggacctgatccgcgcggagcggctcgcctcgctcgggcagctcgtggcgggcgtctcgcacgagatcagcaccccgctcggcatcgccctgaccacggcgacgcaggtccagtccgactcggccgcgttcgagcgcctcgtgggcgagaaccagctctcccggtcgcggctgacccagtatgccgggcggatgcgggagggcgcgcagctgctgaccagcaacctgatgcgcgcggccgatctcctctacagcttcaagcaggtggcggccgatcaggccatcgaggaccgccgcccgctgaacctcgcggactggatcgacgagctgctgaagagcctgcgcgccctggcgcggccgggccggcacgtcttccaggtcgagtgcccgcccgatctcgtcgtcgacaccctgccggggatcctggcgcaggtcgtctcgaacgccgtcaagaacgcgatcgagcacggcttccaggatcgggagggtggccgcatcaccatcacggggatccggtccggggacggcatcggcctctcgatcgccgatgacgggcgcggcatcgacggggccgacctcggccgcgtgttcgacccgttcttcacgacggcccgcgcccgcggcggcacgggcctgggcctgcacatcgtccacaacctcgtggtgaaccgcctccaggggcgggtcgaactgcagagcagcgcgggtgccggcacggtgctgcggctgtggcttccggagcggctggcatga

SEQ ID NO: 6564 - DNA, 888 bp, Methylobacterium sp.
atgcccgcgtctccaagcctcgcccgggaccgatcccgcatcgcggccctcgctctggcgacgctgatcggcgtcggcgatccccggccgggctggtccctcgacatgccggacagcccgcgtcccgcccggccgtcccggccggtgccgccggagctggccgcggccctcgcggcctacaggacctacgtcgtggcccaggccgacgccttcgtgcgcgagaccgcgcgcttcgtcgcggcgatccaggccgggcagctcgcggaggcgcgccggctctacgccccggcgcgcgcgccctacgagcgcatcgagccggtggcggccctgtttcccgagctgatcaagcgtctcgacgtgcgcagcgacgagttcgagctgcgcgagcgcgatcccgccttcgtcggcttccatcggctggagatggcgctgttcactctcggcaccacggaggggctcggcgaggtcgcggagcggctcgccgccgagaccgtgaccctgcgcgaccgcgtcgcggcgctcgccatcccgcccgcccgggcggtcggggcggcctcggcactgatcgaggggatcgccgccaccaagatcagcggcgaggaggagcgctacagccgcaccgacctgtgggacttccaggccaatatcgagggctcgaaggtggtgttcacgctcctgcggccgctgctgacggaccgggacttcgtggcccgggtcgagcgcagctacaagagggtcgaggacctgctcgcacgctaccgcagtccggatggcggcttccagagctacgacaacctcaccgcccgggaccgcaacgccctgaaggggcccatcacccttctggctgaagatctgtcgaccctgcgtggccggttgggtctagactga

SEQ ID NO: 6565 - DNA, 1245 bp, Methylobacterium sp.
atgatgcgtttcccgtcacaggtcaccacccgccgccagcttctcggcggactcggcgccgcggcgctcgtcggcccggcccgggcggaggacgccacgccgaccatcgccacggaagggacgctcgtcgcccagcccttctacggcccccaccaggccgggatcgtcaccccgcagccggccgccgccctgtacgtcgccttcgacgtgctggccgagcggcgcggcgagctgccccacctgtttcgaacgctcaccgagcgcctcgccttcctgacgcgcggcggtgccgtgcccgatctccacccgcagctcccgccgcgcaattccggcatcctcgggccgaccatcctcccggacaatctcaccgccaccgtctcggtcggtgcgagcctgttcgactaccggttcggcctgggtcgcgcccgcccgcgccatctcgggccgatggagcgcttccccaacgacgccctcgacccggcgcagtgccacggcgacctgctgatccagttctgctcgaacaccgccgagaccaacatccacgccctgcgcgacgtcatcaaggcgacgcccggcctcctcacgccccgctggaagatggagggcttcctcccgccccacgtggtgaagaccatgggggccgacaccgtgcgcaacatgctcggcttcaaggacggcaccgccaacctcgacgtgcgggacctccggatgatggaccgttacgtctgggtcggagcggggcaggacgagccggcctggacgacaggtggaagctaccaggtggtgcggatcatccgcaccctcgtcgagcgctgggaccgcacgccgctcggcgagcaggaggccatcatcgggcggcacaagggcagcggcgcgccgctccggcagggacacgagcgggacgtccccgactacgccgccgacccggacggcgaggcgatctcgctcgcggcccatatccgtctcgccaatccgcgcctgccgggcaccgagggcagtctgatcctgcgccgcagctacaactattcccgcgggctgaccgccgccggccagctcgacatgggcctgctgttcgtctgctaccaggccgacctcgccgccggattcatcaccgtgcagaaccgtctgtccggcgagggtctcgaagagtacatccgtccgatcggcggcggctatttcttcgccctgcccggcgtgtcggggcccggttccttcctcggggaaggcatgctggccgcgacctga

SEQ ID NO: 6566 - DNA, 1302 bp, Methylobacterium sp.
atgcagacggatcgcgtcgatccgacctaccgcaagctgcgctggcaaatcttcgcgggcatcttcctcggctatgcgggctattacctgctgcgcaagaacttctcgctggccatgccctacctcgtcgagcagggcttcagccgcggtgagctcggcaccgcgctctccgccgtcgccatcgcgtacggcctgtccaagttcctgatgggcatggtctcggaccgctcgaacccgcgctacttcctgccgatcggcctcgtgctctcggcgctggtgatgttcctgttcggcttcgtgccctgggcgacctccagcgtcggcatcatgttcgtgctgctgttcctcaacggctggttccagggcatgggctggccgccgagcggccgcacgatggtgcactggtggtcccagaaggagcgcggcggcgtcgtctcggtctggaacgtggcgcacaatgtcggcggtggcctgatcggtccgctcttcctgctcggcctggcctggttcaacgactggcacgcggcgttctacgtgcccgccgccgtggcgctcggcgtcgcggtcttcgccttcatcaccatgcgcgacacgccgcaatcctgcgggctgccctccgtggaggcctggaagaacgattatccggacggctacgacgcgaaccacgagcgcgagttctccacgcgcgagattttcgtcgagcacgtgctgaagaaccggatgctctggtacatcgccttcgctaacgtcttcgtctacctgctccgctacggcgtgctggattgggcgccgacctacctgaaggaggccaagcacttctcggtcgacaagacctcctgggcctacttcctctacgagtgggccggcattcccggcacccttctctgcggctggctgtccgacaagctgttccgcggcaaccggggcgcaacgggcgtggtgttcatgttcggcgtcatggcggcgacgctggtctactggctcaatcccgagggcaatccgggcgtcgacctcgcggccctgatctgcatcggcttcctgatctacggaccggtgatgctgatcggcctccaggccctcgagctcgtgccgaagaaggcggcggggacggcggcgggcttcacgggcctgttcgggtatctcggcggctccgtcgcggcgagcgcgctggtcggctacacgaccgaccattacggctggaacggctgcttcatcctcctgctggcggcctgcgtcctcgcgatcgtctgcctgtcgctgaccctgcggcacagcagcaccgcggtcgcgcagcctgcctga

SEQ ID NO: 6567 - DNA, 1125 bp, Methylobacterium sp.
atgagccggacggacaacgccgatgccggcgatgaggtcgccgggatcgtcctcgatcaggtcgagcggttgctcgcccagcacctcacgccggcgctgctggcggccagcgacggggccgcgggcgcggccgcgtggccgacggatctctgggcggcgctcgccgagagcggcctgccgctggcgctggtgcccgaggcggagggcgggatcggcctcgccgccacggtcgccgcccggctgatccggcgctgcggacgggccgccctccccttgccgctgccggagaccgtcgccggcgcggcgctctgggcagccgcagggggacaggtgggcgacgacgccctgtcgctggtcccgggcggcggtcccgtgcggatcgcgccgcacgcggagggtttcgttctggacggacgggtcgcgcaggtgccctggggcggttcggtcgccgccctgctcctcgacaccgtcgatgcgtccggcgtcccgcacctcgtgcggatcgccgcgcccggcgcgatccgcgacacgcaccacaaccttgccggcgagccgcgcgacacgctcgatctgaccggctgcaccgtcccggccgaggatgtccgcgccgcgccgggctgggcgaccggtacgggcgtgccgtccgtcgaggcagccggcgcctgggtccgggcgcagcagatggtgggcgccctggagacctgcctcgcctccgccctcgatcacgcccaggagcggcagcaattcggccggccgctcgccaagttccaggcgatccagcacatgctggccgaggccgcgggccacgtcgcggcggcgaccgcggccgccgatctcgcggccgcctgctggggcgacccgcgcttcgtcctcgcgaccgccatcgcgaaggcgcgctgcggcgaggcggcgggccacgtcgcggcgatcggccaccagattcacggggccatgggcttcacccaggagcacccgctccaccgcgccacgcggcggctgtggtcctggcgcgacgagttcggatccgacgccctctggcaggagcggatcgggcgcgcggtctgcgcgggcggcggcgcggccctctggccgatgctggtcaggctccgcggcggtgccggctga

SEQ ID NO: 6568 - DNA, 1152 bp, Methylobacterium sp.
atgcacagtttccgcttcagcgccgagccgctcccgcccgaggccgagtccgcccgcgcctccgtccgcgccttcctcgacgcggaacgggcggccgggcatttcgtgccgcaccggacctcgtggacgaccttcgacgccgccttcagccggcgcgcgggggccgcgggcctcatcggcctgacgatgccggaggcctatggcggccacggccgctccggcctcgtccgcttcgtcgtcaccgaggagatgctggcggcgggcgcgccctgcggcgcgcactggatcgccgaccgccagtcgggcccgcagatcctccggcacggcaccgaggcggccaagcgggcgatcctgccgcggatctgccggggcgagtgcgccttcggcatcggcatgagcgagccgaattccggctcggacctcgccgccgtccggacccgcgcggtgcgcgacggcgacgattgggtgatcaacggctccaagatctggacgaccaacgcccatcaggtcgactacctgctggccctggtccggaccggggagcccgggccggaccggcacggcgggctgacccagttcatcgtcgacatggcggcccccggggtgacggtgcggccgatcctcgacctgtcgggccatcacgagttcaacgaggtgttcttcaccgattaccgcgtccccgacgcgatgcgggtcggcgccgagggcgcgggctggggtctcgtcacggaggaactcgccttcgagcgctcggggcccgaccggttcctgtcggattaccggctgctcgtcgaactcgtcgaccggatcgggccggagccggaccggttccaggcggtcgagaccgggcggatggtggcgcagctcaccgcgctgctgggcatgtcggcctcggtggcccgcctcctcgaccagggcatcgtgccgggcgtcgaggcggcactggtcaaggatgtcggcaacggcttcgagcgcgcggtgccggagatcgcccggcgcctcgtgccggtcgagccgagcctcaccgcgcagggcgacgccttccgcgaggcgctgggcggcgtgatcctgcgggcgccgtccttcacgttgcgcggcgggacccgcgaggtcctgcgcggcgtcatcgcccgggggctggggctgcgatga

SEQ ID NO: 6569 - DNA, 912 bp, Methylobacterium sp.
atggatccgcgcgtgggcgaccagggccgtttcgagccgtgcggcttccggaaccgtcgtttcgcgcgtcgcgtcatggttgagcgcatcgctccgcggggtgccgcgtccaccgacctgacggtgggggccgaccctgccggctcggatatgaccctggtgaagtccgccgggcgggtgctccagatcctggagctgttcgacgagatccagcgggaggcccgggtctccgagatcgccgagcggctgaacgtcccgcaatcctcgacgtcggtgctcctgaagagcctcgtccggctcggctatctcgactatgaccgggggagccgcagcttcctgccgtcgccccgggtggcgctcctcggcgcgtggctcgacaaggggccggtgcgcgacggcagcctcgtgcgcatgctcgagcacctctcggagcgcacgggcgggaccgtgatcctcgccgcgcgcaacgcgatcttctcgcagtacgtccacgtcctgcaggcccgcaccgccatgcgcttccacgtcccgcccgggacgcgccgcctcgtcgtctggtcggcgaccgggaccgcgctcctcgccgacagcccggaggccgagatcggtccgctggtccgccgcacgaacgcggaggcgccggccgagcagccgccgatcgcgctcgcggccgtcctggccaatctggcgcggctgcgtcgggacgggcacttcttctcccgcgggctcgtcacgcccggcgccggctcgatcgcggtcccgctgcccaggcgcatcgacagcaagggccgtccgctggcggtcgccgtctccggcctgctcgacgagttcgagcgtcgggaagcggagatcgccgcgacgatccacgacgcggtggcgcggttcctgccggaggatccctcgcggccctga

SEQ ID NO: 6570 - DNA, 1437 bp, Methylobacterium sp.
atggcgcttccggacctgagccgcttctacatcgacggcgcctgggtcgagccggtttcggcccggccgttcccgctgatcgaccccgccaccgagacagcgttcggcaccctcgcgctcggcgatgccgaggatgtcgaccgggctgtccgcgcggcccgcgccgccttcccggccttctcggagacagcgcccgccgaacgcgtcgcgctcctgcgccggatcctcgcgctcttcgaggagcggttcgagatcttcgcggagacgatccggcaggagatgggctcgcccatcggcttcgcccgcaaggggcaggcggcgcgcgggccggcgcacctcaacgcgctcatcgcggtgatggagcgcttcgccttcgaggaggatcgcggcaccacccggatccggcgcgagccgatcggcgtctgcggcctgatcactccctggaactggccgatcaaccagatcgtcgtgaagatcgccccggcgctcgcggccggctgcacgatggtgctgaagcccagcgagtactcggccgtcagcgcgatgctgttcgcgcaggtcctccacgacgcgggtgtgccgccgggcgtgttcaacctcgtgaacggggacggccccggcgtcggcgccgcgatcgccgcgcatccggggatcgacatggtctcgttcaccggatcgacccgcgccggaatcgagatcgcccgggcggcggccccgaccatcaagcgcgtcgcgcaggaactcggcggcaagtccgccaacatcctgctcgaggacgtcgacttcgaccaggcggtccggcgcggcgtcgcggcctgctgcacgaactcgggccagtcctgctcgatcccgacgcggatgctcgtgccccgggcccggatggacgaggcggccgccatcgcggccgaggcggcggcgggcctccggctcggcccgaccgccgatcccgagacggatctcggcccggtggtcaaccgcacccagtacgagcgcgtcgtcgggctgatccgcaccggcatcgcggagggcgcgcggctcgtcgccggcggcccggaacggccggaccacctcgaccgcggcttctacgtcagcccgacggtgttcgccgacgtgactcccgacatgaccatcgcgcgggaggagatcttcggcccggtcctgtcgatcctcgcctacgacagcgaggacgaggcgatcgcgatcgccaacggttcgcgctacgggctcgccgcctacgtgcaggggcgggaccgcgaccgggcgcgcgccgtggcgcggcggctcatcggcgggcaggtccacatcaactacccgccgccggacgtccacgcgcccttcggtggctaccgccagtccggcaacggccgggaatggggtgaggccggtctccaggaatacctcgagaccaaggcgatgatcggcttcggcctcgactga

SEQ ID NO: 6571 - DNA, 954 bp, Methylobacterium sp.
atggccttcgatcgacacatcttctccggcacgatcccggccctgatgacgccctgccggccggaccggacgcccgacctcgacgccctcgcgcgcaaggggcgggagctcgtcgatgccggcatgtcggcggtcgtctattgcggctcgatgggcgactggccgctgctcaccgacgaggagcggatggcgggcgtcgagcgactgctcgcggccggcgtgccggtgatcgtcgggaccggcgcccagaacccgaagcgggccgcggcgctcgcggcccacgccaaggcggccggcgcccacggcctgatgatcatcccgcgggtcctgtcgcgcggcagctcggccgcggcccaggaggcgcatttcggcggcatcctggaggcggccgtcgacctgccgtcggtgatctacaacagcccctattacgggttcgagacccgggcggacctgttcttccgcctgcgcgcccgctacccgcacctcgtcggcttcaaggagttcggcggcgcggcctcgctcacctacgcggccgagcacatcaccggtcagtcgcccgacatcaccctgatggtcggggtggatacccaggtggtgcacggctacgtcaattgcggcgcccggggcgccatcacgggcatcggcaacgtcctgccgcgggaggtgctccacctcgtcggcctgtgcgagaaggccgccgcgggcgacgtccgggcccggcgccgggccgaggaactcgacgccgcgctggcgatcctgtcgagcttcgacgaggggacggacctcgtcctctactacaagcacctgatggtgctggaggggaacccggaatacgcgctgcacttcaacgccaccgacgcgctgagcgccggtcagcgccactacgcggagacgcagctacgcctgttcaaggcgtggtacgcgcactggtcggaggcgggcgccggggcctga

SEQ ID NO: 6572 - DNA, 147 bp, Methylobacterium sp.
atgagcacccacggcgacacctatgtccgttccctcggcccgggtcagaccgtcgataccggcgatcagctcagcagcgtggtcctgctcgggatcgcggtcgccggcgccgcggtcgcggtgctgctcaacgcgctgatcgtgtag

SEQ ID NO: 6573 - DNA, 942 bp, Methylobacterium sp.
atgttggacgatcatttccggacgcggatcgctctgcttcgagccgagcgcgatttccgccttgcggtcggcggttactgccagggcatgatcgaaccggcgcagattgtctggccgagccacaagctgctcaatcagatcgggcgctacgtggtctcgttcatgctgatccacaacgactacgcgtggcgccaccatggcggaccgcgccccaccctgacggtcctccaggcgatggtgggatcgagcccgaggcagacggccggcttcgtatcggccctcaaggccgggcgattcgtcacggcagtggcggatcggggcgacggtcgggtgaaatgcctgcaggcggcgccggccctggtgaccgagatcgcgcgaagcgggcgcctgttcgtcgccgccatggatgcggtgacccgtcgcgacccgggtcgggccgggatgctcgacggacccgaccggctcggggagctggtgcgcctctcggccgcccacgtgctgcggcacggcacgctcatcgcgccgttcccgcgggtgctccatttcgccggacgggactgcggctacccgctgctcacggccctggtcggggcccactatgccgccacggtgcccggcgcaccggcggcggtgtcgctcagcctgcgcagcctcgccgagcggctggacgtgtcgcgggcgcatgtcggcaacctgctcggcgaggccgagaccgcgggatggatccggatcgccggcggccacctgaccgccttcgacccggcgctgctggcggagttcgaggtctgggccgcagggcagatgctgttctacgacgatctcgcggcggcgatcctcgcggaggcgccgaccgcgcccgtcccggccggcgcctccggacacgccggtctcgcttgtgttccggtcgatccggggatacctacgggcggcaccgcgccgtga

SEQ ID NO: 6574 - DNA, 957 bp, Methylobacterium sp.
atgcccgtgaggctcgacgcgcgcctggccggcgacctgttcttcttccgcgccctggtcgaggcgggcggcttcgcccgtgccggcgatcgcctcgccgtcacgcagagcgcggtcacgcagcggatccagcggctggagcggcgcctcggttacccgctgctcgagcggggcgcccgcgagatccggctgaccgccgcgggtcacgacctgttcgccgcggcgcggagcggcttcgacgggatcggcgaggccctgctccgggcggaacggcgcgagcgccgggagacgctgcggatcagttgcatcccctccctggcctcggaatggctcgccccccgcttgagggccttcagcgacacgcatcccgacatcgacgtcgccgtcttcggggagacccacgacctggatcccggacgcatggcgcagtccggcatcgacgtcgcgatccgctacggcccgacgccccctcccggtgcgacggtcgtcttcgaccatcccgagcccgtctacccggtctgcgccccggcctaccgggatgcggcctcgcagcccggcggggccgtcgtcctgctccacgacgcgacgccgtgggaggcggccgcgagcgtctcggaggagtgggatcgctggataagcgtccacggggcgccctgggacggcgggatccagaatctctacttcaacctcgcgcaactggcgctgcgcgcctcgctcggcggctcgggcatcgccctggggcgatcgctgatcgtcgcgccctatcgcgccgacgggcgcctcgtgcccgcctgcggcgaggccgtcatgaacggtctccggtacttcgttatcgtccgtgctctgccacccgcggggcccgcggcggccttcgtggactggctcggccggacgatggcgggtccgccgggctcgcccgaggcgccgcgtcggggcggtgcggcggatcgcggatag

SEQ ID NO: 6575 - DNA, 444 bp, Methylobacterium sp.
atgacgcatcaggagaccgcctttgtagaggcgatggtgcggacaggtgatgcgctctactcggcgaccgtcgcagggtacgcacagcccgcgtcggccgcgtccaaggcgttgaagcgcccggacattgtcgccgcgatcaactcggctgtgcggctgcgcgtgcagagcgagggcgcggcggtggcggcgtcggtgctggtagagatcgccctcgacaagacggcgccgaaggctccgcgcgtcgccgcggcccgcgcgcttggggagatgacgcacctgggcgggctggagggcgcgggcctcgataagccgctgtccgagatgtcccgcgcggagcttgtcgaggcccgacagcgcgcggtcgcctacctcgcggagcttgacgcacccgtgatcgaggcggaggcggtcgaggcgcccgcgggcgggcttttcgactga

SEQ ID NO: 6576 - DNA, 1794 bp, Methylobacterium sp.
atgaactaccagcgcaagtacagcttctccggctatcaggccaacaacccacagcggcccctgccggcgacgcagatcgacgccgagctggacgctatcagcgccgccttcgagcagacgctggacgcctacggcgtggcgaaggccaacggcttccaggggaacgtgatcgagtggctcgccagcctcaagggcgagaagggcgacaagggcgacaagggcgaccgcggcccggccggccagaagggcgataagggcgacacgggcagccaagggccgcagggcgatcccggccaccagggcgtccagggcgtgcaggggccgaagggcgatcagggtgagcaggggagcgccgggcctgccggcgaccgcggcccccagggcctacagggtccgaagggcgaccagggcgtccagggcctccaggggccgaagggcgacaagggcgacaccggcagccagggcgcacccgggacgaacgggaaggacggcagtcagggcccgaagggcgaccagggcgcccaggggctccagggcccgaagggcgacaagggcgaccagggcgtgcatggcccgaagggcgaccagggcgagcagggtgcgaagggcgaccagggtgccggcgtcgttatcaaggggagcgtgcccacgccggccgacctgcccgcctccgggaacaccccgggcgacacctacatcatgacgaccgccggctccggctacgcggccggcgacggctacgcctacacgggctcgggcttcaccaatgtgggccagatccgcggcccgcagggcgtgcagggcccgaagggcgacaagggcgatcaggggctccagggtgtacagggcgagcccggtgcccagggtgcgaagggcgatgccggcgcgcagggcgtccagggcccgaagggcgaccagggcgagcagggcattcagggtcccaagggcgaccaggggatccagggcgtccagggcgacccgggcgcggccggcccgaagggtgacacgggatcccaggggccgaagggcgacacgggctccaagggcgaccagggcattcagggcccgaagggcgaccagggcattcagggtgtccaggggccgaagggagacaagggcgatcagggtccgcaggggccggccggcagcctcggctttcagccggtgcagcagggcaccgggccgggccagggcaccaacaccgtgtcggtcggctggggcacgatcaagaacgccgccgggatcgacacggccgcgctgctcttgtcgatcgacggccaagcgcagggtgcgatctggacggatcagctcctggggcagtcgttcggccggaagcggatcgagaacctcgcgacgggcgcgcacttctgcgcagcggtcgggctcggcagctcgggcttgaccgcgtctgccggcaacggcttccagcggatcatgctcaacgcggtcgaggcggatgtcgaggggctgttcaagacgggctcggggcagagctactacctcgtgcccatgtccggcgtctataacatcacgggcgcgctgcgcttcccggacaatacaggctcgttcttctacggcttcggcgtccacaccgcagaggaagatgggtcacacatgagctggtcattccgaccgaccaataacggccggtacgtcagccaatattctcgcatggcccacttcaacaaaggcgatcaggtccggatgatcttctactccgacgctgtcgtcgccaacctgccggtggaccgggccgcgttccagatcgcccttctgtcaggcgatattgtataa

SEQ ID NO: 6577 - DNA, 786 bp, Methylobacterium sp.
atgtgtgatccgctcaccatcgcaggcgcggcgctctcggccggcggcatcgcagccaactcgatcggcgcctcccaggccgccgccgcgtcgagccgagcctacgcggccgagcaggcccggcaggcccagctccggcaggaggccgcgcaggtccagcagcactcgaacagcctctacgaggggttcgccggcaagcagcaggaccgggcggccgatctcgcctcgacgctccgcagtgcccagctcccggcccagggctcggcctcgacgaccgtcgaggcgccggccagcagctcgaacatcacgacgcagggggaggcctcccagcgggcgaacgccgacgcctacgccggccagcaggccacggcgctgggcgacctgcggtccttcggcgacctgctcgggacgaacgccctggcccaggcccgggacgcctcccagatcggccagatcggcaacttcatgcggggctcggcctccgtgctgccgcaggagctgaacgcggccagccacgcgggcgacaccgccaagctgttcggcggcctcgcgggcgggctcggcaaggtcgggatcgcggccggcatcaacgggagcaccctgggtggcctgttcggtggcggcgccagctccggcgggaacgtctctacctcgctcccgacgatggccgcctccgggatgggctcgatcgccaacgcctacggcaacctgccggccgcgcccatgtcgatcgcccagccgttcggcgcggccccgtccttcgccagcagcccctaccgcgtctga

SEQ ID NO: 6578 - DNA, 621 bp, Methylobacterium sp.
atgtcgaagaaggatggcggcgccggcaagcaggcgaacatcgcgcgtatggaggaggcccagcggcaggcgactatccgccagggcaccgatcagatcaactcgacgttcgacagccaattcacgccggacttcttcaacaagcagcgcgacaacttcctcgcgttccagcttccgcagctcgacgggcagtacggtgacgcccagcggcagctcacctacaacctcgcgcggaacgggaacctggacagctcgacccgtggcttccagcagggccagctccagaagacctacaacacccagcggacgaccgtcgccgacaacgcgaacagctacgccaactcggctcggagcaacgtcgagcaggcccgcaacaacctgatctcgacgctcaacgccacgggcgacgcgacccaggccgccagctcggcgaccaatcaggccgcgatcttggcgcagccgcaggcctacagcccgcttgtcgacgccttcgccaccacgaccggcgcgctcgcctcccaggcccaggccgaccgggcggcggctatcgcgaacggcacctacacgggcggctcgggcctgtttggcacgtccggcggctccgtccgcgtcacgaggtaa

SEQ ID NO: 6579 - DNA, 225 bp, Methylobacterium sp.
atgtatgatggccccatcccccgctcgcgctacccggctaccatgatcgatgacaccgacccggtcttggaagcggtgacggcgctacgggccgccggggtcgcggtggacccgatcggcgacgagctcgaacgctggcagatcggcgacctgatcttctcggacgctgacctgtggcgcctggccgcgagcaggggactcgtagaggacagcgactcgctgtag

SEQ ID NO: 6580 - DNA, 381 bp, Methylobacterium sp.
gtgccggcaacagcacagcagcttgatggatggccgggcatcgtcattgccctgctgggtgcgctcgcggtggtcctggtccctctgaccgggttcatgaaggagtggtggggatacaggaaggaggtgctcgccgcagagaagatgaagcccgaaattgcgcgtgacatcggcaccgcatccggcggcgccgtattcgacagcatcgcgctggcggatctcgccaaagccatcaacggcctgacggcggccatcgtcgcagacacggcttccgaggaggcgcagcacaccagtcagatgacggccgcgctcagccgcttcaccgaggtcatggaccgctgggaggatgatcacgggcgtcagccacgaggaaggcgctga

SEQ ID NO: 6581 - DNA, 519 bp, Methylobacterium sp.
gtgcagacttcggttcaggcggccgtgcgcgcgctcctgaccacgaccgaccgttcggagatcacggtgcccctggtggccgccgcggccggcgtgacgccgtcgacgatctaccggcggtggggcacgctcgccgagctcttggccgatgtcgcggtcgagcggctgcgtcccgacggcgagccggccgataccgggagcggccggaccgatctcgaggcgtgggcggagcagtacgcggacgagatgtcgtccgcgccggggcgggagatgatccgggacgttctggcggccgcggacgcgaactgtgcccagcgatgctgcagcttcacccgcgatcagatcgcgatcatcgcggatcgggccgtggcccgcggcgaggccttcccggaccccgaggcagtgctggacggggtcgtctcgccgatcctctaccggatcctgttcgggaccgcgctgaaccgggagcggatcctcgagctggtcgaccgcactttgacggcgcgcgaagcgacctga

SEQ ID NO: 6582 - DNA, 429 bp, Methylobacterium sp.
atgacccagggaacggaaccggcggcgctgccgccccacttggcacaggaatacgcggcggcgcgggacaacggctgcgtcggcacccggctgctctcggaggatgaccgctcccgggtctggaccatcgtcctggcgcccggcgcgcggatcggcttccacacgcacgtgctcgactatttctggaccgcggtgacggcggggcgcgcccgctcgcattacggcgacgggcgggtcgcggaggtcgattaccgcgcgggcgacatccagcacctgtcgttcgggccgggcgagtcgatgacccacgacctcgccaatatcggcgacacggagctgatcttcaccaccgtcgagttcctggacagcgcgaacccgcccctcgcgctcccggccgccgtgcgcgcggaggcgacccgccgcgcggcctaa

SEQ ID NO: 6583 - DNA, 414 bp, Methylobacterium sp.
atgaaacgtctcgcgatcgccctcacggcgctgtcgagcctcgtcctgttcgccccgtcgagcgaggcgcgaccccacggccgcggcttccatcatgggccccaccatctgggtcacggcgtctggagggggcggcgccacggtctccaccggtaccgccatcaccgtctccaccggcactaccggcggcatcggggctaccgcggatatcgcggcgtccacttccgccccgccggctacggctaccggccccacgcgtatcgctccggtggcttgggcggctatcgcggggtcggcttcgcgaccggcgccggcctgggcctcgccaccgcccggccaggtctctacggcgcggcctacgggcgaccctacggatacggctacgcgccggtcggctacggctgcgcctactag

SEQ ID NO: 6584 - DNA, 300 bp, Methylobacterium sp.
gtgatcctgtcgcggtggcgcggctatagcgccgccatggcgaagcgccccatgactctcgacctgttcacgaccctggatatcgtcgatgacgacgtctcggccgtcgtcgacgcctatctggccgatcccacgcccggttcggtggcgttcggggacggcttccgcatcgaccccgcggccgcggtggcctcgcatcccttcgcccggacgctgatcgatcagccctgggccgatgccgggctgcgccgggcggccatccgcgccgccatcctgctggcggagccggagcgggtctga

SEQ ID NO: 6585 - DNA, 1152 bp, Methylobacterium sp.
ttgatacatctgatcaacatgacggactggctggaccgcgccgaagctctcgacgccctcgggatccgggcccaaacgctctacgcctacgtcagccgcgggctgatcgaggcgcggcgggcgccgggccggcgccacagccagtaccgggccaccgacgtcgcggcgctcgccgaccggcgcggccgaagccgcgccagcgcggcgatcgccgcgggggccatggcctggggcgagccgtcggtcgtcaccgcgatcagcaccgtccaccggggcagcctgatctatcgcggccgcgacgccgtggcgttcgcccgcgacgcgagcctggaggcggccgccgacctcctgtgggacagcccggagccgacgctgttcgacgttccggccaacgcggccgcgacgccgttcctggcgctggccgggctcctgcaggacgccgaggccgcgctgggccgcgggcatcaccgcctgtgccgcgacgcgcgccgcgccgtcgctcacctcgccgcgtcctgcggcatccccgaaggccgggcgcccctgcatcagggcctcgcgcggctctggtccctcgacgccgcgaccgccgaccgggtccgtcaggcgctggtgctgctggccgaccacgagctgaacgcctcgaccttcgcgacccgggtcgccgcctccaccggcgcgccgatcgcggcctgcctcatggccgggctgagcgccctgtcgggaccgcgccacggcggcgccgcggcggcggtgctgcggctcgtcgacgaggctgacgcgacgaacccccgggaggccgtgcgcgcctgcctggatcgggccggggcgctgccgggcttcggccacccgctctacccggacggcgacgtccgcgccgcggccctgggcgcggtcctgcccgccgatcccctgctggatgccgtccgggactgcgccgtggcggcgacgggggcgcggccgaacatcgacttcgcgctgacggcgctcgtccggacggcgggcctgccgcggagcgcgccgttcacgatcttcctgctcggccggagcctgggctgggcggcgcacgccatggagcagggccgccagggtacgctgatccggccgcgggcccggtacgaggggccgcggcgctcggcggaccgcccgtag

SEQ ID NO: 6586 - DNA, 840 bp, Methylobacterium sp.
atgcttcggactgcgatcgccctgacgcttctgctggccggagccccggcctgggccggaccgcgctggcaggacctgccgccgacccccgcgccggtcgccggcacggtttccgggcgcgcctctgtcaacggcatccggctgtattacgccacgatcggcaacggtccgccggtcgtcctgctgcacggcggcctgtcgaactccgattactggggtcaccaggtcgcggcgctcgccgcccgtcgcacggtcatcctcgtggacagccgcgggcacggccgcagcacccgggacgatcggccattcggctacgacctgatgaccgacgacgtggtcgggctgctcgatgtgctgaagatcccgcgcgccgacatcgtcgggtggagcgacggcgcgatcctcggtctcgacatggcgatgcgccaccccgaccgcgtcggcaaggtgttcgcgttcggcgccaacgccgatccgtcgggcctgatcgagggcgtggagaagaacccgaccttcgccgccttcatcgaccgggccggcaaggagtacgaggccctctcgccgaccccgaaggactacgccgccttcgtcgacgcggtcggccggatgtggggcgggcagccgcgctggaccgaagccgatctgaagcggatccgcgcgccggtcctcatcgcggacggcgaccacgacgagggcatcaagcgcgcgcacaccgagtacctcgccgccacgatccccggggcggggctgctgatcctgcccaatgccagccacttcgcgttcctccaggatccggcgctcttcaacgcggcgctcctcggcttcctggacggaccttga

SEQ ID NO: 6587 - DNA, 378 bp, Methylobacterium sp.
gtgcatttcatgcggatgatggggttcgtggcccttgtgttgagcggcctgggcctggcgggccccgcgtcggcggccccgctctcaccggcgccgctggccggcgacgcgagcgggctgacccgggtcggctactggtgcgggcccggattccacctcaacccgtggggccggtgcgtcccgaacgcccgccggttctacggcccgggcccggccttctacggagcccgctactacggaggccggcgcttctaccggacctacaactatcgctggcaccgcaattaccgctggcaccgcaactatcattggcaccgcaactatcgctggcaccgcaactatcattggcatcgcagctaccactggcgtcgccgctga

SEQ ID NO: 6588 - DNA, 90 bp, Methylobacterium sp.
atgacgctcgccctcatcatcaccggcttcctgatcgtgaacttcgtgatggccggcttcttctccctcgtggccctctgggccgactga

SEQ ID NO: 6589 - DNA, 1212 bp, Methylobacterium sp.
atggctgaggatgggattgccgattcgggccgcgcctggcgtcggctcgccgcggcgacggcgctcggcacggtcgggggcgtcggcatgtggtcggtcgtcgtcgtgctgcccgcggttcaggccgagttcggggtcgatcgggcggcggccgccctgccctataccctcacgatgctcggcttcgcggtcggcggcctcctgatggggcggctcgcggaccgcatcggcatcgtgcccccgctggtcctcggcaccgtctgcctggccctcggctacgggctcagcgccctcgcgacgaacctctggcagttcgccctcgtgcacggcgtgctcgtcggggcactcggcagctcggtcgccttcggaccgctgatggccgacgtgtcgcgctggttctggcgccggcgagggctcgccgtcgcgctgtgcgcgtccggcaattacctcgcgggcacgctctggccaccggtggtggagcgcgcggtccacgcgttcggctggcgcgcgacgcaggccggcatcggcctgttctgcctcgtcgccatgctgcccctcgcgctggcgatgcggggccggccgccacgggcttcggcgacgcgcgcggccggtccgcaggccgtgacgacgctgtcgcccgcggcgctgcagggcctcctcgtcgtggccggcaccgcgtgctgcgtggcgatggcgatgccgcaggtccacatcgtggcgtactgcggcgatctcgggtacggcgtcgaccgcggcgcgcagatgctgtcgctgatgctcggcttcggcatcgtcagccgggtcgcatcgggcttcgtcgccgatcggatcggcggtctcgcgacgcttctggccggtgcgctgctgcaggcggcggcgctcgcgctctacctcgcgttcgacgacctgacctcgctctacgtgatctcggccctgttcggcctgttccagggcggcatcgtgccggcctacgcgatcatcgtgcgcgagtacctcccggccgaggaggccggggcgcggatcggtgcggtgctgatggcgacgctggccggcatggcgctcggcggctggctcacgggggcgatcttcgacgcgaccggctcctaccgtgcggcgttcgtcaacgggctggcctggaacgccgtcaacgtggcgatcgtgctgtggctgatccactgccgtcgggcgcgcacgagtccggccgcgctctga

SEQ ID NO: 6590 - DNA, 495 bp, Methylobacterium sp.
gtgaggcgtctgctccacgcgcctcccctcgccttgctcatcggcctcggtctcgccccgctcttcatcctcttcccccgcctgcccggcgggccggaggtcggcccagcgcatgacccagcctcacagcccttcgcgttctgggtcggtacggccttgctcggtggcctcgcgggcaccctcgacggtgcggcccgaccactgtaccgcgctgccgcgctcatcttgggagcgtcgctcctgtcggttcctgccttgcgcctggcgctcatgtcaggcctgccgtttccacacaggctcgctgtgtggctcggactcgatggggaattcgcgatggaggccgacctatacgagatctggctgctgtcgtggctcgtctgcctcggcctgatcgtcgtggtctggcgcggtctggcgcggatcataccggtgcggcccgcggaggcggcgggccacacggaaaccacgtcgactggccccaatccgtgcccatag

SEQ ID NO: 6591 - DNA, 696 bp, Methylobacterium sp.
atggcgaaatttcatttcgtcgaggattacgaggcgtacgtccgtcagctgatgcgcgacctgcccctggacgaggcgatgagcgtggcggtaggcggcgactacgaccgcatcggcgcgatcgagtgcgagatcctccagcatttcgggctccgggacggccagtcggtggtcgatttcgggtgcggctccgggcgcctggcggtgcatctcgcccgcaccgcgagcgtcgcgtatctgggcctcgacgtcgtccaggacctgctggactacgcgaagcgccgctgtcccagggactaccgcttcgcccggaacaccgcgctgtcgctgccggtcgccgacggcagcgtcgacctcgtctcggccttcagcgtgttcacgcatctcctgcacacggagtgctacatctacctggaggagatgcaccgcgccctcaggcccgggggccgcgtcgtggcctcgttcctcgagttcagcatggcctcgcactggggcgtcttcaccaagacggtcggcgagcagcgcaccagcacggtgccgcacctcaacacgttcatcgagcgcagcgtctggcagacctgggcggaccatatcggcttcgacagcgtgacgttcctcgacgggacggcggcgccgtggccgtcgggggtctatctgggccagtccctcgcggtgctcggcaaggcgccggcctga

SEQ ID NO: 6592 - DNA, 1407 bp, Methylobacterium sp.
atgtccgaagccgtgagcccggcggtcaacgccggaggccgcctcgaccgcctgccgatcggcccgttccaccgccgcatcatgtggctgatcgggatcggcatgttcttcgacgggttcgacatctacatcgccgccaccgtgctcggcgcgaccctgaagagcggcttctcgaccctgccgcagaacgcgtggttcgtctcggccaccttcgtggggatgatggcgggctcgttcctgacgggcttcttcggcgaccgctacgggcggcgcttcacctaccaggcgaacctgctggtcttcgggctggccgccatcggggcggccttcgcgcccaacatgacggtgctgatcgtgctgcgcttcatcatgggcgtggggctcggggccgagaacgtcgtgggctactcgaccatgaccgagttcgtgccggcgcgctcgcgcgggcgcttcctcggcctgatggcggtgttcgtcgtcacgggcctgccggccgcctccctggtcggctacctgatcatcccgaccttcggctggcgggcgatgttcgcgctgggcggcctcggggcgctcgccgtctggtacgcccgcaagagcctgccggaatcgccgcgctggctcgaggccgtggggcgcaacgccgaggccgaggcgctgatgcgcgcgatcgaggccgaggcggcccgcggcgcgccgctgccgcccgccgccgccgcggcgcccgtcacgcagctcgggctcgccgccctgttccggccgccgctgctgtcgcgtctgctgctgggctgcctgtgcctcgtggtgatcaacaccctgctgtacggcttcgtgacctggctgccgaccttcttcatccggcagggcctctcggtggcgacctccttcggctacgcgctgctgatggggctcggggcgccggtgggcagcgccatcggcgccctgaccgccgaccgctggggccgcaagccgacgatcatcggcgcctcggcgacggccatcctgttcgggatcctctacccgatgaccctggacccggtcctgctgccgctggtcgggtttgggctgacggtgccgatctacgtgctggtggccctgctgttcgggatctacatccccgagctgttcccgaccgaggtgcgcctgcgggcctcgggcctgtgcaacacggtcgggcgcggggcgaccatcgtgacgcccttcctggtcgtgaccctgttcgaggcctacggcatcgcgggcgtgaccggcctgatgatcgggctgctcgccctgcagatcgtggcggtcgcggcgttcggcgtcgagccgcgcagccagagcctggagagcctggaggccggcgtcgcgccggccgagggcggcccggccgcccgggcgcggggcacggttccgcgcccgatccactga

SEQ ID NO: 6593 - DNA, 1524 bp, Methylobacterium sp.
atgaccctgcacgcgccggaaccgaccgtcgagacacggggcaacttcatcgacgggcgcgaggtcgaggccggcgacggcgcgctgatcgacgtgcgcaaccccgccaccggcgcggtgatcgcccggatccccaattcggggccggccgacgtcgaccgggcgatgcgcgcggcccgggcggccttcgagggccgggaatggggcgggatggacatccgggcgcgcgcccggctggtgaacaggctcgccgacgcgttcgaggccaacctcgacacgctctaccggctggagaccaccaacaacggccggccggtcaacgagacccgggcgcagctctcgcggctgccggacttcttccgctacttcgcgggcgtggcgctggcgcggcgcgacgacgtcatcccggtcgagggcaactacctcaactacacccgccgcaccccgatcggcgtggtggcgaactgtacgccgttcaaccacccgctgatgatcctgtgcaagtcgctggcggtggtgctcgccaccggctgcaccacggtggtcaagccctccgagtacacgccgctcacgaccctgaagctcgcgcagatcttcaccgaggccggcctgccgccgggcgtgttcaacatcgtgctggggcttggcgcctcgaccggcaaggcgctggccgagcacggcgacatcaacaagctcgtgctcaccggcggcaccgaggccggccggatcgccggctcggccgccgcgaaggtcttcgcccaccagaccatggagctcggcggcaagacccccgtgatggtgttcgacgacttcgacgtcgagcgggcggtgaactacgcggccttcggcgccttcatcggcgccggccagacctgcgtgtgcggcagccgccacctcgtccaggcctcgatctacgacgagttcgtcgagcggctcgccgccaagaccgccgcgatccgcctcggcgatcccttcgacccggcgacccagctcgggccagtcatctccgagcgccagcgcgagcgggtgctggcctatgccggctacggccgcgaccagggcgcccgcgcggtggcgggcgggcgggcggcccgggtgccgggcttcgagggcggctacttcgtggagcccaccgtgttcgcggacgtcaccgccgacatgcgcatcttccaggaggaggtgttcgggcccttcaccagcgtcacccgcttcgaggacgaggccgacgcgctccggctggccaacgactcgcccttcggcctcgctgcggccgtgcgcacccgcgacgtcgcccgggcccaccgggtggcgcacgcggtcaaggccggcatcgtctggatcaacgaccaccaccgcctcgacccggcctcgccctggggcggggtcggcgacagcgggctcggccgcgagtgcgggatcgagagcttcaacgaccatttcgacgtgaagagcgtgatggtcgccaccggcgacgggcccttcgactggtaccgcgacacggccggccagcgccgcctgaactga

SEQ ID NO: 6594 - DNA, 633 bp, Methylobacterium sp.
gtgctgctccgagacaacatctacgcggcgatccgcgccgacatcctggcctgcatcctgcgccccggcgcggaggtgcgcgagcaggaactggcccggcgctacgccgtgagccggcagccggtccgggaggcgctgctgcgcctggagcgcgagcggctcgtcacggttcacgcgcgtcagggatatcagatcaacgcgatttcggtggcggacgcgcgcgatctgctgcgcatgcgcctcgccctggagccggcctgcgcggccgaggccgcggccggcgcgcccgcttccgtcctggcgtccctcgacgcgttccgcgccgtcgcggacggcgccgacttcatcgcggagaaccgcgccttccacatcgccctcgccgaggcgtcggggaaccgccgcatggctgcgaccgtgcgcgacctcgtcgagcaggcggaccggctggtccgggtcagcctcgacggtatccgcgggcgcgacccggcgcagctggtggacgagcacgccgccatcatcgacgccgtgcagcggcgcgacgggcgcggggcgcgccgcctcgtgcgcgcgcatgtcgcccaggccgagcgccgcatcctgaccgccctggaacgcagcgcgatcgtcctctga

SEQ ID NO: 6595 - DNA, 414 bp, Methylobacterium sp.
atgcaggacatcccgttgggggcgaaggggagcttcgccatgctggtcgggccgtcacatctggccagccagttcaaggacaacatcctgccgccggtcttcgccacgccgatgatggtcctgatcatggagaacgcggcgctgaacgccgtccgccagtacctcgatcccggcgagagcgccgtcgggaccaaggtggacgtgacccacatggcggcgacgccggtcgggcaccgcgtctgggcggaggccgaggtggtcggcgtcgccggacgccagatccagttccgcgtcgcggcctgggacgagtcggagcagatcggggccgggacgcacgagcggatgatcgtcgacatcgagcggctcggcaaacgtctcgccgccaagcagcccgccccgtcgaagcgcgcgtag

SEQ ID NO: 6596 - DNA, 465 bp, Methylobacterium sp.
atgtcgttcatgagggtcacgatctgcgccgtcgcgctctgccttgtcgcgggcctgggccacgctcaggaggccgggcagacggtcgccggcgagggggactgggtgctcaggaaatcggcggccccgtcgagcggcgacgtcgcctgcgttctggcgccgaaggcgcggtcgcgcatccagatcgtcggcgaccgcatcgagatcaccggcctgccaaagaattccatcttcaattatcagtatcggatcgacgacggacctgtttcaaccgcgatgtttcccacaacgcagatgcaggacgccggagtgatcacgctgaatggggacgtattgaaagatattctggccggtcgacgcttcagcatccgcctgctggaccgatggcacgaggccatgacggaggagatcagcctctccgggctgcgcggcctgatcgacaagcgggccgaggcctgcaggtag

SEQ ID NO: 6597 - DNA, 243 bp, Methylobacterium sp.
atggccttccccgatgcgaacgaacccagcgccacgtcgatcagcgccctcgagctggtcaataccctgatcgagcgcaaggagaacggcgagccggtcgacgccgacatcctgtccttcctgaccgacatggaacggctcgggctcaccgacaccgatgcttacgccacgctcgacgcgtatcggcctgggcccgcactgggtgcgaccggcggcgatgacgcgagcgaggcggacgcctag

SEQ ID NO: 6598 - DNA, 291 bp, Methylobacterium sp.
atgtcgaagacgatcctcgccctcgccacgtcattcgtactcgccacgtccggcgcggcgctggcccaggcgccgcagaccggcggcgccaaccagggcaacgtcaacaagtccggcgcggtcggcggcaccgggacgggggccggctccatggagagcaccgggtccaccggcgccggcctggcgcccggcaccagcggcggaccccgggtcagcacgccgggcgcgcccgcgggcagcagctcgggcaacggcgccaccggcagcggcgctgcgcccagcgggcggtag

SEQ ID NO: 6599 - DNA, 654 bp, Methylobacterium sp.
atgggcgggacagtggcgacctggaacagcgacgccggtccctccggccacgggatcgccgcgggccggcccggccgccctccgcccggcggatcatggaacctcgcggcgttcgagcgccatcgcgccgcctatctggcgcgggcgcgccgcatcctcggctgcccggcccaggcggaggacgtggtccaggacgtgctgctccggctgatcgccgatccgcccccggcccagaccgcgatccaggccgcctatgtcgggcggatggtgcgcaacctcgccctggaccgggcgcggcggcagggcctcgagcggcgcctgttcaccggcctcgacgccgcgccggacccggccgatcccggcatcgggacccccgaggcggccgcggcgtcgcgggaatccctgcggcaggtggaggccgcggtggccgagctgccggagccggtgcgcacggtcttccagctccaccgggtcgagggcgtgccgcagatcgagatcgcggcccggctcggggtctcgcgcgcgctggtgtgcggcctcgtgcgccgcggccacctgcactgcctcgcggccctcgaccggcgctgcgccgcctgcccggcgcgcgccgaggccccaggccggcagcggcgccggaccgcgcccgtcaactag

SEQ ID NO: 6600 - DNA, 801 bp, Methylobacterium sp.
atggctcgtctgcaatcctccggcttcttcgatctcggcgatggtcgactggaatatcatttcgtcggtcgacagccggaggtggcccccacgcttgtgttgctccacgaaggcctcggttcggcgatgcaatggggcgccctgcccgagaccctcgcccaaacgacagagtgcggtgtcctggccgtctcccgccagggatatggcgcgtcgagcccggtgcccttgcctcgcccggccgattatctcgagcacgaggcccgcacagtcctcccgcggttactcgacgccgcaaatttcaggagcggcgtgatgatcggccactccgacggcgcctcgatcgccgctctcgccttggcggaaggcgatgcccgcctgcggggcggtgtgctgatggcaccgcatttcttcgtggaggaggtcacgctgtccgcgatccggcgaacccgagccgcctacgagcgggggctcttgaggacccgcctcggccgctggcacaccgatgtcgaaggggccttccgtggctggaacgacgcatggctggatccggcccggcgcggatggacgatcgaggctgcgctgacacgcctgaccgtccccgtgacacttatacagggaaccgaggacgcctacgggacgcaagcccagatcgctgcagcccgcagatcatgtccacccagcctgctcacagtccgtgagatgccgggtgtcggtcatgaaccacatcgcgaagctttcgcggacacggtcgctctcatctcggctttcgtcgagtatgtcctgaaagacgaaccaggctaa

SEQ ID NO: 6601 - DNA, 1350 bp, Methylobacterium sp.
atgcagaccgccgccaccttcgcatccgatccccccgccctcgccaggcccaccggtcggcagacggcgacggccgccatggcctcgctgttcggctgggggctcgatctcttcgacctgttcattctgctctacgtggcgccggtcgtcggcaccttgttcttcccggcggacaagccgatgctgtcgctggccggagcctatgcctccttcgcggtcacgctgctgatccggcccctcggctccgccctgttcggctcctatgcggaccgcttcggccgccgccgcgccctcatggtggcggtgatcggcgtcggcctgtcgacggcggtcttcggcctcctgccgacggtcggccagatcggatggctcgccaccgcgatcttcctattcttccgcctcgtccagggcgtcttcgtcggcggtgtcgttgcggcatcccacacgatcggtacggaatctgtgccggagcggtggcgggggctgatgtccggggcggtcggcagcgggggctcggccatcggcggcctcctggcctccctggtcttctatctcgtctcgctcatggcgccgggcgaggccttcgccgactggggctggcgggtgatgttcttctcgggcctactgacctcggtgatcggcctgatcctcttccgcaacctcgaggaatccccgatcttcaaggaactgcaggcccgcaaggccgcgctccgggagggtgctccgacgaaggcctcgccgatccgctcgctgttctcgccgtccaaccggggaagcttcgcggtcgcgacgctcatctccttcggcggcggcgcggcctactacctcacgtccggctacctgccgaccctcctcaagctcgtgaacggcgtaccgaacgccaccgcctcgatgatcctgatcggcgccaacgtggcggcggcgatcggcgcctgcggcatgggcgaactgagccagcatatcgggcgcaagcggtcgttcttgctgatgggagtcatccgcctgttcgcctttcccgttctcttcctgaccatggcgaacacgacgagcctcatgggggtcgcggcctgtgccttccttctctcgctcatcgccaacgccagctacgcgccgctgttgatcttcctcaatgaaaaattcccgacggcggtacgggccacggggacgggcctgacctggaatatcggcttcgcgctgggcggcatgctgccgacgttcgtctccctcatcgccgatgggccgacgcagatcccgatggtgctgacggtcgtgatgacatgcgtcacgctagtctatctcgttggcgccgttatcactccggagacgcagggcaacctcgaccgggcgtga

SEQ ID NO: 6602 - DNA, 807 bp, Methylobacterium sp.
atgacgagcgacacccacaccatcgacccgcgcctgacgaacctcgacgggttccgcgtcgagatcgactcggagcgcgagcgcgccgacgtgatcctggcgcggccgcccatgaacgtcattgcgatgccccagcgcgacgagatccgtaaggtgttcgaggcgctggacgaggatccccgcgtgcgggtcatcgtcctgcgggcggagggcgaacacttctcgtcggggggctacatcaagggcttcctcgacgcctcgcccgagcacgtctcgaagctcgcctggaacatggcggcgccggcccgctgctcgaagcccgtcatcgccgccaaccggggctatacgttcggcgtcggcttcgagatctcgctggcctgcgacttccgcatcgtctccgagacctgccgttacgccctgcccgagcagaagctcgggcagattcccggctccggcggctcggcccgtctccagaagatcgttggcatcacccggaccaaggacatcgtgatgcgctccaagcgcatccccggacggcaggccctcgactggggcatcgccaccgaatgcgtggccgacgcggacctggagaaggccaccgacgcgctggtcgacgaattgcgcgccttctcccccatcgcccagcgcaccgccaagaagctcctcaacgacaccgaggatgcgagcctctccatcgccatcgagctcgaagggcattgctacagccgcctgcggcaggccgatgacttccgcgagggcgtcgaagcgttccacgccaagcgcgcgccgcgcttcaccggctcatag

SEQ ID NO: 6603 - DNA, 1560 bp, Methylobacterium sp.
atgcttgatctcggcaccagcttcctcgcgagcgtctcccgcgatccctgggccctggccctcgtcgacggggagacccggctgacctacgcggagtggttcggggtcatttccgcgaccgtggccgggctcgaccggctcgggctgaagcccggcgaccacctcgtcacggtccttcagaaccggcacgaggcggcgaccctgcactgggcctgccaattctcgggagtcgtgatcacgccaatcaactggcgggccaaggccgaggagatcgatttcgcgatcgagaacgcggaagcccgcgccatcgcctacgaaccggtctcggccgcgagcctgcgtgagagcgcggcatcgcagctgatcccgcgcatcgccgtcggcacgccacccggccccggcgagacggccttcgccgacctcgccgccaccgaggagccgtcggcgacgccccgggccgacgcggaggcgatctcgctgatgctctacacctccggcaccaccgccaagcccaagggggtcccacggcgacaccgggcggagcgcgcggcggccgtggcccatgtagcgcaaaacctctacgggcgcggcgagcgcacgctcggcgtgatgccactctaccacacgatgggggtgcgctcgctcctcgccatgtcgctgatcggcgggaccttcgtctgccttccccggttcgatgtggcgggggcgctgcggctgatcgcggccgagcggatcaccaacctctacctcgtgccgaccctctaccacgacctcgtgcaccaccgggatttccaggcgacgaacacgacctccgtgcgcaagctcggcttcgccggggcaccgatgacggacggcctgctcgcccgcctgaccgaggcgttccggccggacctcttcgtcaatcattacggctcgtcggaggtctacaccttcacgatcaaccacgaggcggcggttaagcccggctcggccgggcgggcgggcctcaacaccatggtacgtgtcgtgtccctggggggcgatcctagccggaccgccgcgccgggcgaggagggcgagatcgccgtcatcgccaagggcgacgaagccttcgagggctactggcatcgccccgaggccgacgccaaggccttccgcgacggctggtacttcaccggcgacaccggcttcgccgacgccgacggcgacctctacgtcaccgggcgggtggacgacatgatcatcaccggaggcgagaacgtctcgcccgtcgagatcgagagccgcctgtccctgcatccggcggtgtccgaagtcgccgtcgtcggcctgcccgacgagcgctggggccggatcgtcgcggccttcatcaagcggagcggcagcaccgacgcggcggcgctcgacgcccattgccgggccggcggcctgccgagtcacaagctgccgcgccgctacgtcttcgtggacgagatcccgaaatcgccggtcggcaagctgctgcgccgccaactcgtggccggcgagtacgtcctggaaggcggggccgagccccatgccgaaggtcacgaggctgcctga

SEQ ID NO: 6604 - DNA, 534 bp, Methylobacterium sp.
atgccacagctagacgcgcaggaccgtcacacggtcgccttcaccctcaacgggcgcgagaccgcggtcgaagtcgagacccgcaccctgctgaccgacgccctgcgccacgggcttggggccacgggcacgcatgtcggctgcgagcacggcgtctgcggcgcctgtacggtgtccatcgacggggttcccgcccgggcctgcctgaccctcgcggtgggggtcgagggctgtgccgtgcggaccgtcgagggtctggccccggagcctggccgcctcggggtgctgcaggtggccttccggcggcggcacgccctgcaatgcggcttctgcaccgccggcatcctgatgtcactcgacgcctatctcgcgctccggccgaacccgtcacgacgagagatcacggaagtgatcgggggccatctctgccgctgtaccggctacgcgccgatcatcgaggccgccctggaggcggctgcggaactcaggggcgacatcccggccccgtcatccccggaggccgcccatgcttga

SEQ ID NO: 6605 - DNA, 858 bp, Methylobacterium sp.
atgtctgaggctctcgagattgctcatggcacctttggtcgcgtggcgctcctcgacatggaccggagccttgttcggcacgcgcatccgcactgccacgttcttctgaaggtcgaaggggacgacaccgagttcctcgtcggggaccgtgtcgttgcgctgaccgacgaacaagccgtgctcgtcaatgcctgggaaacgcacgcttatctccatgatccgcgccgcgccaaggcgatgatcctggccctctatatcgagccggactggctgggggccttccggcgcaattgggcggcgagcggggcgcctggcttctttggaaagcccttgggcggcgtgaccccgacgatccgccgcttcgcgcacgacctcgctgcggagatggtctacgcgccgcactcctcgcacattcaggatcagttgctgtcgggcctgatgatcgcggtaatcgagcggttcaccgcgtggcgtgaggaggccgagtcgctccgcgccgccgccaggcgcaacgccagcgattggcgcatccggcggactatcgcgcgagtgcgcgccgagcccggtgccacgttggggatcgaggccctggcccgtgaggcgggcctttcccgagcgcaattctatcgcctgttcgagcaatccaccggagctccgccccacgtcttcctcaacgcgatccgcatcgagcaggccgtcgagtcgatcgtgggcagcgaggaatccttggcggcgatcggcacgcgcctcggcttcgccgcgcctgcccatttctcgcgcttcttccgggatcatgtcagcgtgcccccaagcgtattccgcagcattgtccggcgaagcggccaacccgccgtgtga

SEQ ID NO: 6606 - DNA, 705 bp, Methylobacterium sp.
atggctttcaacaccgaactcgacagcgctctcgaagcggccttcgcggaggcgcgcgctctgtacaaggagcgcggtttccagcgccgcgtcgggttcggacggcgtcccgccctaatcaatgtcgacctcgccaacgcctggacgcggccgggcaatcccttcacctgcgagaacatcgacgagcagatcatccccggagttcaggcgctcttggccgcctgccgccgcaacaaccacccggtcgtgcacgtcaccacctgctaccaggtcaccgacgtcgacagccccaagaccgacatgggcctgtggcaccgcaagatcccggtcgaggtcgtggatcagaacaagcccgagctctgggcgatcgacagccgcatcgagccggtgccgggcgagcaggtcctggtgaagaagcgggcgagcgcctttcacgggacctaccttgccgggttcctgcgcgccaacaacgtcgacacgatcctggtcacgggcgtgaccgcctcggcttgcgtgcgcaccacgctctgcgacggtctcgccgagggcttccggaccatcgcggtgcgcgagtgcatcggcgaccgcgtgccgggcgccgtcgcctggaacctcttcgatatcgacgcgaagttcgccgacgtcgagccgctggagcgctgcgtcgcctacctcgacgaggtcgggctgcgcaacgccgcctga

SEQ ID NO: 6607 - DNA, 1053 bp, Methylobacterium sp.
ttgtctctcgatcgattctcgccgacgcgccggcaggcgctcctcggcggcgcggcggccatcctcacggcgggggcgggacgcgaggcgcgcgcggcggccggaacggtcgtcgtctccaactggggcggcgactggaaccagcgcacggtgcgcttcgtcgagacgcccctggtggaggcgcagggactgaccgtcgtgcgcgatctcggcatggaaccggagcgcaaggccaagctcctcgccgagcgccgcctgcgccggggcagcatcgacgtgattcatctgaacgactcggacgggttcgagatgatgaagcaggacgtgctggccgacctcgaccggtcgcgcatcccgaactacggcgacgtggtaccggccctgcgcaaggattatttcgtcccgtggctctacagtggcgtggtgcttatctataacaaggacaagatcaaggatccgccgaaatcttacgcggaactctgggacaagaggtgggccggccgcctcggtctgaccaatcagctctacttcaactacatgatgatgtccggcctgatccagggcggcaacctgacgagcgtcgagaccggccgcgagcggctcgtcgcgctgaaggaattggtccagccccggctctacgccgcgcatcagcagctcggcgcggcgctggccaccggcgaggtcgacatcgccctgaactacaaggcccgcggcctgcaatggattggcgagggctcgccgctggccatccagtatccgaaggagggcgcgatcgcgatcaccttcggcgccgggatgccgaagcgcgcgccgaacccagacggagcctacgtctacctgaacgcgatgctcgaccggaaggcgatggccgagctcgccgcggcgagcttctacgcgccggccaacggcgcggccgagctgagccccgagctgcgcgcccggatcgacttctcccccgaggagcgcgagcacctcaacttcccggattatgcctacgtctcgaagaacaccgccgagtggctcgagtggtggaacaagacgatggcgcgctga

SEQ ID NO: 6608 - DNA, 1158 bp, Methylobacterium sp.
atgtcagcgaacacctacgacgtcatcgtgctcggcgtcggcggcatgggatcggccgcctgctggcacctcgcccgccggggcgtccgggttctgggcctcgagcgcttcgacatcccgcacgccatggggtcctcacacggcttcaacaggatcatccgcctcgcctacttcgaggacccctcctacgtgccgctgctgcgccgcgcctacgagaactggcgggaactggagggacgcttcggcgagcaactcctcttcatcaccgggtcgatcgatgcggggccggagggcagcgccatggtcgagggctcgctcgcggcctgccggatgcacgacctcccgcaccgtctgctcgacggcgccgagctgcggcgcgtggcgccgggctacaacctgcccgacacgcaccgggccgttctccagccggacggcggcttcgtctcggccgagcgcgcgatcgtcgcgcacgtcacgcaggcgcaggcggccggcgccgagatccgggcgcgggagccggcgctgagctgggagccgacggcctcgggtgtacgcgtccggacggagcggggcacctacgaggcggggcacctgatcctgtcggcgggctcgtggatgggcgaattcgtaccgcagctcaaaaccgtcgctgtgcccgagcggcaggtgctcggctggttccagccacgggagccggccctgttcgcgccggaccgcttcccggtgttcaacatggaggtcgaagagggcaagttctacggcttcccggtctggcacgtgccgggcttcaagatcggccgttggcaccatctcggcgagacgggcggtgccgataccttgtcgcgggagtgcgaagccgaggacgaggcggtgctacgcccctgcgtcagccgctacttcccccaagcaaacggtccgaccatggcgatgcgggcctgcttcttcaccaatacgccggacgagcacttcgtgatcgatacgctgccggacctgccgcaggtcgtcgtcgcttccccctgctcaggccacggttacaagttctgcagcgtcgtgggtgaagttctcgccgacctcgccttgggcagaaagccgggatttgacctcagcctgcatgcgctcaaccgcttcgcaccacgttcgtatgcgagcactgattaa

SEQ ID NO: 6609 - DNA, 951 bp, Methylobacterium sp.
atgcggcccttcagctacgagcgcgccgcgagcgccgaagcggccgtggcggccgtcgccgcccggccaggcgcccggttcatcgcgggcggtacgaacctgctcgacctgatgaagttccagatcgaggcgccggcccatctcgtcgacatccggcatctgccgctgaaggccatcgaggatctgccggacggcggtctgcgcatcggggcgctcgccaccaacaccgaggttgccgcccacccgcgcgtgaagcgcgattacggcgtcctcgcgcgggcaatcgtggccggcgccacggggcagctgcgcaacaaggcgacgaccgccggcaacctgctgcagcgcaatcgctgcccgtacttctacgagacgtccctgccgtgcaacaagcgccaaccgggctcgggctgctcggccctcggaggcgtcacccgctcgctcgccgtcgtgggcacgagcgcgcattgcatcgctcagaacccgggcgacatggcggtggcgctgcgtatcctcgatgccaccgtcgagaccgtcaggcccgacgggtcgcagcgccggatcgcgatcggcgattttcacctgctgccggacgaccggccggagatcgagcacccgctcgaaccgggcgagctcgtcaccgccgtgacgctcccgcgaccgccgggcggggcgcaccactatcacaaggtccgcgaccgggcctcctacgcgttcgcgatcgtgtcagtcgccgtcatcctgcacaaggacgggacggggcgagtcgcattcgggggcgtcgcaccgcgaccctggcggctggagaacgcggaggcgctcctgccaagtggaccggcagccgtcatcacggcggccttccagagcgcgacgcccacggccgggaacgccttcaagatcccgctcgccgagcgcgcgcttgcgctggtgctgagcgaagggagggtgtga

SEQ ID NO: 6610 - DNA, 2748 bp, Methylobacterium sp.
atggaaattctgaccgcgctcgtcgaacgcgcaggacaggtcgtaagcaaggcggacctccacaagcgcgcatggccgcggacgacggttgatgagtccaatttgaaggtcaacatcgcggcgatccggcgcgcgttcgaaggggcggcaccggggaagcgcttcatcgcgacggtgagcggacaagggtaccgcttcgtcgcgcccgtcgacgtcatgtcctggccgatttcggcagcagcgcggcgccataaccttccgagagcgacagacctgcttggccgatccgaggatctcgcggcgatcgcgacgaaggtgctgcagcgaccgctggtcacgatcacgggtcccggcggcgtcggcaagaccagcttggccgtgacggtggggcacgccctcgtcgagcagttcccggacggggtctggatggtcgatctgtgcgtcatcgacagcgaccgctatctcgcgagcgcgttcgctcaggaaatgcgcatcgcaatccatgcggacgatcctcaggctgcactggccactgcgctggcggatcggcagtgcctgctcgtcctcgattgttgtgagaacgccctcgatcaggcggcccggctggccaccatgctcgctaccgccgcgcccggaactcacgtattggccacgagccgggagccgctccggatggcgcacgagaccgtgcatcgcctccgacccctgccggctccgacagcgctcgggatacccaacgcgaaggatgttctgactttcccggccgtggcgctgttcgtcgcgcgcgcctcggccgctgctccagacttcagattcgaggacgacgacgcgtgggccgtcgtcgagatctgtcgccgcctcgacgggttgccgctggcgctggaacttgccgcgacgcgggtcggggcgtttggacttcgcggcctccttcgcctgctgaacgaacgcctggaccttctggacgacggccgacgggcaggtcatccccggcagcgcggcctgaccgcgacgttggactggagctatgggctgctgtcgcaggtagagcaggccctgtttcgacggctgtccgtctttcacggcgtcttcccgctcgacgccgcgctcgcggtcggcctttctgctggggaggccgagcgtgcgtgcatcggccacttggccgatctcgtcgccaagtcgctggtcgtcgctactcctgggtggttggcccggtaccagcttctcgacacgacgcgggcctacggattgcagcgcctcgccgagagtggcgaggatgatgcggttcgtcggcggcacgcggagttttgcgtcgcgcaatgtcgcgacgtctcggcgcgcaggagcgcgcgggcggcatccgacccgcgcgaggagttggtcgcgctcgtccacaacgtccgcgccgcactcgactggtgcctaaccgaccggcgcgatcccgtcctcggtcgaacgctggcagccgaggcgctcgtggtgtgggacacgctcgcgctgcttcaggaacggatcgaggcgagcgagtgggcgctcgcgtcggccgcccccgccgacggtccggaagaccggtacgagatcacgctgcgggcgtcgctcgctgcggccctgttgcaggtcgagggtccgacggcgcggatcgcggagttgtggagcggggcgctcgcccgcgccgaacggctgtccgacggcgatggccagttgcgggcgctttggggcttgtgcgacttccagacctgggtcggagaccacagcgcctcattcgccctgacggagcgcatcaggacgctggcggccgccagcggcgatcgcgcggccggcgcggccgtcgaccggcccgccgccaccgcgctccgctatctcggccgtctcgacgaggctcgcgaggcagcggagcgcctgctggcccgtgcggcccgccgtgacagtcccggccggcggctggaggatcacggcttggtcgcggcgcgcggcaccctcgcgaacgtcctgtggctccagggacgggcgaatcacgccgtcgcgtcggcgcggcgtgcgctcgtcgaggccgaagccagcggccaggccttcgccctcacgaatgccctggcgcacacggtgatcccgatcgcgctccatggcggcgatctcgacgaggccgagcgcggtctcgaccgcctcggggaccacgtcgctcgtcacgccatgcggatctggcaggtcatcgccgattgcctcgaagcgatcgtgagcctccgccggggcgacgcgggcgggctgcaccgcctcgaggatgccctcgtcgagatgggggagatcggcttccgcatgcggcgtccggcctatctcggctcgctggcgtccggccttgcggcgcatggccgccttcccgacgcgctcgctcgcatcgacgacgcgctcgccgcctccgagtgcggcggcgaactctggtgccagccggaactgctgcgcatcaagggagtaatactcctcgcctccaccggcatcgccggcgagccggacgcggcgcggcacttcctgcaagcgatcgatctggccggaagccagggagcggcgatgtggcgcctacgggccgcgacgagcctcgctgcgctggatgaccggtttggtggccaggaagccctcgccgccacgcttggcgacttcgacgaagggctcgacacgcccgatctcagggctgcgagggcgcgccgtgctggtcgggggggacttggcagagatgcgggccggccggtctccctggcttga

SEQ ID NO: 6611 - DNA, 1083 bp, Methylobacterium sp.
atggcacagaccgtctcgtggggcgtcctcggcaccggggtcatcgcccagcgcttcgtcagcgaccttctggggcggccggacgcgcgcctcgccgccgtcggggcgcggagccacgggagcgcccaggccttcgccgcggccttctcccaggcgtccggcgcgccggccgccgtcgccggcgtcgaggccctggccgcgcggccggatatcgacatcgtctacatcgccacgcccaacagcgaccacatggacagcgcgctggcctgcatcgaggccggcaagtcggtcctgatcgagaagccgatcgcgctctcgggcgggcaggcgcgacgcatcgcggaggcggcgcggcgcgagggcgtcttctgcatggaggcgatgtggatgcgcttcacgcccggcgtcgtgcgggccaaggcgatgctggaggcgggcgagatcggcgatcccctgcatctcgacgcccgcctgttcttcccccgcgcgccgaacgcgcccggacggacggacgatccggccgaaggcggggtgatcctcgatctcggggtctaccccgtgtcgctggcgctccacctgttcggcgcgcccacccaggtctcgggcgtcggcctcgatcggggcggtgcggcggcgcggcaggccgcgctcgcgctcggctggaacgccaggaccgcgaccctgagctgcggctcgaccggagaggccgacaacgccgccgtgatcgtcggcacgcgcggccgcatccacctgcaccggcagttcctgtgcccgcccttcctgacgcgcgtgcgcaccgcggccgcgccggcgcccgccgaccgtgccccgccgcgccgccaggccgtcggccggctggccttcgcgaaacgcctcctgcagccgctggacttccgccgcgtcgcgctgatcccgacgccgtacctcgggttcgggctgcggcatcagatcgacgaggtgcatcgctgcctgctcgccggcgcccgcgagagcccgatcatgccgctcgcggacagcatccgcaccctcgacatcctcgatcgggtccgcgcccggccgcagccgctggaggccgtcgcctag

SEQ ID NO: 6612 - DNA, 1230 bp, Methylobacterium sp.
ttgccgatcgggacgagtgcgccggccgcgtccctcctcgcggaccgcgtcgccgtgttcctgctcggcgccgctctgaacttcaacgtcctgacctcgaccttcgggctgccgttccagcgcctgtccgacctgctgccgttcctgctcatcccctggctcgggttgcgccgcgccgtcgtcgcggaggcggtgcggcaggccgcaccgctcgccggcatcctggcgctgatcgcggcctcgctggtgctgaaggcacacaagcaggcgggcgacgtctacctgaccctcgtcctgctgctctacgtggtccaggcgttcatcctgctggtgatgttccgcgaccggcgcttcgaggacgcgttctgcgtcggtctgctcgccggcatgctcgcctccctggcggtgctgctgctcgccgcctccggcacgccgctcgaccggttcgggctcgcggtccccacggacgggctcgacgaggagttgaagctgttcgtgcaggacaagcagggcggcctctgggcctccggcaacgagaccggccacgtcttcgcgctggccggggccgcggccctgctgctcagcctgcgctaccgcatcaagatcatctatctcgcctacttcgcggccctgctggcgagcttcccgttcaccaacaaccgcgccggcctgttcatgccggtcctgttcctcggcctgctgatgcgccggaacctcaaggcaccggcggtgctggccgcgctcggcgtcctgggcgtcctgctcgtggcctgggcggtgacgggggagatcccgctgccggggaccctgtcccaggcgatcgagcggcgcttcgccgaggaccacaacgtcacgggcaatttcgacgagcggttcctgtccggcgtgaccgcgctccagctcgtcgtcgagtacccgttcggcgtcggcgaggtcgcccgccgggaggagctgcaggcgctgaccggactcgtgacgccccataacggcttcgtctcgctggcgctccagagcggcatcgccacggcgctgctgctcatcgccggcctcgggcgggtcctgctggcgcccgccgcgttcgggccgttcctgacctacagcgcggtgttcctgatcccgtcgctgatgttcgaggagctgtcggtcaaccagtacttcctcttcttcatgggcttcatcctggcgtccctcgcgctgccgccggaccgggcgcagtccgagacccgatag

SEQ ID NO: 6613 - DNA, 1338 bp, Methylobacterium sp.
atgatgacccccaccctgtcgtcgaactatgcccgggtcctcgccgaggagccgcgcgcccaaggtcaggaccggccgagggagcaggcggccgcgcgcgcggtgaccggccccctgcggatcctgcatctcagtgccctctacccgccctacatcgtgggcggcgccgagcgctcggtggagcacctcgccgaggaactcgtcacggccggccacacggtcgcggcggcctgcatcgcccgggagcccgagcccaagagcgtgcgcggcggcgtcactgtctaccgcatggcccaccacaacgatttctggctggaggactggccccaggcgagccgcttcggccgcgcctgggccaaggtcaagcagcagtggaatttcgcggtcgcggccgagttcggccgcgtcctagacgatttccggcccgacatcgtcaacacgcactcgctgctcgacgtctcgaccctcgtctggcgcgaggcggccaagcgcgggatcccgatcgtccacacggtctgcgagtacgacctgatctgcggcaacgccgcgatgttcagggacggcaagccgtgcgaccgctggcacctgggctgcaaggtggtcaacgccgccaagcagatcacgaaccggtcggtcgacgcggtcgtcagcgtcggcaccgagatcctcaagacccatgtcgaccacgggctgttcgcgcatctcgcgccggagcggcgccgggtgatcttctactcctgcaccgtccccgagggcgacccggaggcacggcgccggatcgaccggaccggccagccgatgaccttcggctacctcggccggatcaacaccgagaagggagtcggcacgatgatcgacgccttccggcggctcggtcccggcgactggcgctgcctcgtcgccggtcacgcgatggacgactcgatcgagcgcttcaaggcccaggccgagggcctgccgatcgacttcgtcggctgggcgaagcccgccgagttcctcagcgccatcgacgtgctcatcgtcccgtcgttctgggccgagccgtcgccgcggacgatctacgaggcctacacgatgggcgttccggtgatcggagcggcctcgggcgggatccccgagctgatcggcgaggacaacgccgactggctgttcacgccgggtgacgacgccgacctcgccgcgcggctgcggagcgtgatcgaccgcggtcgcggcgacctgccggacgagcgcgccttccagcacgtcatccgcgagtcgacctcggagcgcgtcgccgagaagtatctcgatctctacgccgaactcgtcgccgagcgtcgggcatctcgtccgtga

SEQ ID NO: 6614 - DNA, 1257 bp, Methylobacterium sp.
atgcgcatcctgcaccttagctcgctctacgcgcccgagcaggtcggcggcgccgaactgatggtcgagacgctcgcccggacccaggcggatctcggccacagcgtcgctgtcgcctgcgccgcgcggaccgagggcggaccggtcctgcaggacggcgtcaccgtttaccggaccggctacgggacgccgttccacatcctcgactggccgcagcgcgggcgggccgaccgcctccgctacaagctcgcggcgcagtggaaccgccacgccctcgaccggatggcgggggcggtccgcgacttcggccccgacctcgtgaacacgcactccctctccgagctgccgccggcgctctggccgatgctccggcggatcggagtgccgatcgtgcacacgctgcacgacttcaccagcctctgcaccaatggcgcgatggtgcgccacgggcatccctgcgcccagcagcatctgaagtgccgcctctacgccgcgccgcaccggcgctgccagcgcgccgtgacggccgtcaccgccgtgggcacggacatcctcgaccgccacctcgctgccggactcttcacccaggtcccgccgtcgctgcgccgggtgatctggaacccgatcccctccggatcgcccgtggcgcggggaaagcgggcgcccggcgcgccgatccggttcggctacctgggccggatcgagggcgcgaagggcttcgacgtcctcctcgacgcctgccgacgcctgccgggatcgggctggagcctcgccgtcgcgggccgcgccgtggacgggctggacagctaccgcggcctggccgagggcctgcccgtgaccttcctgggctacgcggagcgcgacgccttcctcgatgatctcgactgtctcgtcgtcccaccgacctggcctgagcccttcggccggacggtggcggaggcctacgggcgcggcgtcccggtgatcggcaccgccaccggcggcatcagcgagcaggtcgggcccggcccctggctggtgccgccgggcgacgcgccggcgctcgccgccgcgatggcgcggatcgtcgcggagccggcccgcctcgccgaagggctcgcccgctcggcccggatccgcgccggcaccgatccgctcgccgtcgcgaccgcctacttggacctctacgccgcgacccgcgacgcggcccgcaccgaaccgcttcccgagctttccgcccgcgcggagcgcccgcacctcagcgagtgccgttcatga

SEQ ID NO: 6615 - DNA, 2196 bp, Methylobacterium sp.
atgtccttcctgactgtcgatctggccgaccggacgccggttcgcgccctcgcccaagagccggcgcgcggcggtccgctggccgcggccctcgcccggatctggcatcgccgctacctgttcgcggcggtgttcgccaccgtcctcggcctcgccgtgaccgccctgctgatgatccagcggcaatacgtggcgagcggctccgtgatcgtggccgaggcggagccgggcgccaacaacgcctcgatggcctggatccagaagatcggcgacccggctgacatcgagagccagatcctggtgatccgctcaccgcggctcctgcgcctcgcgatcgacgacaacctcgtcgccgcggtgctggccgagtgccgctacgcggccacaggggggcatcccgaccggatcagcgagaagaaggaggccgcctgcacgaagctcacgaccgaccgcaacgcgctcgtcgagtacctgcagaagcgctacacggtcctgagctccggccgctcgcgcatcatcaccatcggctacaagtcgccgctgcccgagacggcgcagacgatggccaacggcctgatcaacgccttcctggacgaccagcgcgaggcgcaggcctcgagccgcaaggccgcggccgactggctccacaccgagatcagccagctggacgcctcgatccgggccgacgagacccgcatccagaccttccggcgccgcaaggggctgctgaagggctcgctcgccccgatcagtgcggagcggctcaccagcatcagccagcagctcgccgcggccgagaccgccaaggcggacgcggccgcgcggctctccgagatcgaggccaagggtgcccgcggcgccgacagcgccccggccgtcctggcaagcccgaccatcgtctcgctgaagcagcagctcagcggcgtcagcgcgcagctcgccaatcagagcaccctgctgggcgcgaaccacccggtgatccgggcgcttgagaccgagcaggcgagcctgcgcgcgcggatcgagcaggagatcggcaacgtcgccaggggcctacgcaagtcctacgaggcctcgaacgccctcgccaagtcgctgcgcgcccagctcgagaccgcgaagacagacgccgccgccgccatggacgacgaggcgtcgatcgagggcatggtgcgcaacgccgagatcaagcgcacccgctacgccgacctggtcaagcgggcgggcgagttggagaccgagcggcgtatcctcaccggcagcacgcggctcgtcagcctcgccgagctgccgcaggagccgttctcccccaaggccgtgccgctcctggcgggcggcatcgtgctcgcgggcgtgctcgccgccgccgccgcgctgctgcgggacttcaccgaccgccgcgtgcgcacctcggcgcagctgatcgccggcaccggcgcgccggtcttcgcgcagctgccgagcctggagcccgccggcctcgtcggccgcttctccgagcggcagcgcgagctcgacctcgcggaggccctggcgcgggcgcgggtcgatccggtgatgcagaacgtcctgcgcaacctgcacgcccatctcgtgctggcgggcgccggcaagtcccgcgttatcctggtgacctcggcgaagccgcgggagggaaagtcattcacggccttcgcgctcgccggcatcggcgcggcgagcggccgccgggtgctcgtggtcgagtgcgatctgcggcgaccgaacttcgaggcctccctcgggctcggccgcggccccggcctcggcggtgtgctccgcggcgagatcgacccggcagaggccgtcgtccaggccgggcgcttcgacgtcatcccggctggaacgccgacggccgactcgaccgagctcctgatgggcgaccggatggccgattttctcaagtggagccgccgctacgacctcgtcctcctcgacaccccgcccacaagcctcctgatggacgcggcgatgctcgcccgccacgtcgacggcgtgctctgctgcgcccgctacggccgctcgcagctctccgacaccgtcgagaccgtggcgaacctgcgccgcgccggcggacacgtcctcggaatcgccatgacgatggtccgcccgggcatccagtcgacctacgacgtgatgccgctgcccgatccccgcacggccgcgagcgcgcgatga

SEQ ID NO: 6616 - DNA, 723 bp, Methylobacterium sp.
gtgacccgtctcacgcgccggtcggccctagccctggcggctggcgccctcgcggccggtcgggccgccgcggccgagccgctgcaccgttgcgaggcgctgatcgactcgatcggcgtcaacgtgcatctcggccatcgcggcaccccctacgtcgaccgcttcgccgcctgcgcccgggcgctcgacgaactcgggatccggcacctgcgcgacgacatcgtgctggtcggcgacgagccggccgggcagttcgagcgcatcgccgatctggccgaccggggctaccgcttcagcctgatcttctacgacgggctcacgccggggccgcgcgtgccgccggagcgcttcgccgagatcgcccgctgggccggcgacgggctcatcgtggcggagggcggcaacgagccgccggtcgcggcgcggccgggcctcgcgcggctctcggccgatcatcaggcggccctgttccgcgcggtgcgggcggatgcgcgggccgaggccgtccgcgtggccggaccgagctacatccagggcaacgtcgcggcggcgcaggacctcgcggcggtcgtcgacctcgccaacatccacgcctatcccggggccgagcacccggaaaccgacggcggcggcagcctcgcgcgcttcgtcacggccgcgcgcccggtcttcggcgacgcgccggtgatcgcgaccgagaacggctaccacacggcgctcgcc

SEQ ID NO: 6617 - DNA, 135 bp, Methylobacterium sp.
gtggtcgagatccgtatgtcggaggataacgacggccgctggacggtctacgcgccggggctggtggtcaccgatctgacgcacgaggaagcccaggcgttcgcggcgagctaccggcgcgtcaccgcagcgtga

SEQ ID NO: 6618 - DNA, 987 bp, Methylobacterium sp.
atgtcctgcgatacgctctcaaatctgttctcgaccttgtcggtgcaggttcacgctttcgctttctgcgagattcaggcgggctggcagctggcgaagaacggcatgccggacgcgatcctcgttcactacgttctgtcagggtgcgggacgattgccgtggaaggtcaagaacctctgcgtttcgggccgaattgcatcattattcccccgcgcggcatgcagcacgcgatcggtttcgccggagccacccgggcggttacagctgacgatgcgcgcagagtacttccagacggtctcatcgcactgacggccggcgatggaagtcgcgacattctcttggcctgcgggtccatctcggcgcgctatgccggcgcgctcggtctcttcgatcgcctgcatgacgcgctggtcgaggatctgtcgggcagcgatcggttgcgccacgccttcgctttcatggtcgaggaactggttcaaccgagtttcggcacgcaggaggtgacgagcgccctgatgaagcagtgtcttgcgatcctgcttcgcgttcacctgaaggagaagggcgcgcaatcgccgatcttcgaggcattgcgcgatccgaggctggtcccggcgatcgccgcgatcctcgatgcacccggggcgccgcatacagtcgatagcttggctgcgctctgcgcgatgagccgctccggattcgccgagcgtttctccgccatcttcgacgagggaccgatcgaatatctgcagcgggcgcgccttcaacgggcagccaggctgctgacggcctcgcccatgcccgtgaaggtcattgccgagagtgtcggctacgccagccgcagctacttctcgcacgcttttaaagccgcctacggttgcgacccgagcgcctaccgcacgcgggcgacgcgcatggttcaggcgctggaacccctgccgacgcgcggagccggcgtcgcgggcccggatcccggagaggcttga

SEQ ID NO: 6619 - DNA, 393 bp, Methylobacterium sp.
atggcgggccgcgccgccgaccggtttcctcaaccggtgcgcgtcggcgatctccccggccgcttcctgctccagccggaggagtcccagcccgtgctcggccgcgtgaccgggctcgtccgccgcgccgacggtggcaccgccgtgatcgttcgcctcgacggtgccctcgggctgacctggctcggccttcggccggtggcctggagcgggatcggcccccggctcgtggccgtgccggtcgaggcggtggcgctcctcggcgagcacgtcgccctgatgggcctgacgccggagcgcctgcacgcgctgccgaccttcgcgaccggctcggccaccgcgatcccgccggacgagacgctccgcgtcgggatcgtccggcccttccactga

SEQ ID NO: 6620 - DNA, 1116 bp, Methylobacterium sp.
ttggcggcgtatctcgaccgctggtcgggctgtgcgcaccacgccctcgccgcctcggattcggaaccgctgacgctcaccgcgttgctgcacttcgccggcccggaggatcgtcgacgctggcgggaggccgatctcggctacgccgatccgcgcggcgccgactggctgcgcgccaccgtcgccgcccgctaccgccggctcgaggcggacgacgtgctgatcagtgccggcgcgcaggaagcggtgacttccgtgctgagcgcactcctcggtccggccgaccacgcggtggtggtggtgccgatctaccagccctcggaactcgtcgtgacccgcctgtgcgcggccgatggcgttgcgctccgcccggaccggaactggcccctcgatctcgaccgcctcgcggcggccatccggccgaacacgcggctggtgctgatcaacttccccaacagcccgaccggtgcggcgctggatcgagcgaccctggacggtctgatcgacctctgccgccgacacgggctgtggctcgtcagcgacgaggtctaccgccagacggaccgcgacccggagcgcgccgttccgcccgtcgtcgacctgtacgagcgcgggatctccatcaacgggctgtcgaaggggttcggactccccggcctgcgcgtcggctgggccgcctgtcgcgaccgcgggacgctcgaccgcatcctcgcggccaagaatctgctgtcgagctgcctcgcgcggccgagcgagatcctggcgcaggtcgcgctgcaggccgagccgcacctgacccgccgcgcccgcgggatcgggcaacgcaaccttcaccgcctgcgggcgctcctcgaccgccatccggacctgttcgatccggacgagccgaggaacctcgccttcgcttgtccccgcttccgcgggcgggagggggcgaccgccttcgcgcggaccctggcgtctgaggacggcgtcctcgtgctgccctccgtcctgtggcactctgggctggcgtcgatccccacggaccgcctgcgcctcggcctcggccgagtcggcagcggtgcggcgctcgggatcctcgcggttcacctgctgcggcgcgccggccgatga

SEQ ID NO: 6621 - DNA, 1593 bp, Methylobacterium sp.
atggcggatgtactgatcgtgggagccggcccggtcggcctgacgctcgcctgcgaactggcccggcacggggcgcgctgccggatcatcgacggggcggcgcggccgtcgccctattgccgcgcgatcggggttaccccgcgcacgctggaagtctgggaggacatgggccttgcccgtgatatgatcgacgcgggtctctggctcacgggcctgcgcacgatcctgcacggtcagccgccggtcgacgcggtcagtgcgccgctggatctgccctacgcgtcgctcggtctgccccagttcgagaccgagcgcgtcctgaaccgccacctggagcgcttcggcgtccgggtcgagcgcggcctgcgcctgacggtcctggagcaggacgctgccggaatccgcgcgcacctgcaggaggcaaacggtgcggtcgcggaggcacacttccgctacgtcgtcggctgcgacggtgcccacagcacggtccggcgcctgctcggcatcgcgttcgagggcgaggcctatccctggcccttcatgctcggcgacgtgcacatcgcctgggacgtaccctacggcctcgcggttcgggccctgcgactgaacgaggacgccccgcccgacatgttcatcgccatcccgctccccgagccgggccgctaccgcgtctcgatgctcgcgccgcaacatctggtgccagcgggcgggtcggatcacgggatccaggtcgagctccagggaccgtcgctggccgaccttcaggccgtcgccgacgatctcctgccggacggctcgcgcctgtcggacctgcgctggtcgtcggtgtaccgcatcagcatgcgcctcgccgccgcctatcggcgcggccgctgcttcctggcgggcgacgccgcccacatccacccgccgaccggcgggcaggggatgaataccgggatccaggacgcctacaatctggcctggaagctcgccctggttcttcgaggtaccagccccgaggctctcctcgacagctacgagggggagcgacgcccggtgggcgcggacgtgatcgcgcggacccgaacagcgagcgagggatacggtcgggagcgcggcggcgcgccggaccgcctcgccgacacgcaggtcctggtcagctaccggaacacggcctggatcgccgacgacgcgacggagccgacggaggccggcccgagggccggcgaccgggcgcccgacgtcaacgggctggtccgcgacgggctgggcttcccgacgcggctcttcgacgccctccgcggcaccgagcacgtcctcctcatccatgctgccgggatgtcggacgccgtggccggccccgatctgccgatctgggcccgccagcaccgtccccgcgttcgggtcgtcgtcatcggcggcgacgcggccatccccggcgtgacgacgctcgcagatccgacgggggccttcgatcgggcttacggcgcggggaccatggcgtggctgatccggccggacgggcacctcgcctggcgcggccggacgtggcgcgagcccggcctgcacgcgcatctccggcgccaattcccgtcggccttcccgcaatga

SEQ ID NO: 6622 - DNA, 1695 bp, Methylobacterium sp.
atgagcgaccgggcggtgagctatgtccacggggcgatcggcgagcccctgctcggcctgaccatcggccaggccctggatcgcgccgccgcggcgtggccggatcacctggcgctgatcgcgcacgcccagggcgtccgatggacctggcgcgagctgaaggaccaagccgacgccttcgcggccggcctgctcgccctcggcctccggcccggcgaccgtatcgggatctggtcgctcaaccgcgccgagtgggtgctgacccagttcgccgccgcccgtgcggggctgatcctggtgacgatcaacccggcctaccggctgtcggagctggaattcgcgctcaacaatgtcggctgcaccgccctggtcacggcgacggcgttcaagaccagcgactatctcgggatgctcaacaccctggcccccgaactcgccgcctccgggccgggccggctgtccgccgctcgcctgccgcacctccgcacggtgatccagatcggcggaccgccggccccggggacggtcccgttcgacgcggtcgcggcccggggcgacgcggccggcaccggcgccctgcgcgacctcgccgacgcgatgcagttcgacgacgcggccaacatccagttcaccagcggcacgacgggcgccccgaagggcgtcacgctgacccaccacaacatcctcaacaacggccacttcgtcggtcgcgcgatgcggctgaccgccgaggatcggatctgcatcccggtgccgctctaccattgcttcggcatggtgatgggcaatctcgcggccctgacccacggttgcgccatggtgtttccgggcgagggcttcgacccgcgcgcgacgctggagaccgtgcaggccgagcgctgcaccgcgctctacggcgtgccgaccatgttcatcgccgagctcgaccatcccgagttcgcgcagttcgatctccgctccctgcggaccgggatcatggcgggcgcgccgtgcccgatcgcggtgatgcgccgggtcgtggagcagatgaacatgcgggatgtcaccatcgcgtacggcatgaccgagaccagcccggtgagcttccagagctcgagcgacgacccgctggagcggcgcgtcacgaccgtcggccggatccacccgcatctcgaggtcaagatcgtggatcccgagggacgcgtgacgccgcggggcgcccgcggcgagctgtgcacgcgcggctactcggtcatgctgggctactggggcgatgccgcgcggaccgcggaggtcctcgacgacgccggatggatgcacaccggcgacctcgcgacgctggacgcggaggggtactgcaacatcgtcgggcggatcaaagacatggtcatacgcggcggcgagaacatctatccgcgcgagatcgaggagttcctcttccggcacccgcagatccaggatgtgcaggtcttcggggtttccgacccgaaatacggggaggagctgtgcgcctggatcaggctgcgcgacggcgagaccctgtcggagccggcggtgcgcgcgttctgcgcggggcagatcgcgcatcagaagatcccgaaatacatccagttcgtcgatgccttcccgatgacggtctccggaaagatccagaaattcgtgatgcgtcggtgcgtggaggagcagctgggcctcgcgcgatccgagacggcctga

SEQ ID NO: 6623 - DNA, 3879 bp, Methylobacterium sp.
atgctggacatggaccggatcggatcgcgaaagggcgggctctccgtattcgggaaggcgacgccttgcccggcgccgtgcgtcgcggcgctggcagtcgcggtgatcggcctcctcgccgccctcggggcggcccagtggacccgtgcttggaacggacgcgtcacggcggagcggttccaggtcgccgcgggccggctggcctctgtcatcgatgggcggatggcccgctacgagtacggcctccgcggcgcccgcggctccgtgctgtcggccggcgaggccgggatcacacgtgaaggtttccggcgctacgccgacagccgcgacctgggacgggaatttccgggggcgcgcggcttcggcttcatccggcgcgttccggcggcgggcgaggccgcattcctggcaggcgcccggcgcgacggcgccccagacatgcgcatccggcagttgcagccgcacgatggcgagcgctgggtgatccagtacgtcgagccgatggcgcgcaaccgcgaggcggtcggacttgacgtcgcctcggaggaccaccgccgcggcgccgcgctccgggccatggagaccggggccgcgacgctgaccgcgccggtcaccctggtgcaggccaccggtatgaaggagcgcggcttcctcctgttcctgccggtcctgcgcgacggtgcgccggcggccacgcctgacgaacggcgggccgcgaccttcggctggacctacgcgccccttatcatcgacgaggtgctcgcgggcgtcgacctcgacgccgacgagctcgacgtcgccatacgcgacgtcgaaccggaagggacgacgcgtttctacgccggacgcgacgcgaccgaggtgccgccgggcggcctcgccatgacccgacgcctgtccatcttcggccggacctgggacgtcgacgtcaccgcgcgcgccgccttcctcgcgggcctgaacctcgtccggcccgcgaccgtggccgcggtggtcgtcacgggcgcgctgctgctggccgggctggtctacctccgcctcaccggacgccggcgcgaggtcctggccgccgtcgagaaggcgcggctggccgccatcgtcgagaacgcggatgacgccattgtcggaaagaccgtcgagggcgtcgtgaccgactggaacccgggcgcggagcgccttttcggtttctccccgggagaggtgatcggccggccggccgaggacctggttgtacccgcgcacctccgtgcgcaggaacgtgacgtcctcctgcgcataagccatggagacgccgtggcgcctttcgcgacgctgaggacccgtaaggacggaacggtcttcccggtcctcgtgaccgcctcgccgatccgtgggccgaacggtgcggtcgccggcgtcgccacggtcatccgggacatcacggagcaggcggctgccgaggaacatatccgcacggtcaacgcctccctcgaacggcaagtggccgaacgcaccgcggcgctccaggccggctcggcgttgcagagggccgtcctcgaccacgccggctatgccgtcatagccaccgacatgtgcggcaccatcaccctgttcaacccggccgccgagcggatgctgggctacgccgccgaagagctggtgggcaaggcgacgccgggcgtgttccacgaccccgcggaggtcgaacgacgggcgggggtcctgtcgcgggaactcggccggccggtcgagccgggcttcgaggtcttcgtcgcgaaggcgcgccgcggccagcccgatcccggcgagtggacctacgtcaccaagggcggcgagcggctgccggtgctgctcaacgtcaccctgctacgggcgggtgacgggaccgacctgggcttcctcggcatcgccatcgacctgagcgaacgctaccggcacgaggccgagatgaaggccgcgcaggccggcacctggaactacgaggtcgcgaccgggcgggtgcggttctcggcggagtgcgcccggcagcacggcctgccggaacgcgagaccgagatcgacgtcgaggccgagtggaagcggctggcgcatcccgacgacgtcccgcatgtcctcgccgacctcgcgcaggccatcgaggccgggggcagctacacgacggagttccgagtgccgctggcggacggcggcatgcgctggatcaccgccgtcggccgggtcgaggcggacgcgtcaggaatgacgtccagggtcatcgggctgacgctggacacgacggccaggaaggccgccgagatcgccctgtccgaggccaaggcagtggccgaggcggcgcgcgcggaggccgagcgggcgaaccgcgccaagaccgacttcctcgcctcgatgagccacgagatccgcacgccgcttaacgcggtcatcggcttcaccgacctgatgctggcctcgggccggctggacccgggcaaccgtcggcaggctgagctcgtacgctcgtccggcaacgcgctgctgaccgtcgtcaacgacatcctcgacttctccaaggtcgaggccggggccatcgagctcgtcgaggccccattcccgctgctggccatggtcgacaactgcgtgtccatcgtccgcggcccggccgacgccaagggcctggagttcaggctgcgcatggacccggacctcccgcgctggctgaagggggacgagcaccgcctcaggcaggtgctgttcaacctgctcaacaacgcggtgaagttcacggcgtccgggtccatcaccctcgacgtcgcgccgcaggggcgcatctcgggcggcgagcgcgtgcgcttccgggtcgtcgacaccggcatcggcatcccgaaggacaagcagaaccgccttttccaacgcttcagccaagtcgacggctcgatccagcgggacttcgggggcaccgggctcgggctggccatctgccggcacctcgtcgagctcatgggcggcgagatcggggtctcgtccgtggaaggcggaggctcgaccttctggttcatcgtcagcatgccccgggcgtccgcgccggccgaggctccgtcacccgcgcttccggccgccccgcgccgaacgggccggcttttgctggtcgacgattcccttatcaaccaggagctcgcacgggcggtactgattggcgccgggcacgtggtcgagacggtcggtgacgggcaggcggcggtcgacgcggtcagggaccgagccttcgacctggtgctgatggacgtgcagatgcctggcatggacgggatgaccgccacgcggctgatccgggagttgccggggcccgtgtcgcgattgccggtggtggcgatgacggcgaacgtgctgccggagcaggtctccgctttccgcgacgccggcatggacgaccacgtcggcaagccgttcgaccgggatcacctctacgcgaccgtcgaccggtggttggcgcggagcgggacggatgacgtgatacccctcccggagtctgcgagcccggaattcgacgaggatgcctggagcgccgtgcgccgctacctgtcaccgggccgcccccgcgaggtgctggctctcctcgtcggggaactggataccagtttcgagggcgacgccgccgaccaggccgtgcgcgtccgcctccgtcttcgcgcccactcgctgtcctcggcgtcgggtatgatcggcttcaccgagatggcgacggcctgccacgcgctcgaaaggttcgacgaggcgcgggtggcctcggagggggtcgccgcgttcgccaaggccctggaccgggtgcgcggcctggcggaccgctgcgcgcggaaggcggagcgcatgctggaagacatggagggctcgccgggcctcaggacggtctgcgggcgtggttga

SEQ ID NO: 6624 - DNA, 1239 bp, Methylobacterium sp.
atgccgctccagccccacgagaccgccttcacgcaggcccccgcgccgccgcgcccggtgccggtccttccggacgccgccgcggcgctcgccgtcgccgaccggctggcggaggccttcgccgaggccgccgccgagcgcgacctggagcgccgcctgccggtcgccgagatcgcgcgcttcaccgaatccggcctctgggcgatcacggtgccgagggagtacggcggccccggcctcgacagcgccacggtcgcccaggtgatcgcccggatcgccgcggcggacggctccctcggccagatcccgcagaaccatttctacgccctggaggtgctccgcaacggcggcaccgaggcccagaagcgcgccctctacggccgcgtcctggcgggcgagcgcttcggcaacgcgctcgccgagaccggcgcgcgcgaccacacccgccgcacccgcctcgtgcgcgacccggccggctggactgtcgagggccgcaaggactactgcaccggctcgctctacgcccaccgcatccccaccctggccaacgccgaggaggacggccgggcggtcgcctacctcgtcttcgtcccccgggacgcgccgggcgtgaccctggtcgacgactgggacgggttcgggcagcggctcaccggctcgggctcggtcctgttcgagcgcgtcgccgtggagcccgactgggtggtgccgttccaggcctcgctggagcggcccaccgccatcggccccttcgcgcagatcctgcacgccgggatcgatctcggcatcggcgcgggcgccttcgcggcgaccttgcccttcgtgcgggaccgcgcccggccgtggatcgattccggggtcgcgcgggcgagcgaggatcccctgaccctccacgcgctgggcgacgtccaggtgcgcctcgcggcggccgacgccctgctggcgcgggccggccgctacgtggacgccgcgcaggaagcccccgacgccgacagcgtcgcggccgcctccgtggcggtggcggaggcccgggcggcgagccaccgggccggcctgctcgcggccaacaagctcgtcgagctcggcggcacctcggccaccgaccgggccgaggcgctggaccgctactggcgcgacgtccgcacccacaccctgcacgatccggtgcgctggaagtaccactggatcggcgcctaccacctcgacggccggcagccgccccggcacggagcgctctga

SEQ ID NO: 6625 - DNA, 1125 bp, Methylobacterium sp.
atgaccgtcagaaccgccgtgccggaccggtccgggaccgcgccgaccgggtcgcggcgggcctccgcctggaccggggcggccggcaccctgatcccgggcctgctcctgtgcctgggcatcaccgcggtggcgcaggcgctgcaggccggcgaggagcacctgaccggccatccctacgtcgaggccctggtgctggccatcctgctggggacggccgtgcggaccgcctgggtgccgggcgcgcgcttcaaggccgggatcgccttctcggccaagcaggtgctggaagtggccgtcacgctgctcggcgccgcggtgagcctcggggcgatcgtcgcctccggcccggcgctgctggccggcatcgtcggggcggtggcgctgaccatcctggcgagctgcgcgctctgccgcgccctgggcctgccggtgcgcatggcgctgctgatcgcctgcggcaacgccatctgcggcaactcggcgatcgccgcggtggcgccggtgatcggggcggacagccgggacgtggcggcggccatcgccttcacggcggtgctgggcgtgctgatggtgctgggcctgcccctgttcgtgccgctcgtcggcttcagcgagcaccagtacggcgtgctggcgggcctgaccgtctacgcggtgccgcaggtgctggccgcgaccgtcccggtgggcccgctcgccacccaggtgggcacgctggtcaagctcgtgcgggtattgatgctcgggccggtggtgctggcgctctcgctcctcgccccgcgcctgccggcggcaggagcgaccgccaggcctgccgcggggagcgccccggggagcgcccggcgccggcccggcttcttcaagctggtcccgtggttcatcctcggcttcctggccctggcgagcctgcgctcgctcgggctgatcccggacgcctgggtcgcgccgatctcccgcctcgccggcttcctcaccatcgtgtcgatggccgcactcggcctcggggtggacgtgcgcgtgctggcccaggtcggcggccgggtcacgatggcggtcaccgcttcgctcctcgtgctgctggccatcgccgtcctgctcatccgcggcctcgggatcggctga

SEQ ID NO: 6626 - DNA, 588 bp, Methylobacterium sp.
ttgcaggacgcgtcggccacccccgagatccaggccgtggacgccccgatcgcggcggatgaacccgctcaagcacctgaccattcgcctgaccactccgccgaggccgccccgaccggcgccgagacggtggacgcggccatgaccggcgcggcgcccggtggggcgtccgaaatcgcggccgagaccgcgcccgacggcgcggtggacgtcccgtccgaccagggggccgcagccgccgcgacgacgtccgaagccgagttcgaagccgaatccggacccgacacggtgatcgacatcgcccctccgccggtgccgggcgcgggtccgggactcgccgcgaccgccaaccgaatcagcttcacccccgaccgcctcgacgtcgtcgagatcggctcgatcatcgcccgctacgtgcgcggcgagggcgaggcggccgtcgcgcatctgcgggcgctctcgggcgcccgctcgccggccgacgtcattcgcctgcaggtcggcgaggtccagcgggccgccgacgcgtccctgacctgctgggtcacggtggtcgggcaggcgagccgggtcgtcgcgtaccgctga

SEQ ID NO: 6627 - DNA, 603 bp, Methylobacterium sp.
atgagcgcgcagcattacctcccgaaacttcgcgcgcttcgcatccccgccgacgccagaaatagcgagggcacggtcgcttggtgcgattggtgcgagactgtgcacagccacagcgccggaggcggcccccgcgtcgcacactgccacaggaaggaatcccctttcaccgcgttcggctatgacctcgcacccgtcggctgggcgcccgatgcaggcgcggcagttcctgcgggccttcttgtcggccggcgccgcctctcggacaccctcgatgctgccatcccggggcttcgtaccgccttcgagcggtgcgtcgtcgggcggaagcggatcggcctagctcgcatcagcgtgttcggccgtcagtggtcgatcgaggcggacgtgaccaagggcgagccggcctcgggctggactaccggcgtcggtctcctcggcctgctctcggcactctacggcgtccgccgcggcgtggccggcgtccgactcttggaagcgatcaccggcgaggaatttgacgcgtcggcacggctcacgatcgccaaggcgatcgacgcctctgcagcgcgcgccgcaggatccccgggggcccgcgcatga

SEQ ID NO: 6628 - DNA, 576 bp, Methylobacterium sp.
ttggccttctgctgggcgcacgtgcgccgccggttctacgaactggccaaggctggcccggcgccgatcgcgaccgaggtgctcgcccgcatcgccgaactctatcggatcgagggcgagatccgcgggcgctcccccgacgagcggagggccgtgcgtcaggaccgcagccggccggtcgtggcggcgctggagccgtggctcaccaccaagctcgggctgatcagccagaagagcaagctcgccgaggcgatccgctacgcgctgagtcgctgggccggcctgtctctcttcctcgacgacggccgcgtcgagatcgacaacaacacggtcgagcgggcgatccggccgctggccctgacgcggaagaacgcgctgtttgccggctcggacggtgggaccgggcattgggctgtcgtcgcctcgctggtcgagacctgcaagctgaacggggtcgagccgcaggcctacctgaccgacgtcatcacccgcatcgtcgccggacatccgcagagcaatatcgacgacctgctgccctgggcctacgccccgcagcccctcagggtcgtggcctga

SEQ ID NO: 6629 - DNA, 1971 bp, Methylobacterium sp.
atggcccgccccgacctccgcgccctcacggatgacggcctgatccagctcgccaatgccgggctggtgaagcgggcgctgcgcgaggttgccgccggccagggaccagaactcgcggaggccggggacggcaccgtcgaggcgcgcttcgccgacggcacgatcacgaggctcggccccggccggcctcccggcgaggccagctgcacctgtccggcgagcgggatgtgccggcaccgggtcgccctcgtcgtcgcctaccgggccgccccggtcgcggacgggctggccgatggggccgccgagggtgcggcggtgccggccgcggcgccggtcgcctgggatcccggcaccctcgacggcgccgccctcgaggcggggctcggcggcgccgcggcggcggagctgcggcgcctcctggcgggcgggatcacggtcgggctggagcggggcgccgtcccggccgcgcggctcccgaccgcgaccgtgcgcttcctcgtgcccgacgccgtcggctacgcccgctgcgactgcgcggccgggggcggctgcgcccacgtcgccctggcgatccgcgccttccgggagtccgcgggcgccgccgagatccgcctgggcggcgcggccccggccggagcggaggcgaagccggtagggacggcagagacggacctcgcggaggccgccgaccgggtggtcgccggcctgctggaggccggggtcgtgtccgggccggaggcccacgacgcggccctcgtccggctccggcgggcggccgagaggcggggcgccacgcagctcctgctggcggaggcggatctcgacgggcaggtcgcggcctatgccgggcgccacgccgcctacgacgcggccgtcgtcctggcgctcgccaccgaacttctcggccgcgtccggggcggggaggccgccctcggcctcggccagccctacgagaccgccatgggcaagacgcgcctcgtctccctgggcgcccggctcctcgcccgcgggcgcggcgccaccgcccgagtggccctggccgacaccgataccggcgcgctcctggcgctggagcgcgcgttcgcgccgggcgaggccgaggcggatatcgcggccggcctgcccgggcgcctcctgagcccgggcctgtccgtctcgggcaccggccagggccagatcctgaccagcgtcgcgcggcgccgggccgacgggctcctcgccctcggccagggcacacggggccgcacggcgctgctgccgcgggacgccctggtggccctgccggcccccctggcggcgcgggacgtcccgtcgatcctgcgccgcctcgccgaccggccgcccgtgttcctgcgcccgcgcgaccggctggaggccttccacgtcttccccgtcgaggcggttctgggacaggcctgggcgcccggcgcccagacgtggcaggccgccgtcgcgctgccgggggcgggcggcacgctgcatctcgcccgcgcctacgaccccgccgcgccgcacgccctggacgccctcgcgggcgcctgcgcggggcgctggggacccgtgcggcaggtcgccggcccggtgcggatcgaggacggcaccctggtctgcgatccctggtcggtgtcggtcgaccggctcgtcgtgcccgacctcgccgccccggacgatgccggccacccgatccagccggcgccagacctggggccggccacgctcctcgacgaggcggccgcgctgctggcgaacgccctccatgcggggcggcgggccttcgcggccagcgcccgcgccggcggcgccgacctggtcgcacgcctcgccgcgaccggctatccggccaccgcggcgcggctctccgccttcctctccgccaccctggcggctccgggcgcgcagtccgagcccttcgcccgggccgccctctgggtcgccgccatgcgcgacgatcccggaccggaagaggcctga

SEQ ID NO: 6630 - DNA, 357 bp, Methylobacterium sp.
atggccgtgaggcggatcgtcaccaacatccgggcgacggaggtcgaggcggcgcggtccttctacgcggacgtgctcggcctggaggtggtcatggatcacggctggatcctgaccttcgcggcccccggcatatcggcgacgccgcagatcagcgtggccagcgcgggcggctcgggcacgccggttcccgacatctcggtcgaggtcgacgacttggcggacgtcctcgcccgcgtgaggcgggccggcctgcccgtgctgtacggcccggcccgggagccctggggcgtggagcggttctacgtccgcgacccgttcgaccggctggtcaacatcgtcgcccatctcgcgtga

SEQ ID NO: 6631 - DNA, 1035 bp, Methylobacterium sp.
gtgcccggcaccaccctgctggcgctgctgatccacctcgacgggtcgggcgcggtgaccttcctgatcaccatcccggcgatgctgccgctctacgaccgcgtcggcatcgaccggcgcgtcctggcctgcgccgcctcgatggcggcgggcgtgaacttcctaccctggaccgggccgatgatccgcgcctccgccgccctgaagctgccgatccccgagatcttctcgcccctcgtgccggtacaggcggtcgggctcgtcttcatcttcgccgcctcgtactggctcggcctgcgggaggagcgccgtctggccctcgtccccggggcggcggggtccgcggggtccgcgcccggcccggccacgaccgcccggaccctgagcgacgcggagcgggccctgcgccgccccgaccgcttctggatcaacatcgtcctcacggccgcggtcctcgggacgatggtgttcctggccgagaaggtgccgccggcgctgatgttcatgctcggcacggcgctcgcgctggtcatcaactacccgcaggtcgacgcccagcggcagcgcgtcgacgcgcatgccagggccgcgatcctgatggcctcgatcctcctcgccgccggcgtgttcaccgggatcatgcagggcaccgggatgctcagggccatggcccagacggccgtcaccttcgtgcctcccgagatggggcgccacatcccgttcgggctcggcctcgtgtcgatgcccctgtcgatgctgttcgacccggactcgttctacttcggcgtcctgccggttgtggcggaggtggcccaccagctcggcgtcccgccggtgcaggtcgcccagggggcgctgctcggccagatgacgacgggcttccccgtcagcccgctgacgcccgcgaccttcctggtctgcggcctgaccgggatcgacctcgccgaccaccagagattcaccttcccgttcctgctggcggcctcggtggtgatgaccctcgcctgcgtcgtcctcggcgtcttccccatctga

SEQ ID NO: 6632 - DNA, 1338 bp, Methylobacterium sp.
atgagaaccgtccgcctcggcgccggcgccggctatgccggggaccgcatcgagcccgccgtcgaactcgccgagcgcggcgacctcgactacctcgtgttcgagtgcctcgccgagcgcaccatcgcgctggcgcagcaggcgaagctgcgcgaccccgagggcggctacgatccgctgctggaggcgcgcctgcgggccgtgctcgggccgtgccgggcccgcggcatccgcatcgtcaccaacatgggcgcggccaacccggtcgccgccgcccggaaggccggggcgctcgcgcgggagctgggcctcgccggcctgcggatcgccgcggtgaccggcgacgacctgctcgacgcggtgcgggcgggcgacttcgtcctggaggagagcggcgagccggtcgccagcctcggcaaccgcgtcgtctcggcgaacgcctatctcggcgcggcgccgatcgtggccgccctcgcggacggagccgacgtggtcatcaccggccgcgtcggcgatccggccctgttcctggcccccctggtgcacgctttcggctgggcgatggacgactgggagcgcctgggccgcggcaccctcgcgggccacctcctcgaatgcgccggccagatcaccggcggctacttcgccgatccgggctgcaaggacgtaccggacctcgcgcgcctcggcttccccatcgggatcgtggccgaggacggcacggtcgagatcacgaaggtcgcgggctcgggcggccggatcagcctcgccacctgcaaggagcagctgctctacgaggtgcacgacccggcgcgctacatccagccggacgtggtcggcgacttctccgatgtcgagatggagcaggtcggccccgaccgcgtccggctgcgcggcgcgacgggcgcgccggcgacgggcctcctcaaggtctcggtcgggtacgtggactcctatatcggcgaggggcagatctcctacgccgggcccggcgccctggcccgcggccggctcgccctgtcggtggtgcgcgagcgcctcgccctcaccggcgtggcgacgaccgagctgcgctgcgacctgatcggcgtcgacgcgctccacggcgcggcgctgtcgggcgggcgggagccctacgaggtccgcctgcgggtcgccgggcggaccgagacccacgccgaggccgtgcggatcggcaacgaggtcgagacgctctacaccaacggcccggccggcggcggcggcgcctggaaatcggcccgcgaggtggtggcggtgcagtcggtcctcgtcccggccgccctcgcccggccgcgcgtgcacgtcgtcgaagcctga

SEQ ID NO: 6633 - DNA, 345 bp, Methylobacterium sp.
atgaagctgcgcgcgctcgcccatgcccgcacgggcgacaagggcaacacgtcgaacatcgcgctgatcgcctacgacgcggccgattacgagcacctcgcggcgcacgtcacggccgagcgggtgcgggcgcatttccgcgggatcgtgaccggcgacgtgacccgctacgcgctgcccaagctcggggcgctgaacttcgtgctcacgggcgcgctcggcggcggcgtcacccgctccctggccctcgacgcgcacggcaagggcctcggcgccgcgctcctcgatctggacatcccggaccgcagcgccggccgagccgcgcggggaagcccgagacggtga

SEQ ID NO: 6634 - DNA, 420 bp, Methylobacterium sp.
atgctgttccacatggtctccggcgggccgcagccggtcgcccccttcagccacgcggtcgaggtcgacggcttcgtcttcgtcacgggtcagatgcccgacacgccggacaggcccggcgtcctgcccgacgggatcgaggcgcagacccgcaacgtgatggccaatctcgcgacggtcctggccggcctcggcctgggcctcgagaacgtcgtcgtcgcgcgcgcgttcctgaccgagttcaagcgcgactacgccgccttcaacgccacctacaaatcctacttcccgtccgaccggctgccggcccggacctgcgtgggcacgacggggctcgcctacgacgccctggtcgagatcgacctgatcgcccaccgcggcggcgcgacctcgccgtcgtcggccgcgcgatcgggctga

SEQ ID NO: 6635 - DNA, 261 bp, Methylobacterium sp.
ggcgcggcgaccggcacggtgggcggcatcctgggtgtcgacgaccgcccgcggttccgcagctacgtccgcgaccgcggcgtgcgctcctacagctggggcggcccggtccgggtcggcaccgtgctgccggaggacagcgtcacctactacgacgtgcccaccgagtaccgggtgcgtccgggctaccgctacaccatcgtgaacgaccagcccgtcctggtcgatcgcggccaccgcatcgtcgaggtcatcgactga

SEQ ID NO: 6636 - DNA, 159 bp, Methylobacterium sp.
atgaggatcattggcgcgcgcgtcatggccgtcgccgtcatgttgctggtcatggcggtatggcgcgggcttgagcaactcggagtcgcctcggtcgtcgagggctgcctcgtcgccgccattgccgcgaccgccgccacggccctcgctcgttggtga

SEQ ID NO: 6637 - DNA, 906 bp, Methylobacterium sp.
gtgacgcgactccaggcggccaccctcgccacagccttcgcctcagccctcgccgcaaccctcctggcgccgtcatcggcccgcgcgatcgactgccgcaaggcggccagcccgctcgagcgcatgatctgcgccgacccggcgctccggaaggcggacgccgcgctgggtgcggcctattccggcctcctgcacagcacggacgacgccgagatccgcgcgatgctggtcgccagccagaagcgctgggtggcggcccgggacacgtggctcggcgacctggacgcggccgacgcgcgcgccgtcgtgctgaaggcgatccgggcacggaccgaggacctgtccggccgctcgaagagcgatccggcccgaccgcactggatcgcggcggcgctgcggcagcgggccttcgcggcgcggttcaccggcggccccttcgcggggttcgacacggcttgctatttcctgcccgtcgggcaggaccgggtctacgggtgcttcggcagccggcgctaccagaacggcgaccgggtctgcacgctgtccgacgactgggcgagcggccacacctccgagacgcgcacggtcgcgcgggtcgtcgacggcgccgcgcgcacggtcgcgacctgcacgatcggcggtagcgacgacgcggaatgcccgggtcccgacaacgccgacggccgctgggcgcggcctgccgccccggccgccgccggcgcggcggcacccgcgggccctcggcccgtcctcgacgtcgagctggccccggacgccgatgccgagacctggctctcgacctgcctgaccgaccccgcctatccgccgcccgacccggttccggcggcccggacggccccgggatcgagcccgcccgcgcctgcgggcgccccgagcagccggtga

SEQ ID NO: 6638 - DNA, 1227 bp, Methylobacterium sp.
atgcgcgccgccgctcccgagacgccctgcctcgccttcctggaggccctgccggtggcggagcgctggcagcgcgcccgggactggatcgcccgcgcgccccagcccttcttcgcgcagctgcgcgcgcggcggaccgccctggattgcggcgcggccatcctcgtcgccggccgcgccgaggtcgaggagatcctgtccctgccgcaggtcttctccgtcgcgctctacaagcccaagatgggcgagttcatgctggcgctcgacggcacggaggtgaattaccgcgacaaggcggtcatgcgcgccgtgctgtcctggcgcgacctcccggcgatccgcgatctggcgggcgccgagaccgacgcggccctcgacgcgggtctcgaccagggcggcggatccatcgacgtcgtggcgtcggtctcgcgccgcgtcccgctgcggatcgtgcagcgcttcttcgggttcgcggcgcccgatgccgacctgctgcgctggtcgtacgcgaaccagttcgaccagttcaacaacctccccttcgacgagcgcccggacgccgacgcgatccacgcggcggcggatctggcgcgccaggagatgcgggcggccttcgccaggatcatcccggcgcgcgtcgcggcgatcgaggccggcgccgacctgcccgacgacgtcctcacccggctgctccggctgcacctgccggcggcgaccggcttcggcatggaccgcgtcgtcatcaacgtcggcggcctgctgatcggggccatcgagaccacgtcggaggccgtggtgcacgccctcgcggagctcctcggccggccgcagatcctcgcggcggcccgcgcggccgcccggaccggacccgccgccttcgacggctacgtgtgggaggcgctgcgcttcgcgccgatcgtcgccttcatgttccgccaggcggagaccgaccacgtgctcggccggggcagcccggccgagagcgggatcgccaagggccgggtcgtcctgcccctcagcctgtcggcgatgttcgacgcgaccggcgtgcccgacccggaccgcttcgacccggcccgcccggagcagacctatctccatttcggccggggccatcacgagtgcctcggccgctacgtggcgggcgcgatggtcccggagatcgttcgccgcatcctcctgcgcgacgccgtgcgggccgagggcgcggtcgaggacggcgtgccc

SEQ ID NO: 6639 - DNA, 99 bp, Methylobacterium sp.
cagacggcggccggcacgcggcaggtcgaggccgcctccgccaacctcaccgagctcgcccaggccctcatggccctggccgagcgataccggcactga

SEQ ID NO: 6640 - DNA, 99 bp, Methylobacterium sp.
cagacggcggccggcacgcggcaggtcgaggccgcctccgccaacctcaccgaactcgcccaggccctcatggccctggccgaacggtaccggcactga

SEQ ID NO: 6641 - DNA, 273 bp, Methylobacterium sp.
gtgcttggccagagccgcacggagttcgtgcagatagatgccgggctgcgcctcgtagagggagacgatcaggtcggctcgcgcctcgatctggtgcgagcgctgatcgccgcccatcggcttgggcgcgacgtggccctcacgggcgaaacgctcacaccaccgactggcgctcgccaggctgaccccaaagcattcggcagctttgtgccgggaggcgccggccgcgacggcaccgaccacgcgctgacgcagatcgacggacagggctga

SEQ ID NO: 6642 - DNA, 267 bp, Methylobacterium sp.
atggcgaaggaacgcccgacgttgaccagcctgtcggaccggctggcccgaaaggtctcgactcctgccgtggagccggttgggccggtgctcgaggcccagccgaagaccagcaaggccgatgagcgagtccaaatcatcgtgcgaatgacgccggccgaacggaaggcgctcaggcggattgcgctggaccaggacaccacagcccaggcgcttgccgaagaagccattcgcgacgtgctgcgccgacatggagctttcgagtaa

SEQ ID NO: 6643 - DNA, 375 bp, Methylobacterium sp.
atgaagctcgcgatgctggcctgcctcgccgccctgtgcctcaccgggccgatcgcgcatgccgcaccgggcgagacgaccaggccggcgccggcggcgaacggcacccacccgcccgagacggcggccccgcatccggccactgcgcccgcacccggcgcggcgcccgcgcaggccgccccgcgcgcggccaacagtgcccgcgcggagcgccggcggcgctcctacgcggcctgcaaccgcgcctcgcaccagcgcggattgcgcggcggcaagcgccggcgcttcctgatccggtgccggctcggctacgagcggacccgggtccccggcgggcagcccgccgcggcggcgccggcacagccgggccggaag

SEQ ID NO: 6644 - DNA, 159 bp, Methylobacterium sp.
atgcaggacgagagaaagaccgccgccttccaggtgcgcatgcgaccatcggtgaaggctgctgctgagaaggcggccgcggaggaaagccggtctctggcctccctcatggagtaccttctgatcgagcacctgaaggcgaagggctatctgaaatga

SEQ ID NO: 6645 - DNA, 216 bp, Methylobacterium sp.
gtgacgttcctcatggcctacatcgcccagacaggaggaacgctcatgcgaattcgctatctgctgccgctcgtcggcttgctcgcgctcacggcctgcaaggacgagaagaaggccgaggctcccccgccgccaccgcctcccgccagcacggcgccggcgaaccctgcgcctccggccacgacgacgaatccggctcccgccaacaagccgtag

SEQ ID NO: 6646 - DNA, 171 bp, Methylobacterium sp.
atgcgaattcgctatctgctgccgctcgtcggcttgctcgcgctcacggcctgcaaggacgagaagaaggccgaggctcccccgccgccaccgcctcccgccagcacggcgccggcgaaccctgcgcctccggccacgacgacgaatccggctcccgccaacaagccgtag

SEQ ID NO: 6647 - DNA, 1371 bp, Methylobacterium sp.
atggcatccttccaggattttcaggacggctacgagcggacctgggcgtcgctccagatccggccggagaagctcgcgaccgtgcgcaagctcgcgcagcagctcgccgccggcaagccgcgctaccaggagatcgaggcgcgcaccggcgtgccctggtggttcatcgggctctgccactaccgggaatcgacgttcgatttcgacacgtatctcggcaacggacagaagctcggacggcgcaccacgatcgtcccgaaggggcgcgggccgttcacggggccgcaggccttcgtcgaaggagcggtcgacgcgctgcgcctccagggcctggtcgggctcggcgactggagcgtcgcgcgggccctctaccggctcgagggcttcaacggctacggctaccacggccggggcgtgaactcgccgtatctctggggcggatcgacggcctacgggccgccgggcgcgcgcggcggcaagttcgtgcgcgaccacgtgttcgacccgaacgtggtcgacacgcagatcggcaccgcagtgatcctgcggagcctcatcgacctcgacgcgacggtcgcgctcgcggcgccgcgcgccgtcgaggcggccgtgtcccgcgagcccgatgacgaactcgccgacagcacgctctgggtccagcaatcgctcaatcgcctcggcgcgacgccgcccctcgtcgaggacggccggaacgggccgcagaccatgacggccgtcgcgacgttccaggcgcagtgcggtctggacgataccggcctcgcggacgcgcgcacgatcgccgccatccaggaggcgctgcggccggcggcgccggaccacgcggtgctgacgcggatccaggacctggagcgacagctcgccgcgagggcggtcaccacgatgcagcccgccccgatgcaacctgcctcgatgcccccggtggtgatcgcgccggccacgcccgcaccggccgcgccgctcgctgacgtcgcggcgcggctcgacgagctcctccaggccctgcgccgacagatcgacggtgcgcgcctcccgaccgcgccgatcttgcccagcccgcccacggcacgtcccgacggcgcggtcctcggaccggtcaacggcgcgctcgggcagacgatcggacagctgctctccggcaggaagtcggcgatcggcatcatcggcgccgtcgccacgcagatcctgtcccaggtgccgctcaacaccggtctcgggcaggtgctcgcacagctcacgcccgccttcgggctgagcccctacacgatgccgatcttcatcgggctgacggcgtggggggcgctcgggaagttcgagaagtggaacgcacgcgcggggcaggcgaccccgtag

SEQ ID NO: 6648 - DNA, 1371 bp, Methylobacterium sp.; identical to SEQ ID NO: 6647

SEQ ID NO: 6649 - DNA, 246 bp, Methylobacterium sp.
atgttcgagcagatggtcgaggcgccgcggaccgttcggcggcttgaggtcatcaccaccgcgagcggccggcgacgctggtcgcaggctgagcgcagacggatccttgctgaggccatggcaccgggtgccgtcgtgttggttgtcgcgcgccggtacgggatgagcccgcagcacctgtttacctggctgcgcgaggcgcgtcagtggaagggcagctgccttcgtaccggttctcctcgatga

SEQ ID NO: 6650 - DNA, 150 bp, Methylobacterium sp.
gtgcgtgccgaggccgcggcggccaacgagaccgagacgccgcgcgagaagctcggccagatggaggacaaggcgcggtccggtaccgatctcggcgaggcgatcgaccgcgccaccgccgccgtcggccaggacgacgggaagcgctga

SEQ ID NO: 6651 - DNA, 450 bp, Methylobacterium sp.
atgaccatttcagccagggacgttcatctgcgcaggatggagaaccccgaatacgccaaggcgtacaccgaggctggaccgcgcatggagctggcgttccagatcgcggaggctcgctcgcgcgccagcctgaaccaggaggagctggcagcagcgatcggctcgtcgcaaacccaggtgtcgcgctgggagcgcggtcgctctgccccgacgggtgactatctccgacgggtcgcggccgcgaccgggtcgaggctcatgttcgtgccggaagaggtcgcggccgccgtcgagacgattatcgtcaagaagacggtcatcatcgagaagcggcccgcacgcggaactgccgcccgcagcggccggacggagcaagccaaggcagccaaagccgccaaggcgccgacgaagaagcgcgctccgcacctcgcgctggttaccggctcgtag

SEQ ID NO: 6652 - DNA, 441 bp, Methylobacterium sp.
atggcgccgaacccgaaatccgcaaaacgcgaccgccgcaagaaggcaccggagaccccgactgcccccgaggcggctgcgccggccgctgccgcaacggcgtcgggctggaccgtggagtacctcgacgagaacgtcgtggccgagtccgaggcgtggcccttgccggtgcaggcgaacctgcagcgcatcatcgaccggatcgaggcggtgggtctgctcaagatcccgagcgactaccgcagtcgggtcagggggaagatctgggagctgcgccccgacgcggacggcgtcgagggccgggccttctatgttgctgtgacgggcaagcgtgtcgtgatcgtgctgtgcaagatcaagaaacggaggaacacccctccggactggatcgacctcgccgagaagcgcgccaagaacttagacgcgggagacgacaaatga

SEQ ID NO: 6653 - DNA, 1104 bp, Methylobacterium sp.
ttgttcggcgtcagcgtcgacgaaagcgtgcgctccgccctgctcggcggcgcgcgcgtggtcttcaacctgtcgggcgggaaagacagtggcggcctgagccacgcggccaacgcctacctcgacgagatcgggcacccgcgcgatcggcgcctcgccatccatgccgatctcggccgggcggagtggcagtccaccccggcgaccgtcgaggccacggcggcgcacctgggcctgccgctggtcgtcgtgcgccggaacgccggtgacctggtcgcccgctgggagaagcggttctcgaacgccttagagcgctacgagggcctggagacctacaacctgatcggcccgtggtcgcaggccaacaagcggttctgcacttccgagctgaaggcccaggtcatcggcccgcacctcgcccgcctgttccacggcgagaccatcgtgcaggtgatcggcatccgccgcgacgagtcccgcgatcgggccaagacggcgatctccagcctcgacacccggttcgccaagccgggcaaccggcacggcaccaccatgatgatgtggaacccgggcgtgctgtggtcgcgcgacgaggtgctggactgccacgcgcggcacgcgatcccgctgcacgaagcctataccgtctatggctcgacgcgtctgagctgcgcgttctgcgtcctggcctcgatccgggaccttgaggcggccgcgagcgcggcgggcaatcgcgacctctacctgcacctggtcaagatggaagcgacctcgaccttcagcttccagcccgaccgctggctggccgacgtcgcaccctcgctcctgccggcctcgctccgtgctgcagtgcagcaatcgaagctcgacgcggccgcgcgccgggacatcgaggaagccatgccggcgggcctgcggtacgtgaaccagtggcccccgcgggtgcccacgcccgaggaggcacgcgccatccaggcggcccgcacagccatcctggcgcggcacggcctgcgcaacctgtacgatacaggcgagaaggtgcgggaccgcttcgccgaactgatcgccaagcgcgatgccaaggccgcggccgccgcgcaatag

SEQ ID NO: 6654 - DNA, 753 bp, Methylobacterium sp.
atgacgttcacggcacacaacatccgcctcgcggacgggtctgagaccttgcccgaggcgggctggctgatcgccgacagtccctggacccaggcggctctgcgctcgctccggctgttctacggacacaggctggccggccggtcgatcgtcgatctgggctgcctcgagggcggttacacgctcgaattcgcccgcgccgggatgcgcgccaccggtgtcgaggtgcgccgctccaatttcgagaactgcctgcgggtcaaggatggggcaggcgtccccgacctcgccttcgtcaatgacgacgtgtggaacctggcggcccacggccccttcgatgccgccttctgctgcggactgctgtaccacctcgacaggccggccgccttcatccgcctcatggccgaatgcgtccgcgacgtggtcatcctgcacacacatttcgcgaccgaaaccaacgaggccctgttccagctctcgccgcccgctgagaatgaaggtctgccaggtcgctggatgcacgagcacgatctcgacgacacgagccagctcgaggcgcacaaatggacctcgtggagcaacaagcgctccttctggcccaccaagccggccctgatccagcttctcaaggagtgcggcttcgacatggtctacgagcagtacgacatgctgggacacgacatccgcggctcgatggagagcggctactaccaccagcagggccgcagtatgttcgtggcgatgcggacctga

SEQ ID NO: 6655 - DNA, 711 bp, Methylobacterium sp.
atgttcgcgacgagcctcgccctgtgggtgatagccatcctgcttctactcgcttggctgcatctgcaggagcgggtcaccgagcagtgtcgccgcgcgatccgaccgcagatcgaacgcctgatcatcgagaaccggtggatggagcaccacgcgcgcggagcggccgcgttcgaggcgctctgggaccgggaactcgtcaggctgcaccgcgcccatatctcgcgcccgctcagcgccgtcgtccgattccgcggcttcaggcgtctggtcagagcggaattcgcatcgatcctgccggccgaggtcgcgtcctggaccttcgtcgaccgcgcgagcccctcgcaggcgcactacgaggcgttgatgctgcggtgcctgaagtcggccggctggcgcctggattaccaggatcaggaccacttcgtgctcctccgggcccgaacgcgcgtcgtcgtctgcctgcactggacggaacgtgacgtcgcgtgtctcccgatctcggacgtcgcggcggcggcggagcgcgccgggtcgaccacggcgtgcgtgatgaccaatggccggttcagcggcgcggcgcgcgccatggcggaggagcagaacgtcctggcgctgcactgctcgcagatcgacctgctgctgccccgggacaagtcgactgtcgcgccccgcacggtccgcgaaaccggttttcggctcgccgcctga

SEQ ID NO: 6656 - DNA, 1200 bp, Methylobacterium sp.
atggcggccgccgtgttcggcgccgctgccctcaccgccctgcccgcctccgcgcagtacgcggacggcggcatcaagatcggcatcctgaccgacatgtccggcggctactcggatctggccggccgcggctcggtcacggccgcgcagctcgcggtcgaggatttcgggcgcccgatcaacggtcggaaggtcgagctcgtcttcgccgatcaccagaacaaggcggacatcgcctcgtcgatcgcgcgccggtggttcgataccgagggcgtcgacgcgatcttcgacaccaactcctcggtcgccgggctggcggtgcgcgaggtcgcgcgcagcaagggcaagatcgacatcaactccggcgccggctccatggcgctgaccaacgccgcgtgctcgccgaccggtgcccactggtcgtgggatacccactcgctcgcggccggcaccgccgcggcgctggcggatgatccgaagaacacgtggttcttcatcacggccgactacaccttcgggcacgatctggaggcgcaggtcacccgcgtcgtgaaggccaagggcggcacggtgctcgggtcggtcaagcacccgttccccaatccggatttctcatcctacctgctgcaggcacaggcgtcgggcgcgaagatcatcggcatggccaacgccggtgccgacacgatcaacaccatcaagcaggcgagcgagttcggcatcctgcagggtggccagaggctgggcgggctcaacatcttcctgaccgacatctactccgtcggattgccggcggcgcagggcatgatcctgacgacgggcttctactgggacatggacgaccagacgcgcgccttcgcgcggcgcttcggcgagcggatgggcgggcggatgccaaccatggtccaggccggcgactactcggcggtgctccacttcctgaaggcggccgaagccgccggcacggatgacggcctgaaggtgatggccaagatgcgcgagctgccgatccaggatttcttcgcccgcaacgccacgctgcgcccggacggccgaatggtccacgacatgtacctcgcccaggtgaagtccccggcggaatcgacggggccctgggacttctacaagatcctgaagacgatcccgggggaccaggcattccagccgctctccgagagcacgtgcaagctggtgaagggctga

SEQ ID NO: 6657 - DNA, 297 bp, Methylobacterium sp.
atgccctacatgatcgagaccttcgataaggccgggagcctggacgtccgcagggcgaaccgcgcggagcatctcgtctacctcgacaagatcaaggaccggcttctggcctgcggcgcgaagctgaacgacgacgggagcgacgccggcggcggcctctacgtcgtcgacgtcgagacccgcgcggaggccgaggcgctcatccacgcggacccgttctacaaggtcgggctcttcgagcgcgtcgagatccggcgctggcgcaaggcctacctggacggccgcagctatctctga

SEQ ID NO: 6658 - DNA, 807 bp, Methylobacterium sp.
atgaccgagcggcagacgaaccccgaggcgatcgtccggcgcgcgagccacgccggacggcgcgtcctcgtcacgggggccggccgcgggatcggccgggcgatcgcggaggggttcggcgcgcggggcgccctggtgggcgtggccgacgtgaacgcggacgacgtcgcggcgaccgtcgcggcgatcgagggcggaggcggtcgcgcgctgccgctgcggctcgacgtcgccgactacgcggcggtcgaggcggccctgtcggaggccgccgccacgatgggcggcgcgttcgacacggtggtcaacaacgccggcatctcgcccaagcacgacggggcggcccaccgggtctgggagatggacccggcggagtggaaccgcgtcgtcgcggtcaacctgacggggtcgttcaacaccgtccgcgcgctggcgcccgcgatgtgcgcggccggacgcggctggatcgtcaacatgtcgtcggtggcgggcaagacccactcgccgatcgtcgcctgccactacgcggcctcgaaggccgggctgatcgggctcaccaagcacctcgcagccgagctcggtccgttcggcatccgcgtcaacgcgatcgcgccggggcggatcgagaccccgatggtccgggcggtgggccgcgccgtcaacgacgagcaggtgcgcctgacccccatgggtcggctcggcgcccccgaggaagtcgccgatctcgccctctacctgacctccgccgaggccagcttcgtcaccggccagaccgtcgacgtcgccggcggcctctacatgacgtga

SEQ ID NO: 6659 - DNA, 1830 bp, Methylobacterium sp.
atgaccgatattccgctcgcttcagcaccgtccgcggccccgacagccgcaccgtccgccgcatcgtccgccttcccgcgccggggcgcggcggcgctggcgctcgtcctcgcggcgctgttggcggtgccggtcgcggtcggcaacccgttcatctaccacgtcttcatcacgatctgcgtcttcgccgcgctctcgaccgcctggaacatcgtcggcggctacgccggccagctctccctgggccacggcatcttctacggcctcggcgcctattgcgggatgctgctcgtcggcgccgggatcagcccgtggatcggcatggtggccggcgccgccctcgccgtgctggtggcgctggcgatcagctacccgtgcttccggctgcacgggccgttcttctcgctggcgaccatcgccttcctcgaagtcttccgcgtcctggcactgcatttccgggacctgaccggcggcgccaccggtctgatgatcccgctgaagttcggctggacgtggatggtgttccgggatcgctggccgccgctggccatcgccttcgggctcctcctgctgaccctggcggtcgcgtggtggatgcgcagccaccggatcggcttctacctcgtcgccacccgcgagcgggaatcggccgcgcgcgccgcgggcgtgcgcaccgtgcgggtgcggctcgtcgccgtggcggtgtcgggggcgctcaccgcgatggtcggcaccttccacgccatgtacctgaccttcatcgagccggcggcgatgttctcgctgaccctgtcgatccagatcgcgatgttcgcgctgatcggcggactcggcacggtgttcgggccgctcttcggcgcgctgctcctcgtgccgatcaccgagctggcccgcggctggctcggcgccaaggccctggggctccacggcctcgtctacggcctcgttctggtgctcgtcgtcctgttcctgcccaacgggctgatgggcctcgtgtcccgcttcgcgcgggccggcgcgggcggccgcggcgcgcaggcggcgtcggttccggccgttccgcgggccccggagcggccggcggtcggcgcggacctggtccgggtcgaggggctgcagaagcgcttcggcggccttcacgtcaccaacgatgtcggcttcacgctccgggagggcgagatcctcggcctgatcggcccgaacggggcgggcaagaccaccgtcttcaacatgatctcgggcttcctcaagcccgatgccggcacggtgagcgtccgcgcgccggacgggacgtggcaccggccgggccggccggcggatttcgcgacgctcggcgtcggccgcaccttccagatcgtgcagcccttcgcggccatgaccgtcgaggagaacatcatggtcggcgcgttccaccggcacagcgacgtccgcgaagcccgggcggtcgcgcgcgagaccgccgagcggatgggcctcgcgccctggctcgggagcgaggcgcgcgggctcaccatcgggggcctcaagcgtctcgaggtcgcccgcgtgatggcgatgcgcccgcgcgtgctgctgctcgacgaggtcatggccggcatcaaccagaccgacgtgcgccgcgccatcgacctgatgctgtcgatccgcgacaccggcgtcagcatcatcgcgatcgagcacgtcatgcaggcggtgatggcgctctccgaccgggtgatcgtcttgagttccgggcagatcatcgcccagggcagcccgcaggacgtggtgcgcgaccccgccgtgatcgaggcgtatctcggcaaggagttcgcccatgctcacgcttga

SEQ ID NO: 6660 - DNA, 1011 bp, Methylobacterium sp.
atgggcatgcgagccgtgatcgccgacggacagggcggtcccgaggtcctccggatcgtcgagcgtccacggccggagccgggccggggccaagtgctcgtgcgcgtcgaggccgcgggcatcaaccggccggacgtgatgcagcgggagggccgctacccgccgccgcccggcgcctcggacgtgctcgggctcgaacttgccgggatcgtcgaggcgctcgggccgggcgcggggcgcttccggaccggggaccgggtgatggcgctggttcatagcggcgcctacgccgagcgggccgtcgtcgacgaggcggtcgcgttgcccgtgccggagggcctcccggcggtcgaggcgggggcgatccccgagacctacttcaccgtctggagcaacgtcttcgagcgcgcccggctgcaggcgggcgagagcctcctgatccacggcggctcctcgggcatcggcaccacggcgatcctgctggcgaaggcccggggcgcccgggtgatcgtcaccgcgggctcgcccgagaaatgcgcggcctgcctggcgctcggcgcggacaccgccatcgattaccggcgggaggatttcgtcgccgcggccaaggccgccaccggcgggagcgggcccgacgtgatcctcgacatggtcggcggcccctacatcgcccgcaacctcgacgccgtggcggtcgacgggcgcatcgcgcagatcgccttccagcagggctcgcgggtggcggagatcgacttccagccgctgctgatgaagcgggtgacgctcacgggctcgacgctgcgcgcccggccggtggccctgaaggcgcgcctcgccgaggccctcgccgagcacgtcctgccgctgctcgcggcgggccgggcgcggccgccgatcgattccgtgttcccgttcgagcgggtcgcggaggcccatgcccgcatggatgcgggccagcatatcgggaagatcgtcctgtcgatgggcgacgccgcgcaggggagccgctga

SEQ ID NO: 6661 - DNA, 363 bp, Methylobacterium sp.
atgacttacgtgagcgggttcgtcacgccggttcccgacgcgaaccgggaggcctatgtcgcgtcggccggggcggcctgggcgcttttccgggaatacggcgcgctccaccagatggaggcctggggcgacaacgttccggagggcgagcggaccgatttccggcggtccgtcgcccttcgcgacggcgagagcgtcgtcctcgggtggatcctctggcccgaccgggaaacggcagaccggtgcgaggccgcgatgcgcaccgatccgcgcttccgcgatctgaccatgcccttcgacgggtcgcggatgatcttcggaggtttcgccgcggtcttcgaagcatcgcgcggggcggcgtag

SEQ ID NO: 6662 - DNA, 315 bp, Methylobacterium sp.
atgccagatctcgccgaggtggagctctactgcgcggaagcccgggatatcctcgctcacgcggagaacatcgttgccgacctggaccggagaggtgcctgcgaggggcactgcctgatggcgaaccagggcctcgcggcgctgcggaacctcgaccgcatcatcgagcggcaccgcaggcgcctgacgttcctggccctgcccaacgcggtcggcccgtccccgcctccgtctcctccgcagaagcggaactggctgctcttcctccggcggcgcggcgggtacgcgggccatggcatcgaggcgcattcctag

SEQ ID NO: 6663 - DNA, 1155 bp, Methylobacterium sp.
atgggcctcagccatcaccgcatcggcatcctgttctccgcgcacggaccctacggtctcgtcgggcgggcgatgctgaacggcgcgctcctggcggtcgacgaggtgaacgcgcggggcgactgcgtcctcgagccggtgatccgcgatccgcacggcgccctcgcgggctacgtcgccggcgccgagcaactcctcgatacggggatccgccacgtcgtcggctgctacacctcgtcgagccgcaaggagatcatcccgatcttcgagaagcgggatgccctgctctggtacccgtcgcactacgagggcttcgagacctcggcgaacgtggtctacaccggggcggcgccgaatcagcacatcgtcccgctggtgcggcacctgctcgccgggggtggccgcacggccttctgcgtcggctccaactacatctgggcctgggagaacaaccggatcctgcgggagacgctggcgatcgccggcggcgacgtcgcgggcgagcgctacctcgcggtgggcgagaccgccttcgatcaggtgatcgcggcgatcctggccgcgaagccggacttcgtcttcaacacgctgatcgggatctcggcgtaccggttcttccgcgacttccggagtgcgtgcgcggcgcgcggcatcgaccaggcgcggaccatgccggtggcgagctgcagcctcgccgagccggaactggaggcgatcgggccggaggcggtcgacggccacctgtcctccagcgtctacttcacgtcgatcgatacgccccgcaaccgcgccttcatggcggcctacgcggcgcgcttccccgaaggcccgaccccctcggcggatgcggaatcctcgtacatcgcggtgcatctcctggcgcgggcgctggcgcggtccgggaccgaggatgccgcgacggtgcgccgggcggcctgcgccgacgcgttcgaggcgccccagggaccggtgcgcctcgacgagacgaccctccacgcctgcctgaccccccggatcggcctctcgacggcggcggcccgcttcaccatcgtggcgcaggccgaggagccggtcgcgccggacccctacctggttcgcagcgatccgcgcgtcgtgccggtgagccggcgcccgcgcctgaaggtggtgccatga

SEQ ID NO: 6664 - DNA, 642 bp, Methylobacterium sp.
atgacgacaccccggctgatccagaatttcagcggcgcgcaggccctgctgatcgcgccgccgagcaccgccacggacgtcctggcgagcaccctgatgaaactcgggctcaccgtggcctcggtcgtcccggccggcgaggcgccgtggctcgatttcgagatcctcgaccccgagcaccacatcgtcatcgtggacggcgacctgccgctgccgggcctcgcggcgagcgccgtccccgacctgccgccggtcccggtcgtcgggctcgtgggcgtcgaggcgccgagccgcctcaaggggctgctccagctcggcgcgaccggcctgctgcgcaagccgatccacggcgcctcggtctacgccgccctgttcctggcggtgaacgagcacaaccggcgccgtctcctcgaagaacgccttgcccgcctcgaggagcggaggcgcggccggcgccacgtcgtcaaggcgatcctccggctgatgcaggagcacggcctcgacgacgacgcggcctacgagacgctgcggcgcgacgccatgcgcgcccggcagcccctggaagcttactgcgaggcgctggtccgcgcccgtccgtcggtcacggcgcctgccgccgcgccgcggcatgcccgatcctga

SEQ ID NO: 6665 - DNA, 762 bp, Methylobacterium sp.
atggatctcgggctcagaggccgccgggcgctggtgaccggcggcaccaagggcatcggcggggcgatcgtcgacctgctggccgacgagggggcggcggtcgccctctgcgcccgcaacgccgcggaggtcgccgccaaggtggcggccctgcgcgcccggggcgtggcggcgaccgggcgcgtcgtcgacgtcgccgattccgccgccctgcgcggctgggtcgccgaggccgcggagcagctcggcggcctcgacatcgtggtgccgaacgtgagtgccctcgcggtcggcagcgacgaggcggcgtggcggagcggcttcgccgtcgacatgatgggcaccgtctcggcggtcgaggcggcgatgccgttcctcgagcgctccgaggccggcgcgatcgtcgtcatctccagcgtctccgggcgcgaaatcgacttcgcggccggtccctacggcgccttcaaggcggcgctgatccactatgcgcaggggctggccttccagctcgcgccgcggaacatccgcgccaactcggtctcgcccggcaacacctacttcgcgggcggcgtctggcaccagatcgagaccggcaacccggcgctgttcgccgaggcgctccggctgaacccgaccggccggatggcgcggccggaggaggtggcccgcgccgccgtgttcctggcgagcccggccgcgagcttcatcaccggcaccaacctcgtggtcgacggcagcctgacccgcggcgtgcagttctga

SEQ ID NO: 6666 - DNA, 486 bp, Methylobacterium sp.
gtgtcgacgcgcgaccggttcagcatgatcgcgaagtggcacctgctgatgccgtgcgtgaccgccgtcgtcggctactttcccggccgtcggctcggatggctcgaagatctgccggccggcgtggcctacgagtgggcattccgcgggcggcgcatggaggcgagctacccggccgccgagcgccccgccctcctcgcccgcttcgccgccgtccgcgccccgatcctggcggtcggtacgccggacgacccgttcggcacgccggcggcgatccgtcggggcctcggctactacgtgtcgagcccgcgcatccaggtgcagctgaccccgtccgcgatcggcgcggaggcgcccggccatttcggcctgttccacgcgcgcaggagcggcggattctggaccgatacgctgcgctggctgagcgacgggcagaatccctggccggactccgtgatcgattcgggtcgcccgatccccgcctga

SEQ ID NO: 6667 - DNA, 927 bp, Methylobacterium sp.
atgcggccccgcacgcctcccctctccacgctcaggctcttcgaggcggccggccgccatctcagcttcgcccgcgcggcgtccgaactgaatctgacgccgagcgccgtgagccacgggatcgtcggcctcgagaaggcgctgggcgtcaagctgttcgtccgggagccgggcaggctggcgctgacgcgcgaggtggcagactacctgacctacgtgtccgaggcgctgtccctcatcctgatcggcacgcgccgcctgcccacgccgcgatccggcaggaccctggccatcagctgcgcaccgaccctggcgacgcggtggctgctgccccggctcccgacctttcgcagccgccacccgcagatcgcgatccggatcgacacctcgcatcggcaggtcggcttcccggtcgacggcttcgacttcgccctccgtctcggccgggtcccgacgccgcgccaccgcagcgtccgcctcttcgaggattggctgctccccgtctgcagcccggcccggcgcggggccgtcaccggtccggacggcgccctcgacctccggcgcgcgacgacgatccacgtcacctccgcgaccgaggactggcaggcctggagcgacgcgtcgggggcggtggcgctggcctcggccgacaccctgcacgtcgacacgttcgcgatggcgctccaggccgcggccgcgggcctcggcatcgccctcggccggggggcgctcatggaccgggagctgcgcgagggtacgctcgtcggggtcggccccgccgtcccggcggcgacctcccactggctcgtgagcgccgagggcgacgacgaccggcaggagcccgaccagttccggacctggctgctggcggaggcgcgccggttcgcggccgagcagaagcggcgcttcccgaccggcgccgcgtga

SEQ ID NO: 6668 - DNA, 147 bp, Methylobacterium sp.
atgatcgccagcttcctcgccatctttgtcgccttcgccgcctgccaggcgctgctcaccgtcaagttcgccgacttcctctccgccgaccgtacccggaacactgtcgagccgcccgccgacgtcgccaacgccaagctcgcctga

SEQ ID NO: 6669 - DNA, 99 bp, Methylobacterium sp.
atgaagctcaaggctctctcctacgtcatgatcggcgccttcgtgaccggcctgctcatgacgttcgtcggttcggccaccgcgctgctggggcagtaa

SEQ ID NO: 6670 - DNA, 699 bp, Methylobacterium sp.
atgatcgggccggccgtcaccgcgctggccgccgccgggcccgcggcgccgggggcgggtccccccggacggggaccgccctgcgggccggttccgggctgcgcggtcttcggatcgaacttcgccccggacgtcccggacgcggcggtggaggctgtcgacgacgaggcggacgctccggttcggccgtcggaagccgacgacgcggcgcccgccgtcacgggatcgggcttcgcactggccgactgggcggccgggccggtcgacggcttcaggccgtcggtcccggaggccggcgggccggcgtcggacttcggatcggtcgtgccgggcttggcggccacgaccgggtcggtcgccggcttgggcggcgttccgggcacgggcccctgcgggcccttcgcgccgccggcggcggtggaggaggtggaggccgacatggacgcggacgtcgaggcggtggacgccgacgtcgtggccggccgcgacgcgcccccggacggggtgggctgcccgggcctgccgggcgcggcgtccggcttccggccgccggggccgggcttgtcggcgtcgctgggtggtggcgtcacgggcaagtcctccaactcttcggcgtcgccgcgcccccctagcaccgcggcggcgccgggcgcgagggcgagatacggcggcccggcctccctgtcaccgcgcggttag

SEQ ID NO: 6671 - DNA, 750 bp, Methylobacterium sp.
atgctcgaactctcgctcgacgctgatacaatcgacgcgcaggccccccggctccccgacagcgtgcagtatcacctcggccatctgctcgctgcgacctacgcgcaggacaacgtcgagccgaccatcgcggatcgcttcgccgaactgctgaggctgctcgacggcgccttcggccgggcgcagtacgggcgcgagaaggcgttccaggcctcgctcctcgccctggtgccgaacctgcagcgcttcgcccgctcgctcctgcgcagccatgtcggtgccgacgacctcctgcagaacacgcttctccgggcctggcgctcgcgcgccagcttcgcgccgggcacgaacctggaagcgtggctgttcaccatcatgcgcaaccagttctacaacgagcaccgcaagcgcgggcgcgaggtgcaggacgaggacggcgcgcaggcggagcggatggtctcgctgcccgagcagggcggccatctcgacctgagcgacgtccaggccgccctcgaccgcctggcgccgccgatgcggcaggcgctggtgctcgtggcgatcgagaacctcacctacgaggagaccgccgccgtcatgcagtgccgcatcggcacggtgaagagccgggtctggcgggcccggacgcagctcgccgagatgctgggctacaccggcctcgaggtcggcagcgacgacgtcatgctggccgccgcggggccgaagggccggaaatccaccgctgtctcgtga

SEQ ID NO: 6672 - DNA, 1311 bp, Methylobacterium sp.
atgccgcgtctgcgctggctcatgatcggcctctgcatggccgccaacgccatcaactacatcgaccgcgccaacctggcggtcgccgcgccctccatgtccaaggaactcgggctcgacgccaccgacatgggcctgatcctgtcgggcttcttctggacctacgcgatcatgcagctgcccttcggctacgtggccgaccgggtcggcgcgcggctctccctcgtcgtcgcggtggtctggtggtcggcctgcacggcgctgaccgcggtcggacggggcttcctgtccctgctcggcctgcgcatgctgctcggcatcggcgaggccggggcctacccgtccttcgccaaggtcgcggcctcgtggttcccgcgcagcgagcgcagcttcgccagcagcatcttcgacagcggctcccgggtgggctcggctttggcgatcccgctggtctcctgggtcatcgcgacgctgggctggcgggaatccttcgtcgtaaccggcgtgctgggcttcgtctgggcggtgttctggatgtggctctaccgcgagcccgagaaccacccgaaggtgtcgccggaggagctcgcccgactgcgggccgcgcaggagcggcccaagaccgtcgacgcggcggacgcccagaaccaggtgccgtggctgtcgctgttcagctaccgcacggtctggggcatgatggccgggttcttctgcctcaacttcgtgatctacttcttcatcacgtggttcccgacctacctggtcaaggcgcggggcttctccctggcggagctcggcacgctcggcagcctgccggccctggcgtcgatccccgcgggctggctcggcggcttcgcgtcggacgcgctctaccgccgcggctggagcctcaccgcggcccgcaagacctgcctcgtcggcggcatgctgatgtcgtcggtgatcaccctgtcgatcatcgccccgaacatctacgtggcgctgctgtgcttcgcggtcgcctacggcagcctcgccttcacggcggcctcgatctgggcgctgcccggcgacgtggcgccgaccccggcccacgtggcctcgatcggcggcatccagaacttcgcgtcgaacgtcgccgggatcgtgacgacgaccttcacgggcgtcatgctgacggtcacccaggggtcgttcgtgatccccctgatcgtggccggcgggttctgcctgctgggcgccttcatctacctgttcgtggtcggcgagatcgcgccgctgccggtccgcgacgcccgcgccccggccctgcgccccgaagcggcgcggtga

SEQ ID NO: 6673 - DNA, 648 bp, Methylobacterium sp.
atggccgcgatcacggcggccgcacagaaggcgccgcccggcgaggcgaccgcgctcaccccggcgcgcgacgtgaagcccgtcacggcgccagatccgcggtcgatctacacgctcacgccggaagcggccggggccgtcttcgcgctggtcgagaaccgcatccaggtgatcgacgccgcgctcgacgtgaccgaccggcggggcacgcaggccgtggccgccgcgatggccacggccacggcgacgacgccggtcgtgtcgccggagacgacgaagacgatcggcgccgccaatcgcaactggagcgaggatgtccggttggatcacggcccgtcccggctcgtcggcgccgacacggccgtggcgtacgacagcccgcgggtcacggcggcctggagcctggccttcccggacgtggccggccggcggttccgggccgtgcaattgccgggtccgagcctccgctccgtcctacacgaggcggaggccggattggacgacaccgggagcgacatctacctgctctgcaacagcgcgcatttcgagacgatccggcaagcccacccgcggacccacatcaactggatcaacgtcgacaacgacgagatcgtcgtcgtctggcggaagccgtccgaggaaggctag

SEQ ID NO: 6674 - DNA, 177 bp, Methylobacterium sp.
gtgggccgctgccgcgtctgcggccttgcctacggcggcatcctcggccgcgaggcgggagtgatccggctcgaccgcgcccggtggcgccgtctctgcccgggcgcggcgtggctgaccgtgccggccgcctgcgcgggtctccgggccagcttcggcgggggcgccggatcctaa

SEQ ID NO: 6675 - DNA, 306 bp, Methylobacterium sp.
atgattgaacagggcccacggatagcgcgcgaattccatgtcggcgtcggcggcgaccgctgggccctgatgcgcgacctccagaccgggcagccctacgtctctcactccccgggcgatgacgcgccggaggtccaactggatctcggttcgttcctcgtgctgttcaccggggaggagcgggagaagctgctccgcctgatcgggtcgctgctgccggacgaggacgcgcgtgcggatgccgacggccgggccggcacgtcgcgtccgctgacctttgtctcccggtggcttcccaaccggtag

SEQ ID NO: 6676 - DNA, 252 bp, Methylobacterium sp.
atggacaaccagcgcaacgcccgacgcgtctccgtcaacctgagcggatgcatctccgtggccggccatcccgccatcccctgcgtggtgcacgacatgtcgcggtggggtgttcgcctccggctcgtcgggaccgagcgggtgccccccgcgttcacgctgacgatcgacgccaccgacacggtgatcggctgcgagacggtctggaagaacgccgacgagatcggggccctgaccgacctgatggagtga

SEQ ID NO: 6677 - DNA, 1161 bp, Methylobacterium sp.
atggacatcaactccttcgccgtgtccccgctcgactacggcgcgagcgtcaacgccgacccggagaccaaccgcgtcgccttccagaacgcgatcaatgcgctccaggccaagggtggcggccggttcgtcgtcccgcagggcatcttcgtggtgaacgcaccgctgaccgccagcctcggtcagaacggctcgatcttcatggagggcgccgacaccaactcgaccatcaccttcacgggcggggcccagaacggcctcgtggtcgacgccggtttcatcaagctctcgggcttccggatcgtcgtctcggccatgccgaacatcggccagggctcggcctgctacttacggaacgcctcggcgctgggcggctcgttccagaacatcgtcgtggaggatatgcggttcgagggtcgtgtcgacgctcggccgagctacttcctggcggtcaacggcccggccacctcgcgcatccgcggcgtcaccgtcgtgggcttctacaaccagtccttcccggtcgacagcacgggcatctacatcttcggtgaggtatcgccgagtggtggcgcctcgggcgactggtcgtgcgagggctgcacggtcatcggcgtgggcacggcgttcctggtcaacgagggcgccggtcccgggcaggcgaccgtcgagggctcgtcgttcacggactgcgtcgccgtgggcgtccaggtgggcctgcacatggtcggcaacggctatcaggtgccgggccactcctggaagggcgggcacatcaacgccgcggcggtgtgcgcgcagttcgacagcatctcgcagttcgagatcgccgactgcctgctctacctggacgctggcggggcgaacaagcaggggttcatcttgttcaacggctgcacgcagatgcgggcgcgggacaaccagatgatccacatcgcgcagaccggcgacaccgggggcggcgtctacggcgtggccttcgccaacggcacgaccgcctcgcgggcccagaacaacgacggcatcgggttccccggtggctcggcggtcatctacaaccagtccggcggcaacaaccgggctggcggtaacggccgcggcggccagggcgccctgctcgtcggcggcaacctgatcgacctgggcgggaaccacgtcttctag

SEQ ID NO: 6678 - DNA, 1299 bp, Methylobacterium sp.
atgcaaccggtcccgctcccgcaccagatcgtcggcgcccagttcctcgcgaacggaggcctgctgctggccgacgagcctcgcgtcggcaagacgggcgcctcgatcctggcgctcgacttcctgatggcccggcgcgtcctggtcgtcacgacggcgtcggggcggttcaacttcagccgcgaggtgcgcgagtggcaggccttcccgcgggaggtccaggtcatgatgggcacggccggccgcgtgcagccgcagaccgacgtggcggtcgtgggctggtcgacggtcgggaacgagcagcagcaggcccatctgctcgactggcgccccgagctggtcgtgctcgacgagagccactacgccaagagcttcgaggcgaagcggaccgtcgcggccatggcgctcgcggacgcggccgaccggacattctgtctgtccggcacgcccatgccgaacagccccctcgatctctggcccatgctccggacgctggcgccggagcgggtgagcgatctgagcttcgacgacttcatgggccgctactgcgtcgtccgccacaagttcgtggccggcgagtggaagccgatcgtcaagcgcgggaagaacgaggtcgagctgcgccagcgcctcgacgggctgctcctgcgccggacccagcaggacgtggggatccgcgagcccatcttctccaccctggcgctcgacggcggtgcggtcggcacggccgcgatccgggccgcgctggccgagctgcccgaggccgacgagatcctcgacgccgcggagaccggcgacacgaaggcgctggagcaccacctgggcacgctccggcgcgtgacgggcatcgccaaggcccatgcggtcgccgagctggtgaaggaggagatcgagaccgggaagatgcagcgcgtcgtcctgatgtgctggcacacgggggcgatcgaggcgctccgtggcctgctcaaggcctacaacccggtcgtcctggatggctcgaccccggcggcgaagcgggccggcgtgatcgaggccttccagaacaatcgctcccaggtgttcatcggtcagatcatcgccgcgggcgaggcgatcgacctgtcagtttcgcgcgacctgatcttcgttgagcaaagctttgctccgaaggacatgaagcaggccgcgctccggatcactaaccacggccagaaggctcagtgtttggtgagagtagccgcgctcgcgggctctatagacgaggccttgactgcggtgttagtgcgcaaagtcgcttcaatcaaagaggttctccagtga

SEQ ID NO: 6679 - DNA, 381 bp, Methylobacterium sp.
atgcgcgtgctcatctgtggaggtcgcgacctcgacccggcgctggtgtggaactggctcgaggcgcacgcgaccgaggaatgcgccgacgcgctcgggcgcgcccagcacgtgctgatctcacacgtgatccagggcggcgcgaccggtgccgattccggagcggccgcctgggcacgctccagcgagatcccgcagtcgtgctttccggccgactgggaccgctacggccggcaggcgggaccactgcggaacacgcagatgctggcggaaggtcgacccgacgtcgtgatcgccctgtacccagccggcgcgggcacggccgacatggtgcggaaggcgcgcgccgccgggctgccggtggtggaggcgcggatatga

SEQ ID NO: 6680 - DNA, 213 bp, Methylobacterium sp.
atgaccgacgagcagaagggctacctgcaggcgctgtccgacatgcgctcctggcatcgatgggagatcggacaggcgcttggcgacgtgcgccgcatggagccccacgagaaggccatcgcttggctcgatgagctgattgccacgaagaagcggcacgcggccgaggatgaagccgagctgcggcgcggcgagcctgcacctaagtcctag

SEQ ID NO: 6681 - DNA, 567 bp, Methylobacterium sp.
atgtccgacgcgatcagcagcgcgctgtcggccggcacgatcggcagcaccgacgcgacggccctcgcgggcgccctgagcagcatcgatgggagcctgtcgtcgaccagcgctgcctcgaccagcgcgaccagccggtccgggctcgacccgtcctcgatgaaggaccggatcgacggcctgatcgccgatcaggtcagcagcggcagcctcaccgccgaccaggccacggagctgaagaacctgttcgccagccccggccggagcacccagagcgcggacgccaccggcgacgggactggcgccgtcgccggcccggacggctcgccgcccgggcctccgcccggcccggcgccgacggacgctgcgggcagcgccgggagcggggcgtcggtctccgcgtcggcctcgacctcgaccaccgacgcggcgcgcacgaccaacgacctgctgtccaccttcatccagcagctccagagcggccaggcgggcagcgtcggctacggggcgagcggcaccgccaacagcggcgccgtctcggcgctcctcctcgacttccgcagctga

SEQ ID NO: 6682 - DNA, 447 bp, Methylobacterium sp.
atgaagagcacgacacagcaggatcagctcgagatcgtgagcgccctcgcggcctcgctcgccgaccggatgctgatggagcgcctgacacaggggaagctgcccctcgcgaacgcgagccgcctctggacagcctcgctgctcctggaagagcacgcgcggcccatcccgcgcatcgtgacggacgtcctcgagcaggtccggcacgtcgagccggacgacgacgcggccgacggggatgacgccgacgggatcggggcggggccgcaaccggacttggccgcggcgcggcgtccggcccggccggcgcgccggcgcgggctcacccgcctcctccgaccgttccggcaggcggccgaagcctgccccgcatcgacggacgcgcccggtgacggcgcgggaccatctggtggatccggagttccccgcgcgcgcccgggacgctaa

SEQ ID NO: 6683 - DNA, 321 bp, Methylobacterium sp.
atggacaaggtctatgccggggaccggacgatcgacgggatcgtcgtcacggtgaacggggcgccgctgccggatcgggccgaggccaagtgctactcccggaacggcttcgagtggagctacgaaggtcccgagccctcgcagctcgcctacgcgatcctggtggatcatctcggcgacgcggcggaggcggagcgcctgcagccgcgcttcatgcgcggcgtcgtggccaacttccagaacgagtgggagatgacgacggccgacgtcgcccgcgtcctggagcacctggaatcgggcggcgcggcgcggtccggctga

SEQ ID NO: 6684 - DNA, 216 bp, Methylobacterium sp.
atgccgtttccgatcaagttcggcctgtcggtcgccgtcgcgctcgcggcgctcgccggctggttctacatgggccatctcggccagaccgggccgcgctgggccgtggccttcctcggcccgttcatggtggtcagcctctggatcttccccgaggtgatgcgcaaccgctccgacggccgcaccccgcgccaccggatccgggaggcgcggtga

SEQ ID NO: 6685 - DNA, 390 bp, Methylobacterium sp.
atggacatgatcgaaccgaacgtcgccgcgctcgcgtggttcgccctcttcgcgggggtcgcctgcaccggcttctacgtgctggccgggatgttcccgctggagacccggcccgacctgagggcgcgccccctcggcctcgcgctgatcgcggccaacgtcctcctgctcgcggcgctgaccggcgggatgctcgcctacggggtcaccgagctccgctggtcgagcctcgtgatcgtgggcggcttcgccatcctgttcgcgcccggcctgttcaacgtctggccccagcgctggcgcgacggcgtcgcgggcctggcgatcgtgctcgccgccctctgcggcgccctcggcctgctgcagcaggtcggcgccgtcttcgtcctctga

SEQ ID NO: 6686 - DNA, 792 bp, Methylobacterium sp.
atggaactcgccaacacccgcatgagcgagcggcagcggaactaccgcgccaattaccgccagcgcgtggccggctggtacaacggcttcctgcacatcgcgatcatctacacgatcggcctcacggccctgtatatctacgtctcgaacatccacgcgccgagctggatcgaactcgcgacggtcccggtcgtgttcctgttctgcaatttcttcgaatggtggctccaccgctacgtgatgcaccggccgcagagcaatccgatcgggcgggccgtctacaatcggcacacgctgcagcatcaccagttctttaccgaccacgagatgcgcttcgccgaccaccgggactaccgggtgacgttcttcccgccctacgcgctcgcgacgttcacgctgatgtcgatccccggcgccatcgtgctcggcaacgtattcacgcccaatgtcgggtggctgttcatcaccaccacgaccagcatctacatgatctacgagttcatgcacttctgctgccatgtcgaggagaactggttcgtccgcaacatgccgttcatcaacacgaaccggcggcaccacaccgcccatcacgaccagtcgatcatgatggagcggaacatgaacctgaccttcccgatcatggactggctgttcggcacctcggacctgaaccgcggtctcatcggaacgctcttcaacggctacgacacgcgccacgtgaagaccgacatgcgcaagaccgcgcgcacgcccggtgcccccgagccccgcgccatgcaggcggccgagtaa

SEQ ID NO: 6687 - DNA, 666 bp, Methylobacterium sp.
atgcgcgttctggtcgtcgaggacgatgccgccctggcgcgcggcctcgtcgccgccctccggcacggcggatacgccgtcgaccacgaggcggacggagcggacgcggtgcagctcgcgctgagcgaaccctacagcctcatcgtcctggacctcggtctgccgggtctgccgggcttcgacgtcctcaaggccgtccgggcggccggctcgaccgttccggtcatgatcctgaccgcgcgcgacgccatcagcgaccgcgtccgcgggctcgatctcggggcggacgattacctgctcaagccgttcgacctcgccgagttcgaggcgcgggtgcgggcgctcgtccgccgcgggcaggcggtgccgaatccggtcctgcgctgcggcacgctggagctcgaccgggccgcgggcaccgtgaccctcggcggggcgcccgtcgcgctgcgccgccgggaactcgccgtcctgaccatcctgatgacgcgcgccgggaaacccgtcccgaaggaacggctcagcgcggagatcttcggcttcgacgaggcggtcgccccgaacgccctcgaactctacgtcgcccgcctgcggaagaagttgcagccggacggtcccgagatccgcacgatccgcggcctcggctacctgctgatgccggtgtga

SEQ ID NO: 6688 - DNA, 318 bp, Methylobacterium sp.
gtgcgcgcggagatccgcgaggagatccgcgtcgccgcgcgcgggcgcgacccgtgtttcatccgttcagcctggagacgatcgatgccgttcgccaatttcaagatcccgcagggcatgatgaccggtccgcagaaggcggatctgatccaccgcacgacggatctgctggtcgcctacttcggggaggccgcgcgcccgcacaccatggtcctggtcgacgaggtcgtggatggcggctacgggcgcgcggacgaggtgttcgatctcgaggccctgcgacgcctgcgggcgcaccacgagacggggtcgcgctga

SEQ ID NO: 6689 - DNA, 1095 bp, Methylobacterium sp.
gtgtccttctcagcactgatgatcgcgccggcggcccaggcggccagcactctggaggcggctctccgcgcggtgcccgattccgtcctggcgacgcctgacccgatgccgatcgtcttcatggacgtccaggcgctgtccagggcgaccggcggcgcgctgagcgacgccggcctgcggcgcatggccttcccgcagagcatccgcccgctgaacgccctcggctacggcggcgcgcagacatggaccgagaaggccggcatcccgttcgaggacatctcctatttcgcggccttcggccagcctccggcgcgcgtgacttactggggtctggcgacgaaggcggcagccgacaccctggtcgccaaactgaaggacaggaacttccggccggtctcgaccgcgccgcgcattctcgccaacggtgagccccgcgccctgaatctcaaggcccggcagccgaccgatccctggtccggcccgatgggcgagaccagcgcgatcctggcgatcgatcgcgtcatcgcgcaggcgtccgcggccgcggatctggagacacgcgtcggggttggccggagcgcggcggatcacgaggccgtcgccacatcgctgacgggtctggccgccgcggatgagcgcgacccgggcgcgatccttcaagcggccgtcgtgacgccgctgatgggtatcacccccgacgatcctgccgccctcctgtcggcgacgaccgatctggtcgcgcagaagaaggcgatcgaggatcaacgcgagcgcggacgggacggcgtcccggcttatgccggcggtatcgtggcggactatcaagggaagaacggaccggccctgctcgtgtccctcgcctatcccgattgccggacggccgacagggccgtctccgcgctgaaggcgcgttggcaagccggcatgacccctgcggcctccgtggacggccgctcggtcgagagcccgcagcgcggctgtgccgccgtcctccgcgtcgatcgtgccccgggtgcgaacagcccgttcggggagttcctcgggacgtacatgcagcgcggcttcaatgtcctgcagatcggatcgcagcgatga

SEQ ID NO: 6690 - DNA, 276 bp, Methylobacterium sp.
atggctggagaagcgaagagggccgcgccgaagcgccgaggggacgacccggatgcggcgcgcgccgagggcgagaaggtcggcgcgcgcatcgatgccgccttcgagaagctcgccgggaagctgcgcgcccgcgccgacagggcccgcgccaagctcgacgcggcgaccaaggccgagaagcgggcggtgctgctgcgccgctacgaactctacgcggacgcggcggcctatctcgaggagcggctcgtcgatcgcggggggcgatccgcgtga

SEQ ID NO: 6691 - DNA, 228 bp, Methylobacterium sp.
atgctgccgaccgatctcgaccgacctgccgaactgaccctctggccgggctacgcgccggcccgggtggccgtgtcgcacagtttcccgacgctgcgggccgctctcgccgccgcggtcgcggcgatcgacgccgaggatgccaatccctggatcatcaccgagggcggcgacatcctcgctccgggatggatccgcgcgaacaccgcgggcgccgtcctgcagtag

SEQ ID NO: 6692 - DNA, 960 bp, Methylobacterium sp.
ttgttctcgacggcggatttcaagccgaaagacagtttccgcctctggcgtgagacgatcttcgagcggatcgtgccggtcgaacttacgcctgccgcggcgcacgctttcaccggcacgctggaggctgcggaggtcgggccgctgctgatcacgcgcgtgacgcagagcgccatcaccaccgtcgcgaccccggacacgatccgccgacacggcaagtacgagaccctgaacgtcgcgatcacgctcaagggccgcgtgttcagcgcgcaggacgaccgcaccgcgatccagaatcccggcgacatcgtcgtgatggaccgtcggccggcgacgatggcctccgacgtcgacacgcagacgctgttcgtcgagctgccgcgcgaatccctggagcgcgccctcggctcgacgcgccggttcacgtgcctcacgatcggcgcggatcaagtcggcacgtcgatggtcacgacctttttccaggagctggtccgcaacgcggagcgcctgacgccggacatgtcgaaccgcatggcgtcggtcggcgtcgatctcatcgtcgcgagtatcgcggaacgcctcgcgcacgagacccccaagaacatccagggcgtcctgatcttccagcgtgcgctggcccacatcgaggcccatctcggcgacctgaacctcgatccggccgggctcgcggcggccgtcggcgtgtcgctgcgccacctccaggccctgttccgcgagcaggaccgcaacatcgccgactggatctggcggcggcggctggagaccgccgcgcagcgtctcgccgatcccggcttcgcccatctggccgtcggagagctggcctacagctgcggcttctgcacccagagccatttcagccgacgcttcaaggacagctacgggatctcgccgagcgagtaccggtggcgcaaccgcggcgcggaccagctcgccggctga

SEQ ID NO: 6693 - DNA, 405 bp, Methylobacterium sp.
gtgctgacggcagggctcgtcgctgcctatgtatcgaacaatcgggttcccaccgccgacctcccgaccctcatcgcgcagtgtcacgacgcgatcaccgcgctggccgccaacggggcggcgtcgatcgaggcggcgggggatacggacgcgctgcgcgaccggcctaccgccgcgcagatccgcagctcgatccggcccgacggcatcgtgagcttcatcgacgggcgccgctacaagacgctcaagcgccatctcacggcccacggcctgcacccgcagagctaccgcgagcgctacggtctgccggccgactatccgatggtcgcgcaggaatatgccgagcgccggtccgcgctggcgcgctccatcggcctcggcgtgccgggcgagcgcgccgcctga

SEQ ID NO: 6694 - DNA, 225 bp, Methylobacterium sp.
gtgatcggcgtggtcggattgcgggcggtcgacgtgctcgggctcttcgtcgagcccgcggtgatctgcctgctcgccgccctggtgatcacctgggccctgcgctggatcctggactggatcggcatcaaccaccttgtctggaaccgcgccctgttcgacttcagcctcctgaccgccgtgacggcgctgctgatcctgtccctgcgcgtccagggcccgtga

SEQ ID NO: 6695 - DNA, 1857 bp, Methylobacterium sp.
atggccggtgaggtcgcgctctccgaggacgcgccgggcctcctgcagcgcctcgcggcgtggtggccgcgcgaggcggccgaggccgtgcgcatcgcgctcaccgccatcgcggcgatctggctcgccatgtggctcgagctggcgctgccgcactgggccggctggacggtcatctcggtgacgctcgccacccgcgcggcctccctgcgcaagagcctgtggcgggccggcagcacgctggtgggcgtcaccgtcgcgatggtgctggtggccaatttcgcccaggcgaccctagccttcgacctcgcgctggccctgtggatgggcctgctcaccgcggcctccagcgtcgagagcggccagcgcgcctacggcttcgcctcgatgggcttcaccgtgccgatcatcgcgctggccgacgtgcagaatccggaggccgtgttccagatcggcgtcgatcgctgctcgacgatcctgctcgggatcggctgcgcctacgcgtcgaacgtgttcgtggcgccgggcgtccccgccgtcagccgcgccctggcagggcggctcgaggcggccgcggaggcctgtgacgcctggatggccgccctgcggcggggcgagcggcccggcccgatgccgatcgccgcggtcatgaccctgggcgaggaggtcaccgacacgttcaccgagcagccctccctgcgctccggcggccgcggcatccgcaacgccgccccccggttgcggcgggtgctcgccgcgggcctgctgcgggcgctgctgccggaccggccgggatcgcgctcaaccgacctgatcggggccggcggggcgatcgccgtccggcaggtcgggcgcgtccgggtctcggcgcggctgctgcgggccggcggccgcgtgggccggcggcgcgtcccgttccgcccgcacctgctcctgtggaacgacctggactgggacggctggcacgccttcgacaacgccctgcgcaccgccgccgccgtcctgctcgtcaacggcttctggtacgtcaccggctggtcgcacggggccggcgccgcgacctgggcgagcctcgtctgcgtcctgctcgccgcccatgccgacccgcgggcggaatcccgcgccttcctggtcggcgcgctgctcgccggcgtggtcgggctcaccgtccgctacaccctgctgacggccaccgggagcttcgcgctgctggccgcggtgctgctgccggtggcgatgctggcggtggtcggccgcgccgacaagcgcgcgatctacgggatcggcttcgggttcttcgtcttcggcgtgctcgatcccaagaacccgatgacctacgacctcgccgattcgctcaacaccgtgctggccgagctgctcggcatggcggtggcggcgatcgccttcgccgccctaccgccgccggtcagcgccgcgaccctgcgcctgcgggcccgccggcggctggtccggtcggtgcgcggcgcggccctcgacccggggctcctgctgccgcccctcgaccgctacctcgcccggggcttcggccgcctcgccctcatcggcgcggatgaagaggcggcccggagcggcgagcgcctgctcgtcatcgggctcctgctgctcgccctgcgtgagacggacgaccgggagggccgccgcgtcggccgggcggtctgggcgcggctcgccgcgtcccgtccggcggggccggagacggcgccggatcccttgcgcgcgctcgccgaccgggcgaccctgcccctccaggcggagcgcatcggggcgctggccgccctcgtgtcggatctcgaccgcgcgggctggccgaacctcgatccgggagggcgggcgtga

SEQ ID NO: 6696 - DNA, 399 bp, Methylobacterium sp.
atgatccgctgcgtacgcatctggaccggtgacgacgacaattcctacttcgaggaaggcgtcatcgacctgccccacggcgagcgcggcgacatcctcagcggcacgaccgacgtggtctcgatctccttccgcgagacccaggccggcgggacctacgcgtggcacgcggcgccgacccggcagttcgtcatcaccctgcgcggcaccctcgacttccagacgagggccggcgcgcacttcacgatccgccccggcgacatcctcatcgccgaggacacggccggctccggccattcctggcgcctggtcgacgacgagccctggtgccgggcctacgtgatcctcgcccccggcgccgaggcgcggctccccttcgtcccgaacaagaccgcctga

SEQ ID NO: 6697 - DNA, 231 bp, Methylobacterium sp.
atgcaggacagcatcgataccgtccgcgagctgagcgccgccgagctggaccaggtcggcggtggcctcggggtcggcctcactgtcggcctcggggtcgacgcgagccaggagctcggtgcggtctcgggggtcgtgggccaggtcggcggtctggtgagcggcctggtgggcagcgtgctcggcgcggtcggcggtgtcgtcggcggcgtgaccggctccctgcgctga

SEQ ID NO: 6698 - DNA, 414 bp, Methylobacterium sp.
ttgcgcaagaaccaggaccagcttgaaccgaccatcagcgacgtggccctgcgcgtcgtgaccgcctatctgtcgaacaacgcgctgccgcacaccagcataccgccgctcctgatcaccgtgcacggcgcgctctccgcgctcaccgaccggccggcggtcgtcgaggcgccgcccgagcagcccgacgccgctcagatccgcggctcggtccgccaggacggcatcgtcagcttcatcgacggccggtcgtacaagaccatgaagcggcacctcacggcgcacgggctgacgccggatctctaccgcgcgcgctacgggctgccggacgattacccgatgaccgcgccgggctacgccgagcgccggtcaaagatcgccaaggcgatccggctcggccgcaaggccgcctga

SEQ ID NO: 6699 - DNA, 351 bp, Methylobacterium sp.
gtgctggcggcgctcctcggaggcctgctcgcggcgccgttcgcccacgggcagggcactgacgatctggaggccgagatgcgggcgcgggtcgccgcggccttcccggatgcgggcctcgtgacgttccgcaagatccggcctatccccgccgaggcggagtccggcgtggcgttctgcggccaggtcagcagcggccccgtcgggcaggggcggtcggattttcaggtgttcctgtacgaccgcaccgcgtcggccgagaccgtccgcatcctcggatcggaatccctcaacggctaccgcgtcggccggaagctgatcggcgccctgcggcgggtcggctgcctttga

SEQ ID NO: 6700 - DNA, 273 bp, Methylobacterium sp.
atggaggttcggatgtgcgcgcggaagaccttctacattttcgtctcggcctcggacggggagcagttctgcgccgtccgacaggaccagcccatcccgtcgctcatcgacggtgtccgctggatgtatgttggctgcatcgatacgacccgggacaggccgtacggattcgacgtggacgcggcgcacgcggcgatgcggcaccgcagcgtgtacttctaccggcgcgaactgatgttccgccgggccaacttcctcctcgaagccgcctga

SEQ ID NO: 6701 - DNA, 672 bp, Methylobacterium sp.
gtgctctggttcctggtcgcccttgggcttgtgcgggtggtcgacgccgcggcgcgcgcggcgaccttcccgggcggctactggatcgtcctgggcggcgccctggccctgtcgtggacctgcagcgcgcgggtgttcccgtactggcaggtccacgcgctcgtgggcgccctgccgttctacgtcgcgggcctgaggctcgggcgacgggcgttcgacgtgtcggcgctgctcggcgcctgcggcctcgcggtgctcctgctctgcgcgccgcggaacttcgtccacgtcgcgaccgggcagtacggcgacccggcgctgttcgccgtgacggccgtggcgggctcggcgttcgcgctggcggtcgccggccggctgcgcggcccgccgcgcgccgcggccggcctgctggggcgggcgagcttcgagctctacatcgtcagcggctacttcctcctcctggcgccgcactggcccgcctgggaccggtgggaccgcttggtgctgctcgccgccatcggcctgcccctgcacctgatcgcggcccgcgggctgcgcgggccgatccgggccgtccgcgcggccgccgacagtgtcgtcgacggtttggtcggcgggctctccggccgccggcgtcgcgcgcggccgggcttgtccggggcggatccttaa

SEQ ID NO: 6702 - DNA, 219 bp, Methylobacterium sp.
atgaccgctccgcaagtcatcgcaacgatcttcttcctggtctcggtcggttcggcgacgacgctggccctcatggcggcggcctcggccgtgctggacgcggtcgcggagacctgcgaccgcgcgcggccggacgcgggacgggaccgctcgcgccgtgtcacggaggccgcctgtcggctgcgccgcgcggccctcgcccgcgccgcgatcccgtag

SEQ ID NO: 6703 - DNA, 222 bp, Methylobacterium sp.
gtgcagcacctgttccaggccgtcgcgatcttcgcgttcggctgcctgctgatccatgccggtcgcgcctatgcccgggcgaccacgctcctgctctccgcgaccgcgctgatgctgagcgtcaccctcggcaccgtgctctgccagcggatcggcctcacggggcgttccgtcgcggccggcccgtcctacacggtggcgctcggccggcccgctccgtag

SEQ ID NO: 6704 - DNA, 144 bp, Methylobacterium sp.
atgaccgcgcctctcctcatcagcgtcgccttcgcggccgtgaccgcgggcgccgccacgctctgggccttgctggtcgcgaacggcatgaacggcgtgacggagtcgcgcccgaccgagcggcacgacatccggacctggtga

SEQ ID NO: 6705 - DNA, 1524 bp, Methylobacterium sp.
atgttggagtggcttgccttacggatcgcgcgccggatcgtcgacagtgactattatctgacacaaaatgccgacgtggcggcggcaggcgtcgatccggtcgcccatttcgcgcgacactggtccgcggcaccattgcgcgcgcccaacgcgcgcatggaggcgcgaatctacgcgtggtcgcccgtgctcgtcgccgttctggcgatgctcgggcagagccgtcaggacatcacggactgcttccgctaccgcatcaaccaactcgcgacccggcgcggcttcggcctgcagcttcggctcgccctcgcgctcgcgcgcttcctcgccgtgcggtccgcatcgcccgcacgtccgagcggcggagcgggtaccgctctcggctcgatctacccggtggtgcggatcgggcaggatgcggtgccctggatcgactgccgcggcatcgcggaagccggcgtgttcgacttcacggatccagcggtcgccctgtccgcgcagccgccgaccgcccgtcgactacgcaggccggaactctggtgcgcgacgatccgggacgcgtcgctcttcggcttcgctcagatcgtctcccattccgccttcgtggtctacgagccggaggcggacccggcgtttcgctacacgagtcgccagtgcgagttcgtcatcacctgtttcggccccgagggcgaccgggtcctggcccgtgtcccgcaggaggcggatcgggcgatcgatgcaggcatccttttgatcgggcgatgcggtgcgaactattttcatttcctgatcgagtacgccacgaagggctacatcgtcgacaatgcgtcgataccgcaggatgtgccgctcatcctgagcgacgatctgtttccacaggaaatggacgccctgaagctgctcttcccgggccgcccattcacggtccggcagcacgggcagcggctggacgtgaagacgctctacgttccctccttgatgaccttcattccggatacgcccgacgtcgagttctggacggtggccgctgtcaatcacgcgagcctctcctggctgcgtgagcgggtgatcgaagccgttccagcgcccagtactccggcgggccggaagctctatctcgggcgatccgcggggcgtaacatcacgaacgccgccgaggtggaggcagtgtttcgccggtacggtttcgagatcgtgaacccggggcagctcagcttcgcggaacaggtcgaggctttcaggactgcgcgctgcatcgccgggccgatcggcgccgccttcgccaatctggttttcgcatctccgggcactctcgtcctgggactcgtgtcgccgttcgccgtgcagttctcgacgttcgccagtctcgcgaggtttgccgggtgtcgctacttggccgtccccggtgagcatggggcctatcgccccggcgccgagacgcggcgccgctcgctcgagctgacgcacggcaattaccgcatcgatctcgattacctgggtaccgtgctacggaccaatatctga

SEQ ID NO: 6706 - DNA, 813 bp, Methylobacterium sp.
atggcgcgccgcccgacctatcataacgacggccgcggaccggaacatctgatcatgcgtggtactctggtcgtcgcgacccttctcgccttctcggcggtgccggccgccatcgcggccaatccggtgcgggacgtgctctgggtggcgctgcagggctgcgtgctcgccaagaaggccgcgggccggagctttccctgcctcgcggtcgatctcggcgacgccgcgcgcccgggaacggcggtgctgcgggcgccgggccagcccacccacacggtggtgatgcccaccgacagcgtctcgggcatcgaggcccccgtgctccagggaccgcgaggggcggcctactggcgggcggcgctcgcggcccggcactacgtgtcggacgcgctgcagggccgtctgcccccctccgcggtcggcctggaggtgaactccgtgggcggccgcagccaggatcagctgcacatccacctcgactgcatgcgccggagcgtcacggcggccctgaaggcccacggcgacgccgtcggcgacagctgggccccgttcccggtgccgctggcggaggtgtcctacctcgccatgcgggtcccggccgacgcggtcgaggcgttcaacccgttcgccgctctggcccgcgtgcccggctggcagggccacctgcacgacgcgagcttcgcggcggtagaggccgatcccggggatccgcggggcgggatgatcctgctcgcctatcgggagccggaggccagcgccgaatacctgatggatcacggctgccgggtggccaggcacggccgggccggctga

SEQ ID NO: 6707 - DNA, 306 bp, Methylobacterium sp.
atgccgctgaccggacgtttctggttccgccggacctggaccggcaagctggtcctgctcgtcgaggaggagcgcgggcgctggttccggcgccgcctcggccgcaccctgcgctggcgcgacgcgcggctcctcgatctggccgaggggcccctgcgggggctcatgacgctggagcggacctaccgcgccgagttcggccccggcgagccgcgccgccccgccggcctcacggcggtcccgggcgggctggccctgccgcgcggcgggccggagccaggaacaaggccgtccctgtcgggttga

SEQ ID NO: 6708 - DNA, 225 bp, Methylobacterium sp.
atgaccgaacgagacccgtaccggcacgaggatccgatctggtacgatcggatcgaggcggatgagccgccaggcttgatcctcgatctgctggcgcacgtgttcgtgccgatcatggcggctctcggtgcggtgagagcgctgtactggctaccgactcgactgtggggccgggcctcgcgctcgctcctgcgccatcggaccaccgctgcgaagcgtccctga

SEQ ID NO: 6709 - DNA, 201 bp, Methylobacterium sp.
atgagcgacgcgcccgatccgaagcggaagacgatcgccgacagcgtgttggttcgtctcagcacgttcgcgctgggcatcggcctgtacgagggcatcgcccagagcatcgtcgagaaggcggttgccgacatgccggaggccaccgtcgagcagatcgcggcggcggcgcagatgatgatgctgttcgtgtcgggctga

SEQ ID NO: 6710 - DNA, 1026 bp, Methylobacterium sp.
atggcgcgctgcgtgccgaggctacgcatgcaaccgttcttctcgacagagggaattcaccccaaggacgcgttccggcgctggcgggagacgatctgcgagcgattgatcccgatcgaccagcaaccccttcacggggttccgtttcagggcaggctggacgtcaccagcatcgggcctgtgccgatctccaaaatggcacacacagccatgcggactgaagcgacccccgacgcgatccggcgccacgggcagcccgaccgcctctacgcgtccatgaagctctccggccaagacgccatccagcaaggcgatcgggaggctgtattccggacgggcgacttcgtcgttgtcgacgcacgcccggccgtctgcgaggcaaacacgggcatctcccttgtcatcgatctgccgcgcgagcgcttcgaggccatgctgggcccgtcccggctgtactgcgcactcacggtcggcgcggacctcgcctccacgaccctggcaaacaccttcctccaggagctggtgcgcgtgggcgatcagctcacgcccgacgcggccgcgcgcatggcggcgatcggaacggacctgatcatagcgagcctcgccgaacggatggcgcaggaggtaccccgttccgtccacggcaacgtcacggtccagcgcgccaaggcctatgtcgaggcgaacctgagcgacccgaacctggatccgccacaactcgccgccgcgatgggcgtgtcgctgcgccggctccaggaactgttccacgagcgcggccggcacatctccgactacatctggggacgccggctggaggcggcagccaagcgcctgggcgatccggcctgcgcccacctgtcgatcggcatgctggcttacggctgcggcttcgccagccaagcgcatttcgcgcgccgcttcaaagatcgctacaacatgagcccccgggactaccggcaggcgcacaggcgagacacgcaatcgggcgcgtcggcgtcccagccatcattatcgtcacctgagtga

SEQ ID NO: 6711 - DNA, 264 bp, Methylobacterium sp.
atgatcgtccgcgtgacactcatcgggcggaactgcgcgccgttctacgccgtcgatcaggcacaactgcaggagatcggaaccacgcttttctcgcagtcgctcgatcgcttcggccaggatcggctgctgaaggccatgaatgtcgccgagactgaagacacagccgcgctccgcgagggcggcgccgctttctggtgtcctctccagcgcgcctacctcaacagcctgagaatgcgaggcctgatcgggcgacagcggtag

SEQ ID NO: 6712 - DNA, 123 bp, Methylobacterium sp.
atggatcgcttcctcacgatgatcatggtcgcaggcggcgtggcgacggtggtgtggatcgccgcgatgctggtggtcggctggcaaatggccgtcgtgctgatgggactgagcgcagtctga

SEQ ID NO: 6713 - DNA, 117 bp, Methylobacterium sp.
atgaccaagccgatcaccctgacgaaccgtctcgtcgacgccgtcgtgacggccgccattgcgttcagtctcgtcgtgcacgcgcaggtcatgatcctgccgccgcacttcgtgtga

SEQ ID NO: 6714 - DNA, 111 bp, Methylobacterium sp.
gtgaccctggactcgcaccgccccggcgacgtgccgcgggcgcgcggctggcgcgtgatggttccagggggcggcatcgtcgtgacggtctgcgaggcggagcccggctga

SEQ ID NO: 6715 - DNA, 447 bp, Methylobacterium sp.
atgtcgaagctcagcctgtccctgaacgcggttcggcccggagccgacgatcacccccggccgcacgtcgccctgcgggacgaggccagcgcgatcgccgcggccgtgcgggtcttcgaggacgggctgacggatctgcgcgcgggcgtgccggtcgcggacgacgccgcttccgccgcggcggcggccgacgcggcgaccggcctcctggccggcatcgccggtcagaccagtctgatggcgctccgggccgcgatcgaggcggcccgcgacggcggagagggccggggcttcgcggccgcggccgcggaggtcagggacctggccgggcagatggtgcgggcgaccgacacgatcgtggcccaggtcggccagatccaggccgcggcggagcgggcgcaggataccgcgacccgggggcagcgccaggctgcgtccgcgcactga

SEQ ID NO: 6716 - DNA, 288 bp, Methylobacterium sp.
atgagcgcgcgcgacgccgcggatgccggacggcggcactggttctacgacagccggatcctggtctgcaccttctgcctgctcgcggtcatggtcatcttctggcaggtgagccggttcgagggtttccagccgatcttcacctgcgcccggaatcaggacgtcgatcgcgacctgctctccgtcgggatgcgcgcctgcatgggcgacgcgccctcgcaggccgcccaggcgcgctgcatgcacgtcgtctacctgctggcctgcacagacgagcggtggcgctga

SEQ ID NO: 6717 - DNA, 273 bp, Methylobacterium sp.
atgacgtccaccgctctcgccgtgatgatggccggcgtcctgggggccttctgcacgatcgtgttcgcggtcgactgggtacccggctccgtggtcggattgccgaacctgccgagccggcgcgtgatcggcctgtgggtctacaacggcgttctgtgcctcgccctggccgcttggttggtgtgcacctatttctgcaccgtcgacggctacgaggacattcccgcggtgcgcgacagctactgcaggccgcacgcgaccgtaggcgcgtga

SEQ ID NO: 6718 - DNA, 246 bp, Methylobacterium sp.
gtgatcccgatgtcgggcggcatgctcggttccctggccctggcggccgtcttcacgctggggtgcttcggcatccacagcgcgcgccggcatccggacgcggtgaccataggcctgttcctcctgctcggcttgctcgcgtccctgtatgtcggccggcacgtcggaccggacgtgcaccaacccacgtggcagcacgaggccctgtatcgcgagagcgcgccgacgtcgcatccgacaatgtga

SEQ ID NO: 6719 - DNA, 192 bp, Methylobacterium sp.
gtggacccccagccattcaccatcgacaccgaggcccaggctcagacgtacctgaccgatctcctcaacaatccgaagaaccggtcgatgagcgagatcgcgagacactgcgccctgcgggtccgcaacccgaagatcaaggcgttctttctgaccgagggcgcgaagatgctcgccgagatgaaggcctag

SEQ ID NO: 6720 - DNA, 153 bp, Methylobacterium sp.
atgctcgctcgcccgttccgcctgttcgccccggcgctcgcagccctcggactcgtggccctgcgcctcgcgagcccgttcatcgggccggtgtcgcccccgcaagcgggcgcgaccgacgacgcgggcgtcgtcttccggcactatctctga

SEQ ID NO: 6721 - DNA, 666 bp, Methylobacterium sp.
atgtcggtcaatacggtttcgggcagttcactccagcgggatctcgtcagcgccctcaggcaggcgcgggcggcgaacgctgcccgcctcgacgtcggcaccgccgcgacggcgaaccaggagaccggcaagcaggcggccgcggacgacaccgccccgtcgaccgggacggcctcgacgccgacgctgtcgaacgacctgatggcgtcgctcctccagctgcaatcggacttcagccagatggggctgcagaacggcgtcacggcgcccgcggaagccgcggccaacgccgacgactcgtcgacgaccggcaccgccaccggtgcggcgcccggtcaggccgcgggcggcgcgcccgccgtccatcaccatcgcggccatcacggccaccggccggtgtcggatgccgagcagagcgagggtgcggcccaggccggcgccgcggccgacgcgtccgcggcctcatccgcgatctcgtccgcgagcacgtccaccagcacgtccgcgagcacgtccgccaccgcgagcaccgatcccgcgacggcgacgggcagcggcagcgacctgcaatccttcctgcagcaggtgaccaaggcggtgaccgcctacgcggccggcggaccgctcggcatcgcggccgcgctgaccagcaccaccaaggcctga

SEQ ID NO: 6722 - DNA, 222 bp, Methylobacterium sp.
gtgcccagtcgcttctatttcgacatcgagaacggcgaggagacgatccgcgacgcgcagggcgtggaggccgcggacctggccgaggcgctcgcggaggcccgcagcgtgatcgacgaaatggcgggtgaactggaggccgcgggaccggccggcgcgtggacgctcgtcgtacgcgacgccaccggcgcggaggtcggccgggtgccgatcaagggctga

SEQ ID NO: 6723 - DNA, 228 bp, Methylobacterium sp.
atgcccctctcccagaacgtcccgcacgccgcccgccaagcggacgcgatggctgcccagatggcgctggccgcccacgcgctgcggatgcgcggcgatgtcggggccgccgagtcgctcctcgcgatggcgcgacacaaccggatcctcgcgctcaagctgcggatcgcgcaggagctggcgccgggccaaggccgcgccgagcgccgggccaccgccggccgttag

SEQ ID NO: 6724 - DNA, 216 bp, Methylobacterium sp.
atgaaatcctgcaacgtggatgctgggacgcaacggctgtcgggcgccgcccgcaagagcttcatggcagattgcctcgcgggaaagagcgccgcgccggccaaggagctgacgccgcagcagatgaagatgaagagctgcaatgcggatgcctcggccaagagcctcaagggcgccgagcgcaaggcgttcatgagcacgtgcctcagaggttag

SEQ ID NO: 6725 - DNA, 738 bp, Methylobacterium sp.
atgctgctgctgggcatcgtgcaatcggccctgttcgcgcccatccacgagaccgtccacctgaccgccttccgcgcgcgccgggccaacgcggtcgtcggctggctggccgcctgcccgtcgctgctgaactggcacttctacacggcgttccacctcgcccatcaccgtcacacccaggatcccgagcgggatccggaactcgcgctgatgccgccctcgaccctggacgcctatctctggcgcgtcctggccctgccctactggcgcacccgcctccaggtggcctgggcgggcctgcgtggcgatctgtcggcctacccgttcatcaccgatcgcgcggcgccccgcatcatccgctcgatccgcttgatgtgcgcggtcctgctcgccggcgcggccctcgccatcggtctgatcggctggtgggcgcccctggtctactggatcgggccgcagctcctcgggcaaccgtttctaaggctttatctgctcacggagcacacgctctgcacgatggacgacaacggcctgaccaacacgcgcacgaccttgaccaacggcctcatgcggctcctcatgtggaacatgcctttccacaccgagcaccacctctacccatcgatcccgttccacctcctgccggatgcccacgcggcgctgcgcgcgcggctcggcgtgctgcagcggggctatgcccgctggcatgtcggcttcgtgcggacgttgcgcccgtga

SEQ ID NO: 6726 - DNA, 189 bp, Methylobacterium sp.
gtgctcgtcgtgctcctcgtcagtgtggggctgatgatcgccgccctggccggcctgatgatctggcagagcgagaccgcgccgcccgattacgccagccagagccaggccgccgcccgcaaggccgtcaccggctccgagagcgggtcggtcggggcccctccggccgggacgcgatccgcgccctga

SEQ ID NO: 6727 - DNA, 198 bp, Methylobacterium sp.
atgcgcgggaaagacggcccggataagccaccgaccgagcccgcaccggcagcccgcccgcgcggcttctttcggcgcgtgctcgacggtctcgaagccgtcgagctgctggtccaggcgggccggctggtctggtggctcctgagaggcctgtggctggccgccggcgcgatcgtgcgcctcttcggggatcgctga

SEQ ID NO: 6728 - DNA, 1212 bp, Methylobacterium sp.
atgcaagcgcactttgcggggatcgacaacccgaacccgatgatcggcccggcccgcctgatccgggcggccttcgagggcgccgacatggccgccctggccgccgagatcctcgccgagggcggcgactctgccctcgacgccgggacggcgctggacatggcgacgatcctgctgctgaagcaccgcttcaccgaggggctcgcgctccagagcgaggtgctggacggacagcgggtgttctcgctgcgctcgaacccggatcaggcgcggatccgcgtcctcgtcctggtcacggccggcgacctcatggccaatacgccgatcgacttcctgctgaacgacggcgatttcggcctcacctacctctatctccgccccggcgagccggtgccgcacgacctgccggcgcacgacgtcatcgtcacgggtatcgcctacgcgcggaccgccgagccgctcctggaagccctcgcggcggcggcggaccagtggacgcggccgatcgtcaatcacccgcgccacgtcctcaagacgtcccgccacgggatcgcggacgcgctccgcggggcgaaggggatcctggcgccggacgtcgtccgcgtgagccggtccatcctgagcgccgcggcgtcccgcatagccgagggcccgacgtacccgctcctcgtgcggcccctggacacgcacgccggcaacgacctccagaagatcgaccgggcggaggacctgcatctctacctcgcgcagacggatgccgaggcgttctacgtcacgcaattctgcgattatcgcggtcccgacggcctctaccggaagctgcgcgtcgtgctgatcgacggtgtgccctacctctgccacatggccatccgcgatcactggatgatccactacctcaacgccggcatgctggaggatccggtgaagcggcaggtcgaggccgccgccatggccacgttcgacaccgacttcgccgagcgccaccgcgccgcgttcgccgagatccaccgcaggatcggcctggattacctgatcatcgactgcgccgagagcgcggacggccggctgctgatcttcgaggccgataccgggatggtcgtccacgacatggattcggaggagctgtttccctacaaggctccgcagatgcgccgggtcttcgccgcgttccaggacgcgctgcgggggcgggtccgcgggcggaccgcctag

SEQ ID NO: 6729 - DNA, 498 bp, Methylobacterium sp.
ttggccatcctcttcgcgggaatcgcactgatctcaacggcgcaaggcggtctgtccctccgtcagctggccgggatcggagaggctgcgacggcgctggccagggactgggtgccctccctcgagaaggtcggcgcgatcgaagtggcggcctccgaggtgcgcatcaagcagttccggctcgtcctgctgtcggatacgtcggagcaccgggacgccaatgaagccgccctcgcgaagacgcacgcgcagctgcgcgacgcgcgccgggcctacgaaccgctgatcaccaccgccgacgagcggcggcactacgacgcgttccacgcgtcctgggcccgatacgcggaggtggatcgggaggtgcggcggcacgtggaggcggggcggcggacggaggcgaccgcgctgctggtccggcccgacgtcgtggcgctggacgacggcgcccgcgcggccctggcccgtctggtggaccacgacgagacgtcggcgtag

SEQ ID NO: 6730 - DNA, 120 bp, Methylobacterium sp.
atgaccgaggcagaggtcgggccggaggtcggggcggaggccgaggcggtcgagcggcacaaggccgagacggagaccgccgcgggcgatgtggccgacgacctcgccgatttcgcgtaa

SEQ ID NO: 6731 - DNA, 183 bp, Methylobacterium sp.
atgcgcctgatctacgccttcctcgcggtccggatgctccggctcgcccgcttcgatctgtttcggcacgagctgctgatggctgacgcggatgcggccctctctcgttcgcgggagcgggtgcggatcgccgaagccttggcagctcgggcagacctgccatcgctggcggccgggcggtga

SEQ ID NO: 6732 - DNA, 219 bp, Methylobacterium sp.
atgaaggagcgcaaccccgccttcgaggtcgtctcccgcatggaagacgacgtggccaacatcaagcgctgggccgaggtgctgagcctgctcggctcgacgcatcacatgattgagccaggcgtcccccatgtcatcgcccggtcgctcaaggagatcgccgatcggctcagcgagcagtgggacgaggccttcgagatcgtggcaggtcggcgatga

SEQ ID NO: 6733 - DNA, 702 bp, Methylobacterium sp.
atgggtaagcggttcaccgcgacgctggccgtgctcctgtccctcgccctgcccgtcaccgccgcgacgctccacagcacctacatcgacccggcggcgatggcgctgcagcgcgtcctgccgcccccgcctgaggccggttcggaagcggccaaggtggacatgcaggccgtggaaactgccgtccgcgcccgctcgcccgacgacgagcgccgcatcatcgcgaacctgccgtgcaccctcgaccgcttcaccggggttctcggaccgaccttcaccgcggagacgatgccggtcaccgcagcgctgatcgagcatgtgttccaagacggcgaactcgccgtgctggcggccaaggccgccatcgcccggccgcgcccctacacggtgaagccggacctcgccacgttcgggcatcgctccgacagcacgtcctacccgagcggccacgccacgttcgggtatctcgcggccacggtgctgtcgcgcctcgtgcccgggaaacgtcaggcgctgttcgcgttcgcggcctcctacggggagaaccggatgatcgccggcacccatttcccgtccgacctcgaagccgggaagatcgctgcggccgtcatcgcggaggtgctgttccgcgaccctcgcttcgaacgggatctcgaccgggcgaccgcggaaatcgcggcccagggagcctccggtcgttga

SEQ ID NO: 6734 - DNA, 798 bp, Methylobacterium sp.
atgattctctccccgctgaacgccctgttcgtcggccccctcgagggctaccgggatcggatcgtgtccgcggaggatccgcgcccctccgtgaggggcgccgacctgctcgatccgcgcgtcctgaccgaccagctcgaccggttcgcccgcaccttcgcggcgccggagccccgcgccgtcgcgtcgatctgggcgaagcagcacttctcgatgctggtggtgcccgcgctcgcggccaacatcgtgctcgacctcgtcctgcccgtggccctcgacgccgtcgagatcgtcccggacgacggcgggctgacgcgggcgctcaagctgcgcggccccgccgcggggagcgacaggtccggcgggcagaccggggagagggcgccggcggatcgcttcggcgcgctgatcgacgcgcacctggcgcccctggtcggtgccctggcggcggtctcgggcgtggcgccgcgcgtgctgtggagcaatgccggcaacatcttcgagttcgtggtgcgccgcaccgaggggctcccgcaggcgggccggaccgggcacgcggccgccgcgagcgtcctgacgagccgtcgccggtccggcgcgcccaacccgctgttcgcgccgatccgctacgtcccggaggcgggggacgcaccggcgggcgcgccgccgcggcgggtgcggaaggtctgctgcctgcgctacctcatccccgaccagagcctctgcggcgcctgccccctgccggcacgccccgaagcgggtccggcgggaacgcacggcccgaggaggcccgcatga

SEQ ID NO: 6735 - DNA, 294 bp, Methylobacterium sp.
atgcgcaagctcgctctcatctccgccgtcaccctgtccctcggcgcgctcggcgccaccggcgcccaggcgcagggttatggctacggctacggcggccaccacggctacggctacggctacggccgcggctatgatcgcggctacggccaccggcgcgatttcggctaccgccgtcaccgcggcctgtcgaccggggccgccatcggtctcggcatcgcgggcgcggccgccggcgccgccgcggcgggcgccttcgaccggggcccgggctattacggccgcggttactga

SEQ ID NO: 6736 - DNA, 180 bp, Methylobacterium sp.
atgtccgcgcttgtcacgttcgtcggctgcggcctggtcctggcggggttcgcggccgagaagttcgccgagcatcgctggctcgcggcgagccggcccgcaccgctcgacaccctcgcggtcctggcgctggcgctgccggccgtcgggctcacgctgatggcgacgctcgcggtctga

SEQ ID NO: 6737 - DNA, 165 bp, Methylobacterium sp.
atgctcgatgtcgccttctggtggtgcgtggccgtggccttgaccggatcggtcggcctcgtcggcttggccgtcgtcgccggccggagcggccgctcgcagccgcgcggcctcaagctttcccggaccgagcccctcgtgctccgtcacttcgggcgcgcgtag

SEQ ID NO: 6738 - DNA, 198 bp, Methylobacterium sp.
atgcatttcgagatccgcgcgaccgacacccgtctgtggacctgggtcctcctcgatgcgacgcagatgccggtcctgacatcggaccgcaccttcccctcggaagcccaggcctcggcggcggcgctggccttcgccaagctcgtcacgcgggccggcaggaccctcaccgccgcaccgccgggcggcctgatctga

SEQ ID NO: 6739 - DNA, 528 bp, Methylobacterium sp.
ttgcgcgcggccggctatgtcggcgcctggacagcggacgtgtcggcgggacaatccctcctcgacgaggggacggcggcgctgctcgccggggatgcgaccctggccgggcgcccgctgcccatcgagatcgcccttcgatgcacccatccggacgatcgcgactgggtcttcgcgcgcatcgcccgggtgcgccagaccggcggccccgtctcggccgagtaccgcgtcctcacggacggcggcgaggttcgatgggttctcgaccgtggcagcctcacgcccgatccggcgggacggatgcgcggtcgcggcatcatcatcgacaccacggacagccaccgcggccccttccttccgagcgcggcgggcgatctgccggcggacgacccgatggtcctcgcgatcgatcacctcctgcaggcgcgcgcggcgatcgtcgcgatgggccaccagcggctgcaacaggtgtcggatctggcgctgttcgaggtcgggcgagcgctggcgcggcgcgctcgggcgtag

SEQ ID NO: 6740 - DNA, 483 bp, Methylobacterium sp.
gtgctcgcggcggcgctcgtgacggcgctcgcggcggcatcgaccgccagagccgagcccgccaatcaggtgctggggacgtggcgcatggtgtccgcgcggctcgatccggaggggcgcaacgcgccggcctacggcgcgcgcccgagcgggctgctggtgttcacgcgcgacatgcacttcgtcgaggtgcttacggacgccgacattccccggttcgcctcgagcgcgcgcggtcaggggaccgcggaggagaaccgggcggccatggctggcagcatcgggttcttcggcacctacacggtggacgccgacggcgcgttcagcggcaaccgcgtcgagggctcgaccttcccgaactgggtcggcgacgtgcgtacgaccgagcagcttcgcctgaccgtcgaggggggccggctgagcgagagcttccggcgcccggacggtacgcggatcgccatcacgtgggagcgcgtccgctga

SEQ ID NO: 6741 - DNA, 303 bp, Methylobacterium sp.
gtgatccgaacggatcccgatttcgaacacgccgtgatcggcggattcaagctggtcgaagacgcctacgcgcgcgggatcatctcttggatgcgccggtgcgcgttgcgggacctgttggcgagcggcgagtccgagctgtacgagaggcgcacctatgtgacgccgcattcggacccggatgcgatccagatcggcgtctacttggaaccgacttcggccttcctgatcgaactcggtctgctgacgccggagatgaccgcgcccgaacaggccgattccggggccgaccgcgagcgctag

SEQ ID NO: 6742 - DNA, 1635 bp, Methylobacterium sp.
atgcgacgcgacgagggtgacgggcgcacggtctccgatggcatccagcacgagcgctcgccgatgaggcgccgcgaggtcctcgccgccctggccgccgccgcggtcgcgcggcccgccgtcgcgcagcccgccaaggttctgcgcttcatcccggaaagcgacgtcgcggtgatcgacccgatctggacgacggcgaccgtgacgcgcaaccacggctacctcgttttcgacaccctctacggccagaccgcgggctacgagttccagccgcagatggtcgagggccacgccgtcgaggcggatggccgcctctggcgcctgaccctgcgcgagggcctgcgcttccacgacggcgcgccggtgctggcgcgcgacgcggtggcgagcgtgcgccgcttcgccgcccgcgacgccttcggccgggcgctgatcgacgccaccgacgaactcgcggcgacctccgaccgcgtcgtgcagttccgcctcaagcggccgttcccgctgctgcccgcggctctgggcaagaccggcacctcgatgccctgcatcatgccggagcgcctggcgaagaccgacccgaacacgcaggtcaccgagatggtcggctcgggcccgttccgcttcaaggcggacgagcgcgtcccgggggcgctcaccgtctacgagcgcttcgacggctacgtgccccgcccggacggcgcggcgagcttcaccgccggaccgaagcgggcccatttcgagcggatcgagtggcggatcgtgcccgacgcctccaccgccgcgagcgcgctggcggccggcgaggtcgactggtggcagaacccgacgccggatctgcaggcgctgctcaggagcagatcggggatccggctggaggtgctcgatccggccggcggcatcggctgcctgcgcttcaaccacctgcatccgcccttcgacaatcccgcgatcctgcgggcgctgctcggcgccatcgaccagaccgagttcatgagcgcggtcgcgggcgacgagcgcgccctgtggaaggaccatgtcggcgtcttcagccccgaggcgccgatggcgacgcgcgcgggcaccgacgggctggtcggcccccgcgactacgccgcggtcaggcgcgccctggcggaggccggctaccggggcgagcgcgtcgtcatgctcgacccgaccgattacccggccacccatcccctggccctcctcgcggccgaagccttccagaaatgcgggctcgccgtggacctcgtcgcgatggactgggggaccctggtgcagcgccgggcgagccgccagcccccggacaagggcggctggagcaccttcgtcacctacctgaacggcaccaacaacttcgatcccgccggccagctcggcatccgcggcaacggcgaccaggcctggttcggatggccccgcgcgccccgtctcgaggagctgcgcgccgcgtggttcaccgcgcccgattctgcggcgcagaaggcgatctgcgccgagatccagcgacagttcttcatcgacgtgccgtacctgccgctcggcgcctattacgaggcgacagcctatcggggcctgacgggcgtgcgcaacggcttcccgcaattctacgatgtcaggccggcctag

SEQ ID NO: 6743 - DNA, 1182 bp, Methylobacterium sp.
atgcggactgcgccagccttctcctcccgccacctcgaccgcctcggcgaccgcctgacggccgatgtcgacagcggcgcgatcgccggggccgacatgctcgtcggcggcgcggacggggcgatctggcgacgcaccgtcggctaccgcgaccgcgtcgcgcacgcgcccctcgggcccgacgcgctctggcgcatctactccatgaccaaggttgtcgtctccgccgctaccatggtgctcgccgagcgcggcgcactgcgcctcgatcagcccgtggcggcattcattcccgccttcgagcacctgtcggtgcttgatccggacggcggcctcaggcccgccagggccaggccgaccgttcaggatctcctgcgccacaccgccgggatcgcctacggctatctcggcgacgggccggcgcggcgcgcctacgcggccgacggcctgctcgccgaggatctcgacaacgcggcgttcgccgaccggatcgcccgcctgccgctggagcacgagcccggcacggtgtggcactactcgcacgccaccgacgtgctcggccgcgtcctggagatctcgggcggcgcggatcttcagcgggtcctcgacgcgaccgtgctcgagccgctcggcatggccgacaccctgttccagatctcggccgcgatgggatcacgcgtcgcgcagccgctgccgcaagcaccggggcagcgccctgtctttcacgatcccgcgcagccgcggcgcggccagaggggcaatggcggcctcgtatcgagcacggcggactgcgcccgcttcctgcgcatgcttctcgccggcggcagtctcgacggcgcgcgcgtcctggcgccggccagcgtgcggctcatgacctcggatcatctcgggccggcgatcgcgaaggccgcctactatccgccggggccgggctacggcttcgggctcggtgtggcggtccgcctcgcggcgggagaggcgccgttccccggcaatgtcggcgactggttctggagcggcgtcggaggcacatacttctgggttgaccctgtagaggggttcttcgcgctcctgatgatgcagacctcctcggccgaccagcggcagcactaccgcacgctgacccgcaccatggtctacgccgccctggaggaccgtcgactgtccgagacggccccctga

SEQ ID NO: 6744 - DNA, 255 bp, Methylobacterium sp.
atgcctcagaatgtcgaatactggatcacggaccgaccggacggccgcttcgacgttgtggtcaggctcgagtccggaaaaatctttcgccgccgcgggtgtgtctcgcggaccgaggccgatacgtggatcgagggattgcgaatgctgatggcggcgatcggcgcgcccgtatcggctgccgacgtgacgtctgacgacccatcgcccctcggatctcagccggtggacggtgcggatcactccacctcctga

SEQ ID NO: 6745 - DNA, 390 bp, Methylobacterium sp.
atgtcgcaccccgtggactggaacgcgttcgccgacgcgtggtgcgccgcctggaacgcgcacgatgtcgagcgggtgctggcccatttccacgacgacgccgtgttcacctcgccgggtgccgcgcggatcgtccccgcttcgggcggaacggtgcggggcaaggatgcgctgcgcgcctactggacggaggccctgcggcggatcccggacctccacttcgcggtggagcaggtcttcgcgggcatcgacacgctggtgatccagtatcgcaaccagaagggtgtgagcgtcagcgaggtgctcgtcttcgaggacggccgcgtgcgggcggggcacggcacctacccgatcggcgtcgacaaccccgtcggtgccgcggcgggctag

SEQ ID NO: 6746 - DNA, 693 bp, Methylobacterium sp.
atgaagtcagaaaaaataacctggcgggcatccgggtcccgcgagcgcctgtacgacgacgcttgcggcacggccctcgcgctggagttcatcggcgagcgctggtcgctgctgatcatgcgcgagctggtctacggcccccggcggttcggcgagatccgggcgaacctcccggggatcagcgcgaacgtgctgacgcagcggctggagagcctgggagcggcgggtatcgtcctgcgttaccggctgccgtcgccggccaacgtgcaggtctacgatctcaccgactggggccgcgaggccgcgcccctgatgcgcgacctgggccgctgggccgcccgctcaccgcggcacgacccgagcctgttcatgtcggcggcgtcggccatgatgtcgcttcaggccctggtcgaccgcgggcgggcggcggcgctgtcggcgacggtcgcgttccacttccccggcgaggatttcgtcgcgacggtggccggcggcgagatccgcgtccgccggggcgtcgcggaggcacccgacctcgctttcacaggcgacacgatggcgctgcgccgcacgatctacggcaaggcgcccctggaccgggacggcgccggcggcacgctcgccgtcgcggggtcggtcgacttggcgcgatctttcatcgacctcttcaccctgccggtcaaagcgggctga

SEQ ID NO: 6747 - DNA, 213 bp, Methylobacterium sp.
atggacgggagcgacagcgcggggccgaccatgtacgacctcatccacaccctccgcctctggctgtggcgccgccaagtgcgggccatggcgcgggagtgccggatgtccgggaccagcgacggcgactggatcgccgccaccgtcgcggcctccgcgacgagctcgggtccaggcgcgccggtctcgtacgtgagcggcaccggcctgtag

SEQ ID NO: 6748 - DNA, 276 bp, Methylobacterium sp.
atgcccacactcggcctcaagctcccgctccggatctgcgtcctcgagaacgccgcctgcgtcgaggatgccggcggccggcgcaccggctacgtctactgggacgagggccgttcgggaggcggtgacaggcccttcacccgcgccgaggccatcgagcaggtccggatcatcgcgggcgcctgggccggcgccctggtccacagcggcaccctcgacaccggcccggcgcccgagccgggtgccgctgccgccgagccgtctccggaaggctga

SEQ ID NO: 6749 - DNA, 255 bp, Methylobacterium sp.
atgaggatcctgacccgtacgacgctgctcgccgccgtcctcgccggcgcggcggggaccgctcacgccgccgagggccagggcaaggccggcgggcgccaggatgccggcgcgcccacgaccagcatgggcgcgggcggcctcagcggcaccggctccacccaggagggcgcccgcacgggcccggtcgagagcaaggggcagccgggcggcgcgaagccgccctccgccccgaaggccgggacgggccgctga

SEQ ID NO: 6750 - DNA, 1104 bp, Methylobacterium sp.
atgacccgcctgcgcctcatcgccgacgatctcaccggcaccctcgacacggccgcgggcttcaccggcctgtgcgggtcgatcccggtggcgtggccggagatcctggcgggggacggatccggctgcttggcgatcgattccggcacccgggaaggctcggccgcggaggccgcccggatcgtcggcgccctcgcgcccaggctggacggggccgacatcgccttcaagaaggtcgacagcctgctgcgcggcccctgggcggccgaactcgcggccgtgctgcgcgccggggcctggaagcgctgcgtggtggcgccggccttcccgtatcagggacgccgcacggagggcgggcggcagctcgcccggcacggcgcgggcttcgagccggtctccggcgacatcgccgaggccctgcgggcggtcgggctgccggcgcgccgggccgacgtctccgacggccccgtggcgggcgtcgccgtctacgacgcggcgagcgacgccgacctcgcccgggtcgcggatctcggcggcgacggaccggtgctctggtgcggcagcggcggcctcgcggcggccctggcgcgcggcgtggcggcgccgggcgacgaccggctcgccggcccggtcctcgggctgttcggctcggaccggcccgagaccgcggcgcagctcgcggccggcggcccccaccacctcgtcctgtcggcgcgccatccggaccatgccggcgcggtggccgcgcgcctcgaccgggacggcgtcgtcctggcgagcctcgcgctgcccgagggcaccgcccgggaggaggccgcggcgcggatcgccgcgaccttcgcgggggtgatcgaccgcgtcccgcggcccggcacgctgctggtggccggcggcgagaccctgaaggcgctgtgcctcgccctctccgtctcgcgcctcgacgtcaccgggcagatcaccccgggcctgccccgctcgacactgcggggcggacgctgggacgggctcgcggtcgtgtccaaatccggcgccttcggaactgagggcgtctggcgcgatctacttcacggcaacggctttccgcgcagcaggagcgacgcgtga

SEQ ID NO: 6751 - DNA, 246 bp, Methylobacterium sp.
atgccggcctatcacctccgacgcaccctcgagcacgcggacggccgctgcggcctcgccttcgccagcgaccgcctggaggcggacgacgcggaggcggcgatccgctgcgcccgcgacctgtgccggaccgccgccaacatgctcctgaccggggcggtgctgaccgattccctcggccggatcctgtggtcgttcaccctggcgctggcccgggagccgctctgcgtccggccgacgagctga

SEQ ID NO: 6752 - DNA, 123 bp, Methylobacterium sp.
gtgaactacgactggatcttcgtaacgttcggcattccggcgatcacgttggcgatcgcctacgcggccgtgcgtgcgaacgagcgtgccgcgcggcgcctcgatccccccgcgggcgagtag

SEQ ID NO: 6753 - DNA, 768 bp, Methylobacterium sp.
atgaccttccgcctgacgcgcctgttcgacctgaccgggcggacggctctggtgacggggggcaactccgggctcgggctggcgctggcccgcgcgctgggcctcgccggggccgggctgatcttgacggcccgccgcgaggccgacctcgcggcggcggccgaggacttgcgggcggaggcggtcgccagcgaggttctgcccgccgatctcgcggagcccgccgcggtcgccgacctcgtcgcgcggctcgacggccggccggtcgacatcctcgtgaacgccgcggggatgaacctgcgccaacccttcgcggccgtgacggccgaggccttcgaccggcacatggccctgcacgtgcgcgcgcccttcctcctgacccaggccctcgcgccggggatggctgaccgcggatacgggcggatcatcaacgtcgcctccctgcaatcctaccgggccttcccggactccgcgccctacggcgccgccaagggcgcggtggtgcagctcacccgcgccgtcgcggaagcgtggtcgacccgcggcgtcacctgcaacgcgatcgcgcccggcttcttcccgacgccgctgacgcaggcggtgttcgccgatgccgagcgcgccgcgcgcaacgccgcccagacggcctgcggccgcaacggcgaactcaccgacctctacggcgcggcggtgttcctcgcctccgaggcctccgcctacgtcaccgggcagacgctgccggtcgacgggggattcaccgccaaatga

SEQ ID NO: 6754 - DNA, 195 bp, Methylobacterium sp.
gtgttcgccggtcggggccagtggcgtgggccggacggacggatcgtccgcgaggccgcccgcatcgtcctcatcgtcaccgaaccgacgcccgaggcggtcgcggccttgcgtgagatccaggaggcctaccggcgccgcttcgcgcagggcgcggtcgggctggtgctgcagcggagctgcgcgctgttctga

SEQ ID NO: 6755 - DNA, 207 bp, Methylobacterium sp.
atgagcgatcgacagaagctctactgcaccgcgacccaggtccgtcgacggtacggcggcatctccgagatgggtctgtggcggtggattcacgatgggaaggtcaacttcccgaagcccgacctgatcgtgaacggccggcggctctggagcgaggccagcctcgacgccttcgatgcgcgtcagatggtgaaggaggccgcgtaa

SEQ ID NO: 6756 - DNA, 1089 bp, Methylobacterium sp.
atgaacgcggcagagacccgccagttgagcctgtgggagcagagcctgcggcgccccgaggccggagccgaccggccgacgaccaggctcggccccgcgctcgacggccgcatggatgtgtcgttcctccacaagggcttctgcatcgccggcctgccgctgcgccggcccaagaacacgatggagccgtggaaccggcgcgacggtcgcttctcgctgaccgtcgagccggcccggttcgtcctgcccaacgggcgccagatcgaggtgggcgtcccgttcggacccaaggcgcgcctcctctccatgtggctggccacggaggcccgcgatccgcgccggagcgccggcgaccgctggatggagatggggcggatcaccgagtggttgaaggccgtcggtttgccggtcacgggcggcgagcggggctcgatcgggccgaccaaggaccagctcgtccggctgagcttccccatcttcacgatggtcctgaacggcgacgagggcggccacgtgttcaagcgcgagagcctgatcgaggggggcgcgttcaaggatgacgacctcgaggtctgggccgccgggggacacagcgccatgcgctggccggaagcgctgatgctcagccagaacgcctacgaccgcttcacacggcactcgatcccggtgccgaccgccaggctgcgccaggtcgcccacaacgccatggcgatcgatatcctcgtgtacctctgctaccggctgccgctgctctcgcgcggggagagcgaattgctgacctggcgcgatctgatggcgcagttcggatcctcggaattcgcctcccgcttcaagcaggccttctcggaatcgatcaagcgcaccctcgacgcgtacccggaagccaacgtcgcgatgacggccgagggtctggtgctgcggcactcggacccggcggagctgcggcgcgccttcgtcgccgtcgcgggggggccgacccgtcgcgcccgtgccgcgccgcgggcgcgcaaggctgcgcgggtcccggatcagatgggcccctgcgagagcgcggacctgctgacgccggccggtgccgcgcgcggctga

SEQ ID NO: 6757 - DNA, 189 bp, Methylobacterium sp.
atgactcgaatcctgacatccgtcctcgacggcgccgcgtgggtcgccgacgcgctcgacgatatcctcgtcgaggcggctctcggcttcggcgccgccgtaccgctgatcgccgatccgtccggcgatccgccaaccggcgcaaccaccggcacatccgagaccggcgccccgccgatccggacttga

SEQ ID NO: 6758 - DNA, 300 bp, Methylobacterium sp.
atgggcgaggccgtctccgggacctacaccgccgccgatcccggcttcgcgcagacgcatcgaagccgcatcctggtcggcacggccgagggcgacatcatcggcttcgtgaccagcacgtcgtcgccccaggagatcacggcctggaccgggcgcctcgtccggaccgacgagaagacggccgaggcgatccacgcggtcttccacgccgtcgaacggtcctcgcagccgaaggccgtgaccggccacgtcgcgctcgagacgaccatcttctcgaaggtcgagaacgcctgttcgtga

SEQ ID NO: 6759 - DNA, 345 bp, Methylobacterium sp.
atgaagatgatctcgacgaagatgttgatggtggcgggtctcgcggccgcgacgttggcctgtggtgccgccagtgccgacgcccgcgggtttggccgtggcggtttcggacacggcggcttcggccatcacggaggcttcggccatcgcgggttcgggcacggaggcttcaggcacggcgggttcggtcaccatcgccatttctaccaccgtggattccgtcggcgcttcggcgggttcagctggggctatcccgcgaacagcctcttcctcggcccgcaattcggcgactgccgcgcgatctacaatcctgtcttcttcggccatgagcgcgtgtgcggctag

SEQ ID NO: 6760 - DNA, 303 bp, Methylobacterium sp.
atgaggggcgtgtgccccctcctacggagccgtgagcccgcgatggccgacctcatcgatttccccgggaaacgccgaggcgccggctctgcctaccggctgcaccggttcggcgcggacggcagcgaccgcggcacggtcctcatccgagcccgcgacgacgcggaggccaggcatcaggccgacaggctggccgaaggattgttggccgagctgtggtccggggaccggctcctggatcacttcgcgccggccgaccacccggttgcgggctgcatcggtcccctgcgcgacgggccctga

SEQ ID NO: 6761 - DNA, 1191 bp, Methylobacterium sp.
gtgccgcgccggtcggccggccggcggcgtgccggcgcgcccgcggggatcctgtccctcgtcctgttcctctccctgtgttccgcggccgccgcgccgctcgccgcggagcccgtccgggccgagacccgggaggcggcgcccgcgctccgcacgaccgagcccgagacgtggcgggtcgcgacgcatccggtgccgcccctggtcatggacgaggacggccggctgcgcgggttcagcatcgatctctggaacgccatcgcgcgggagctcggcgtccggacggcgtacctgcgcgtcgacgacctgccggcgctgttcgcggcggtctcggacgggcgcgcggacctcgccatcgcggcggtgtcgatcaccgcggagcgcgagcggcggttcgacttctccgtcacgatgctggagaccggcctgcgcatcgccgtccggtcggagccggacgcgaccggctccgccaccgcgcgggccctccgggccctcctgagcgacgccgccttcctgcaggtcctgctggggctcgccgccctgatcctggcggtggcggccctggtctggtggctcgagcggcgccaccccggcggcatggcggcgcgctcgggaccggcgcgcggcttcgcccacgtcgtctggtgggccctgagcagcctcgccgcccaggcggaggagatgccgcgcagcccgctggcgcgggccgtcaccgtgctctggctgttcacctgcatcgccctggtggcgtggttcaccgcgggcctgaccagcacggcgaccgtggagcgcctgcgcggcgcgatcaacggccagcaggacctgccgggcaagcgggtgggcacggtcgccaacaccacctcggtcgcctacctggcggaccatttcgccacgccggtgggtttcgcgaccctggaggaggcctgcgcggcgctccaggccggcacggtcgcggcggtggtctacgatgcccccgcgctcagctactacgcgacccggcccggccacgaggccctgcgcctggtcgggacggccttcaaccggcaatcctacggcatcctgttcccggccagcgatccccggcgcaagcgcgtgaaccaggccctgctgggcctgcgggaggacggccgctacgacgagatctacggccgctggttcggctccgagagcggcgagtcccagggtcgctga

SEQ ID NO: 6762 - DNA, 243 bp, Methylobacterium sp.
atgcgcgcgaagatcctcgtcctgtccttcggcctgatctgcgccggcgcgggacccgtctgggccgcccggccggtcctcggccggctgcccagcgccgtcgcgcaggccacgcccgggaccggaagcgcgccgatcctgagcgccgggatcgcgggggcgcccgccctgaccgtgctcgcccgccgcaagccggcccggcgcccgcgcggcgcgcgcctcggcagcctccggccgctctga

SEQ ID NO: 6763 - DNA, 177 bp, Methylobacterium sp.
atgcggccctcctcacgcgcgttcctcggttgcctggtgctggcgctgctgatcggcggcctcggactcggcctgcgccgcgccgtggccgtcaccccggtcgatcccgcgttccgggcggtgctgcgcgcttatgcggcaccggacgcgtccggcgggccccagcaacacgagtga

SEQ ID NO: 6764 - DNA, 1014 bp, Methylobacterium sp.
atgaccatcagggacgccctgctcgccggcccgctcggcttcggcgccgcaccgctcggcaacatgttccgcgacatccccgaccacgaggcggaagccacggtcgacgcggcgtggcaggccggcacgcgctacttcgacaccgcgcccttctacgggagcggcctgtctgagatcaggctcggcaaggccctgtcgaagtatccgcgcgatgcgtaccgcctcagcaccaaggtgggccgcctcatcctcgacgaggtcgagaccggcgctcgcgaccagggcgagaagggcgagatcttcaggtacgggcgcccgaacaaggtcgtctacgactacacggccgacggcgccaagcgctccatcgaggacagcctgaggcgcatgggcgtcgaccggctcgacttcgtgtgggtccacgacatcgccagggattttcacggcgacaagtggatcgggctgttcgagcaggcgcacaccggggcctttcccgccctcgaccgtctgcgcgacgagggcgtgatcgaggcctggggcctcggggtgaacaacgtcgagccggtggagcttctgctctcgctcgacgaggtgcgcccgaacggcaccctgctcgcgggccgctacacgctcctcgaccatggaagggcgcttgagcgcctgatgccggccgcggtcgagaggaaggtcgagatcgtcatcggcggtccgtacagctcgggcgtgctcgcgggcggtgcgcacttcgagtacggctcggtgccgcccgagatcgccgccaaggtcgagaccatcaaggcgctgtgcggcaagcacggcgtgccgatcaaggcggcggcgctccacttctcgctcgcccatcccgcctcggccgcggtcatccccggggcgagccgcccggagcggatcgcggaggaccacgccgccatcggcttcgaggtgtccggggatttctggcgcgacctgcgccggagcggggtcgtggcgcccgacgcgcccctcccgtccggtcagtag

SEQ ID NO: 6765 - DNA, 150 bp, Methylobacterium sp.
gtgcccgagtacgacatcaagatcgtcgctccgcgagatcggaaagctccggacgcaaagcgcgagactccgcccaagcgcaagctcgactgggatcgcgccatgcgcgaggccgcggaagcggaactctcgatccagtcgcacgactga

SEQ ID NO: 6766 - DNA, 294 bp, Methylobacterium sp.
ttgaacgagcccgaacagggcagcgcggaggccgtctacatctcggccatggtcggcgagatgatgcggcgcgtcctggaggacgctctcgccgaactcgcgagaacccgcggtgcggccttcctggagatcttcgtggcgcgcgagctggctcgctgcgccgagctgttccgcgagcggcccggcgacacgccggagacgacggacatgttgcgggcctggttcgccatggagggcggcgaggcgctgcgcgccgtggtcgatcgcgccagcgtcgaggcggcgcgcgattga

SEQ ID NO: 6767 - DNA, 222 bp, Methylobacterium sp.
ttgcaggcgttcgacgagcaattggcgcatgaactcgtccgcggcctcgtacagtcggccgtcgcgcgcggtctcgatccagccatccggctcgatcagtttcggacgttgcagcaagcggccgtcgctctatcgcgagacgctgccgtagttcgaaccagcgagcagatcgtccgggcgatcgactgcgctctcgaggaactgaccgcggtgagatcgtaa

SEQ ID NO: 6768 - DNA, 2073 bp, Methylobacterium sp.
atggaggcgtactatggtgcggaccgggcgctgctcggcttccagtgccgcttcgaccgggcggacggcagcaagacattccagccccttaccctgttccgcgagacggccactggcgcgctcaagtggaggtggaagggttggccgggtcctcggcccctctacggcctcgaccgtctcgccgcgaggcccgaggcgcccgtgctgttgtgcgagggcgagaaggcggccgacgcggccggcgagctggcgcccgacttcgtcgcgatcacgagcccgaatgggagcaagtcggcgggtaaggccgattggagcccgctcaagggacggcgagtcgttatttggcgcgatgctgacctggccggcttggaatacgctgaggccgcggcggccctgatcctcgcagccggcgcggcatcggtctcgctcatcgatccgcccggtgaggcgccgcagggatgggatgcggccgacgccatcgccgagggctggcccaccgttcgcgtcctgagcctcgtggcgagcgcgcggccggtcgggaggctcgcggagcgtcccgcgtccggcgggcgtctggcgccaactcccgcgccagtagaggcgcctccggccgaggacgtgggcaggcggggtccggggcgcccaccctggcacgacacccttctcgggctgacggaggattacatcctctggcacacgccgaaaaagcacgcctatgcctcgatccctcgacctgaaggccaccgagagaactggcggctcaacggcgaggcgttcgctcgggagctgagcctcaaggcattcgaggagacgaaccggatcccgtccaaggcggcgatcgaggagaccgtgcgcatccttgaggcgaaagccatcgcctacggcccgtgtcggaaggaatggctccgcgtcggcgagcgcgacggcaagctgtacgtcgacctcgggtgccctcagtggcgcgcggtggaaatcagcccgcgtgggcctgagatcctgcaaagccacgatctcccgttcgtgcggcccgaggggatgcaggcgctcccggagcccgtgtttggcgaggagaacgccattggcgacctgcgggccttcgtgaatgcgaacagcgacgaggactttcagctgatcgtcgcgtgggtcctgggcgcactgcgcgcggctaaggagtacccgctcctcatcctcaacggcgaacagggaaccggcaagtcgaccttgagccgcctcctgcggtctatcgtcgacccgaacgcggctggcatgctgtcggctccgaaagaggatcgggacctcttcgtcttggcgcagcatgcgcacctggtcgccctcgacaacctgtcgaaggtcgagaactggatgtcggatagcctctgcatcctggcgacgggcggagccctggcgtcccgctcgatgtacacggacgccggcctgacgatccttgaggcgacccggcccgtcattctcaacgggatcccgaccctcgccgatcgccccgaccttgcccaacgctccatcaccgtgcggttgaagccggttccggccgaggagcggcggacgtcgaccgacattgagcgcgagtgggaggccgccgcgccgcgcatcctcgggacgttcctcgaagctctcgcccgtgggctacaggacgtcgataaggtcgccctcgataagctgccgcgcatggccgggttcgcccgcttcatggttgcggcggcccccggcctcggtcccgacttcgacggccaagggctgttcaatgcctacctcgccaaccaatccgagctggcaagctctgcattcgagaacgatccggtagccactgccatcgtggcgctgatgcaggccgcctattccggtgagtggcaggggacgccgacagagctgttgcaggccctctcggatccggccgtgacgcccgaacgggtcacaaacagttgggcatggccgaagaaggcgcagaccctcggcaacgcggtcgagcgcattgcccctgccctgcgcgaccgtgggatcgacgtgcgcaagcggcattcgggcaagacgttctacgagatccggtcccggtcctga

SEQ ID NO: 6769 - DNA, 228 bp, Methylobacterium sp.
atgttggacggcgacgcctttgcccacgagatcgcggcgctcctgatcgccgacatcaagacctccggcgcgcgcacgcgcggcgagatcgaggaggcctgccggatctccctcgagagcctgctcggcggcaccgcggtgccgccgcagatcgccgtgctgatgccgatcggcctggagcggtggccgcgggtggtcgtgaagggacggcccctgcccgacgtgtag

SEQ ID NO: 6770 - DNA, 99 bp, Methylobacterium sp.
atgctgcgcaagctcctgacggccttcatcgtgccgaagctcatcgcctatctcgggcgccgctatgaccggcgccggggcaccggccgcccctactga

SEQ ID NO: 6771 - DNA, 693 bp, Methylobacterium sp.
ttgcccgcgcccccgtcgcgcttcgacgccgtcctcctcgacctcgacggcaccctcgtcgacagcctggccgatctccggacggccctgaacgccaccctggcgcgggagggtctgccgccggtcgggaccgccgcgatgcgggccatggtgggcgacggcgcggtggcgctgctgcggcgcgccctgcgggcctcgggcggcgatccggagcgggcgccggacctgctcccggccttcctggccgtgtacgagccgctcgcggccgccggcaccgccctgttccccaacgccgccgcggcggtccgcgacctccgggcggcgggctacgcgctggcgatcgtcaccaacaagccggcccgcgccaccggcctgatcctcgacgcggtggggctggcgccgctgatcgacacggtcgtgggcggcgacacgctgcccgagcgcaagcccgatcccgcgccgctgcgggaggccttgcgtcgcctgcgggtcgagcccgggcgggccgtcatggtcggcgacatgcaccacgacatcgcggccgcccgcgccgccggcaccgccgccatcctggcccgctacggctacgggcgcccggacgacgcgcggaccgccgacgccgtcctcgacgacatcggcggcctgcgggcgatgatcggggcgctgcccgcgggcggcgccccggcctcctag

SEQ ID NO: 6772 - DNA, 1572 bp, Methylobacterium sp.
atgaggcgacgcaccttcctggccgcgggggccgcggccctggcggccccctccgtcgggcgggcgcagggcgcccgggtcctgcgcatggtcccccaggcgaacgtcacctccatcgacccgatctggacgacggcgatcgtcacccgcaaccacgcctacgtgatctacgacacgctgttcggcctcgacgccgacctgcggccgcagccgcagatggcggccggcctcaaggtcgagcaggacgggcgccgggtgacgatccccctgcgcgcgggcctgcgcttccacgacggcacgccggtcctggcgcgcgactgcgtcgccagcatccggcgctgggcggcgcgcaacggcttcggccagaccctgatggccgccaccgacgaactcgcccacgacggcgacaccgacatcgtgttccgcctgaaggcgccgttcccgctcctgccgcaggcgctggcgagcgtcagccagccggccttcgtcatgcccgagcgggtctcccagaccgacccgtacaagcagatcaccgacgccaccggctccgggccgttccgctggaaggccgacgagttcaactcgggcagcctgatggtctacgagcgccaccccggctacgtgccggcgcccggcacgccgagcctgacggccggcggcaaggtcgcccatttcgaccggatcgagtggcggatcatcgccgacggcgccaccgcggcggcggccctgcagaacggcgagatcgactggtacgagcagccgccgcccgagctccagcagctgctcgcccgcaaccgcgacatcgtggtggagggcctcgaccggctcaccaacccggcgatcctgcggatgaaccacctgcagccgcccttcgacgacgtcgcggtgcgccgggcggtgctgccggcgatcgtccagagcgacttcatggcggcgatcgtcggcgacgatcccgcggcctacgacgaccgctgcgggatcttcacgccgggcacgccgatggcgagccaggccggcctggaggcgctcaccgggccgcgcagcctggaggcggcccgggcggcgctcagggcctcgggctacgacggcgcgaagatccggctgatcggccccacggacctgctggcgcccgcggcgctgacccaggtcgcggccgacctgctcccccggatcggcttcaacgtcgatctggccctgagcgactggggcacggtgatccagcggcgcgtctcccgcgagcccgtcgagaagggcggctggtcggtgctgctcaccaccttctcgtccttcgacaacgccgaccccgccgccctgcagccgctccgggccagcgggccgaacgcgtggttcggctggccgtcggtgccgcggctggaggcgctgcggaccgcgtggttcgcggcctccgacgcggaggcgcgccgggcgatctgcgccgacatgcagcggatcgccctcgaggaggtcgtgttcgtgccggtcggctcctaccgctcgatgacgtcctaccggcgcgacctcacgggccgcctcccgggcttcccgatcctctggaacctccggcgcgcctga

SEQ ID NO: 6773 - DNA, 2484 bp, Methylobacterium sp.
atgaccggcgcggcgatgaccggggcgccggacacccccgcggcggcggcgacccgggcgctgacccccgagcagcgcgcctgcctcgacgcggccggcgccgtgccgaacctcgtcgccgagatcgacctgcccgggccggtcgacgcggaccgcctccgccgcggcctcgccgcggtcgccgcccgccacgacgccctgcgcaccgccttcgtgcgcgaacagggcttccgcggcctgcgccaggccgaggccgctgcgcccgcgatcccgctcgataccggcgcgcggcagggagacgtcgggaccgtcggcctcgtgccagagcgcggccagaccctcgcggccgtcctcctgccgggcgcgacgccgcggctccgcctcgtcgccagcgctctggcggtcgatgccggcagcctcgaccgcgtcctgtcggaagtcgcggccgtctgcgcggccgacgcggcgcccggcgccgatcccgaggccgcgacctacgcccagtacgcggcgtggcgcgaggcggtcgccgccgacgacgcggacggcgagggccaagcctactggcgggaccatctcggcgcgggcgcggcgcccctccggctgccctatcgccgcggggtggccgccgacgcggtggaggagccggccgccgcgacccggctgagtcgggccgtcgacgccgccgtcacggacgccttcgcgcgggcgctggcccggccggacctcgccgcggccggcgccgaggccgtgctccaggccgcgtggtggctgctcgtggcgcgcctcgccgagcggacggagatcctcggcggctgggcgcacgattgccggcgcgactacgcggttttcgccggcacggtcggtgtcttcaccaagacgctgcccctgcgcctcgccctcccggcggagaccagcgtctcggaggccgccgccggtctcgccgcgcggctcgacgagcaccgcgccttccaggaactctgccccctcgacgcggccggcgacgaccgccgccccgcggtcggcttcgcgctcgcggcccagggggccgcgcaggaccggctcctgccaggacccgccgggttcgagctctgcctggagccggccctcgacgcggaggggcgcctcgccgcgctgaccttgcacgccgacccgcaccgctacgcggtggaggccctggagaccctgctcgatcaggtcgagacgctcctcgcccgcctgcccgcgaaggccgcgacgcccttcgcgacctaccccctcgtcggcgcgcgcgaggaggcgcgcctgcgcgcgttcgggcgcccggccccctgcgccctgccggcggagacccttccggtcctcgtcgcccgccacgcggcggcggcgccggacgcccccgccctcgtcggcgccggccgcaccctgtcgtacgccgcgctggaggatcgcgtcgcgcgcctcggcgcctggttcgccgcgcacggcgtcggtcccgagcgcgtcgtcgccctggacctgccgcgctccgtcgacctagtggtggcgatcctcgcggtctggcgcgcggggggcgcctacctgcccctcgacccggcctggccgcaggcccgccgcgaccgcctgatcgcgctcgcccggcccgcgctgaccgtggcgctctcggccgacaccgcggccggccggcacgccctcggggcgatcctcgacggcctcggtgaggcccggcgccccgccgaggcccgggacccctccgacatggcctgcctactcttcacctccggctcgtccgggacgccgaagggcgtggtgatcgagcatgcccagatccgcgcctacgtggaggccgtcatcgacgccctcgacctgtccggccacgggcgcttcgcgctgacctccacggtggcggccgacctcggcaacaccatgctgttcgcggcgctgcgcctcggcgcctgcctcgtggtcgccgacgaggccgagatggccgacggcccggccttcgcgcgcttcctgcgcgccaacgccgtcgcctgcgcgaaactggtcccgtcccacctcgccgccctcctcgacggcgtcgaggaccccgcgctgcccgccctgctggtgctcggcggcgagccgacgccggccgccctggtccggcggatccgggcggcggcgccggcgacgcggatcgccaaccattacggtcccaccgaggcctgtgtcggcgtgctggtgcatccggacgcggccaccgcgccgccggacgagagcctgccgctgagccgcgtgctcgccggcagcgaggcctacatcctcgacgcggcgggcgcgctcgcgccgaccggcgcggtcggcgtgctccacctcgggggcgcccagatctgccgcggctacctcccgggcacggaggccggcggcacgggcgcgttctcgcccaaccccttcggagcggggcggctctaccgcaccggcgaccgggcccgcctgctgcccggcggccgcctcgtgctcgcc

SEQ ID NO: 6774 - DNA, 1269 bp, Methylobacterium sp.
atggtctcgagaatcgtcgtgatcggcggcggcttcgccggtctgtgggccgccgccgccgccgcgcgcgcccggaccgagttcggcctcgacgaccgcgtcgcggtcacggtgatcgcgccggacccgttccacgtcatccgggtccgctgctacgagaccgatctcagcgccctgcgcgtgcccctcgacgacgttctcggtccgatcggcgtggaacgccgcgaggcgcgcgcgatcgatatcgatcccgcggcgcgcacggtcacggtcgagtccgccgcgtcgtccgccgcgtcgtccggcgtcgtcgagacgctggcgtacgaccgcctcatcctcgccgccggaagtctgctgtggcgccccgagatcccgggaatcgcgagcgccttcgatgtcgacaccttcgcgggggcccaggccctcgcggcgcatctcgatcgcctcggtgacgcgggcgggccggatgaggccggccgctggaccgccgtcgtcatcggcggcggcctggtgggactggagctcgcctgcgagctgcccgcccggctcgccgctgccagggaccgggccggggccacgggtccggtgcggaccattctgatcgaccacgcgcgcgaggtcgggagcgccatgggcgcggcggccctgccggggatccgcgaggccttgcgcgatgccggcgtgacctgcatcggcggtgcgcgggtcggtgccgtcgatcgcgccggggtgacgctggcggacgggacgcacgtcccggcgcggacgagtgtctgcgccaccggcatgcgggcgagcccgctgggcggcacgctcggcctcccccgcgacccgctcgggcgcctgccggtcgacgccttcctggcggtccaggggatcgctggcgtctacgcggccggcgacatcgcctcggctgcggcggacgatgccggtcatcgcacggtgatgtcgtgccagcatgcccggccgatggggcggttcgcgggcttcaacgccgtctgcgatctcgccggccggccggagcggcggctgcgcttcgccgcgcccgactacgtcaccgtgctggatctgggcgcctggggggcggtctacaccgccggctgggatcgcggcacgctggtctcgtcgggcgccgccgcgaaggcgacgaagcggatcatcaacggcacgcgcatctatccgcccctcgaccgcgacgccgcgtccatcctggccgcggccgcgccgatcatccaggccgcgcccgcgacgcaggccgcgcgatga

SEQ ID NO: 6775 - DNA, 1113 bp, Methylobacterium sp.
atgctccggtcggtgtcccgggcgagcccgcgcccggcggccggcctgctgatcctggcctgcggggtcggtctggccggccccgcccgcgccgagcctgcgcccgctccggccacggccgcggccacgccggggacgggggcggccgacgggacgcccgtcccggccgcggtccgcgcgcggcgccaggaggccggcgtcgccgtcgcggccgccaccgtgatggcggcgccgccgccgtccttcttcaacttctccgacactgtggtgagctaccgcttccaggggccctcggcggagcccggcctccgggtccagcgtcccgacggccagttcgtggggcgcgaggtccccaagaccgtcatcaacctgttccacgccaacgcgtgggcctacggcaccaacctgctctccctcgacatcctccggtccggatcccaggacccggccggcaatcaggtccgccggttcgagggcgtcggcgccaccgagttctacctggtctaccggggcgtcctgagcctcaacaaggtcttcgacacgcaggccctggccatccccggcttcgtgaaggatgtcggcctgtcgttcggggccgacgtcaacaccaaggacacgaccttcgactccgagaagcgcgccggaaccttcgggctgagcttcgccttcgacgtgccggccgggttcgtgaacctgaaggtccagggctacaaggagttctcccgcaacggcttcgccggatacgggccggttccgggcttcgactacgcgcacttccgcagcgtcgagttcaagatgacgccggaattcgagatcacctacacgatcccgctgccgttcaccgggctgccgctgtcgctggccggcttcaacacgatcgtgctgcccaaggggcgctacggtcgattcaacgagaacgacacccagctggaattcgtctcccagaccaacctcgtgctcgatgtcgggcagctcgtcgccggcacgcccaaccgggtcgaggtcttcgccgggttccagtactggcacaacaagttcggggccgacccgcggcgcacgctcaacaccgaggagaaggcgctgatcgccggggtggcctaccacctgaaatga

SEQ ID NO: 6776 - DNA, 1032 bp, Methylobacterium sp.
atgggcaaccgacgcgaattcctgaccgccacggccgcgggcctcgccgccgccgccgcggcgccggcccgggccgccgaggagcgcacggcggctccgaagtccacgccggcgggggcgccgcccttcggcatgccccgcgacatggtcctcctcaacatgcgccgcggcgacggctacgccctgggcgtgaagaccaaggacggcgtgctcgacgtcgaggccgccggccgggcgctcgggatgccggtccccgccgacatggacgacctcctgcagaacgggcgcggcccggccctgcgcgccctgatcgacgcggtcgaggccgcccccgacgggcgcttcgtgctggcggaagccggcgtcgcctacgcgccggtggtcacgcggcccgagaagatcatcatgatgggcttcaactaccgccaccacgcggaggagaccggcacgccgatccccaaggacccgccgctgttcaacaagtacaacaacgccctgaaccaccacggcggcacgatcgcgctgccgacccaggcggcgcgggaattcgactacgagaccgagctggtgatggtgttcggccgcgagtgccggaacgtgtccgaggcggacgccctcgattatctcgccggctactgcacgggcaacgatttcagcgcccgggacctccagacgctgacctcgcagttcatgatcggcaagacctcggacgggttcgcgccgctcggcccctacctggtgaccgccgaccgggtgaaggacccgaacaacctcaagctcaagacgctggtcaacggccgggtgcgccaggactggagcaccaacgacatgatcttcaactgccgccagctcatcagcttcgcgtccaaagtgatgacgatcaagccgggagacatcttctacaccggcaccccgcagggggtgatcttcggcgagaagatcccgcgcaaggaccgcgcgtggctgaagcccggcgacgaggtcgtgtccgagctggaagggctcggtgagctgcgcttcaggctggtctga

SEQ ID NO: 6777 - DNA, 324 bp, Methylobacterium sp.
atgcggtccatcctcgccgccaccctgctgctggcgatcgctgtcccggccggggcccagagcctgtcggcatcgctggagccgatcacccccatcgccaatccgggccagctgagcctcggcggcagttccaccaccgggccgttcccgaccgtctcggcgcagaccggcggcctcgtgaatgctggccagctgagcttcggcggtggcggtggcggtggaggtggtggccgcatcggcgcgtcgggcggcctctcggccgggacgacgctcggcaccacgaccgccggttcgggcggggcgggccagctcggcggcctggga

SEQ ID NO: 6778 - DNA, 702 bp, Methylobacterium sp.
accgcgactggcggttccggcgtcaccggcacgaccctcgggaccggcgggacgatcggcgccaccggtgcccgcagcggcctcagcggcgcgtcccgcacgggcctgggctcgacagcggggagcctcctgacatcgaccctcggaacgggcggtctcgggggcgggccgggcctgtcccccggcctgggcaccggcctgggcaccggactctcgggagccggcctcggcgcaggtgtcggcgcaggcgtcggcgcaggtgttggcgcaggcgtcggcgcaggtgtcggcgcgggcctcaacgctgccggaagcctcggctcctcgctcgcgaccggctcgtccggcgtcgcgtcgcccggtctcggcagcggcgtggccgcgtcgggcatcggcgcggcgggcgccaccctgtcctccggcggtctgttcgggctgttcgggctcgggaccggaacggccgcgagcgggacctcggccgtgacggttttcggggcggccggtgccggcacgggcgtcgccgggatcgccgggacgcccgggctgcccgcggacgatcccgcccaggcggcccgcaccctgccgaccggcggcggagcgatcggcggtgccggaatcggcggcgcggcggccgcgccggtccggaccggcgacctctgcggcgggcccttcgccgaagcctgcctcggccaggggttctga

SEQ ID NO: 6779 - DNA, 792 bp, Methylobacterium sp.
atggaaggcatgaaagccctggatcttcgtcagccgcatgagcgggtcacgatcctcctcgtgatctgcctgccaacggaaggcctcattacgggcttcgaggctggaaggtggacgatcgtcggacgcttcgagcagatcgagcacgccaagcggcgccttcgtcgcctaatgcattttttggagcatctcgaggcgcgggcattcatcatccaggagacggttccgcggcagtccagcaaacgcgccccctggcttaccctcgtccgcttcagagagcccgagctctatctggatcagtccgacgccgtggaggcttccgaggaggctctggagagctgggctgcgattgcggactctttcgttgcgccttcggccatgaaagcgaagcccgcgccctcgaaacggaatcccatcgccatcgccgcattgatggcaacagccgtggtggcgctgatcggcataatcgcggctctccaagcgctgagcattaagctgagcaacgccatcccttcggcgttcacccgtgcgggcggcatcacgatgtcaatccccgacgagcaccgtgccggctggtatgtgcgcgtgaagatctatccggacaagtcggtcgagatcatcgatcgcttcccggcctacgcaaggggtaagcattggaaggagggcgacatgacgccggaggaactggcggcggatgtcaagcgcccgttgaccgccgacggcaacctcatggacactccggacccgatccctgcgcggacaggggtcgccgccgccttgcggcagaattga

SEQ ID NO: 6780 - DNA, 222 bp, Methylobacterium sp.
atggcacagtgcatggcacagtcgtcgggccacgaggtcccgacccagacccgcgccgtcgccgagaccggtctcgagcaggcccggacggccttcggaagtgtcgtcggagcggcgcgccgcgcctccgacacggtccgaacgaccccggtgcgagggcaggatgcggcccgggaagcggcggccgcggctcgcgacgccgccgggacggcgtcgccctga

SEQ ID NO: 6781 - DNA, 186 bp, Methylobacterium sp.
atgacgcgcgcgcgcgagaccgcagacccgacgagccgcggaccggacgcgcgcgaggcggacgagcccccggcggagcgcgtcaaggcggagccggccacgatcccgaccgaggatcccgaggtcggcctatcgcagaagggcagcggggaagaggcgatcgtccggcgcgagacggagatctga

SEQ ID NO: 6782 - DNA, 255 bp, Methylobacterium sp.
atggccctgaagaccacctacctcgtgcaaccgttcgagctgcaccggaaccgcctgcggccggcccgtcaggagcccgcgcagagcgagttcggcgcgctcaagaaggcggaggcgctggccgcccgcatgccgggcgcggcggccctcagggtcgtggccgacgacgagaccggggaactcgagggcgtcaccatcctcggccagttcgggaccgttccggacgatttcgccgagagcctgctggggggctga

SEQ ID NO: 6783 - DNA, 144 bp, Methylobacterium sp.
atggattggttcgacctgcccgaagacccccagccgccgtcggccgccgacgagagccggatgcggctctacatcgccgcggggctgatcggcatcggcgccctcggcatggtcggcgggatgctgcacatcctccccgcctga

SEQ ID NO: 6784 - DNA, 261 bp, Methylobacterium sp.
atggccacgcccgagacccaggcgccctaccggctgcagtgcatgatccaccgggaaagcgccggcggcatcatcattcacgacgagcagattcccgggcccctcgtggaggcggcggtcgccgccgccaaggcccgcttcgcggagctgcgcgccggccgcgcgggctcggcggccctgcgggattccgccgggcgggtggtctggtcggcccggcaggacgccgcgacgcccggcaccgggggatcggcaacccggtag

SEQ ID NO: 6785 - DNA, 96 bp, Methylobacterium sp.
atgaccgacacgccggccccgtatctcgcggtggcgttcctctcggcgctgtgcctgctcgtggccgggctgcaggcggagggcctcctgtggtga

SEQ ID NO: 6786 - DNA, 93 bp, Methylobacterium sp.
atggggctggtcgccttcatcgtcttcgtctgtccctggatgggcatcgccggcctgctgtggatgcgggcacagcaggccaagccactctga

SEQ ID NO: 6787 - DNA, 1515 bp, Methylobacterium sp.
atgaagcagcggacgcaggagctccgtgcggtggaacggcccgcgcgcgcagtatcgtccgaggacggccctcgggaggacatcgaccggacaaccgaggcgcacgaggccttcctcaagtcctggaacacctatgtgccgaccatcaggacggcggacgagctgaagcgcgctcgaggtctgtgggacgcgtggcagcatttcctcgccgtgggggcggaggccggcgccctcgacagggccggggaacgcgatctcgccgaccgggtgcggacgacggcgcttcaggccgacgcggaagccgtcgcacgggatatcgacacgctgctgaccgaccacgacgccgcggttgccgagcaactcggagctgtcgacgccgccggctcgacctttcgcccgagcctcgtggccggcttgtccactgctgcgctggctgccctggtcttggtgcaggccaccctgcgcggcgtcgcgcagccgatgacagcgctggcctccgccatgcagcgactggccgtccacgatctcaccgtcgccatcccgccggtaacgggctgcaccgagctcgcagtcatggcggccgcgacgagagctcttcaggaaacgctgcggcaggccgtgcggcgggatgcggaggctgaccagttgcgcgctcagagcgagcggcgccgcaccgtgatcgaacaggcgaccgagcgggtcgagaccaagatcggcggcatggtcgaggctgtgtcttcgtccgccgcggcgctgcgcgtcaccgccgacgacatgggccgggcgatccgcgatcgggcggttcgatcgaccacgatgggcgccgcgctcgcacagacgcgatcgaaggtccggcggtgcgccgtgtccgccgagacgttcggcgcggcggtcgaagaggtcggggcgcaggccgagtccaccgcgaccctggccggaagcgccgccgcggacgcggcccggacgaccgcccgcgttcaggcgctgagcagcgccgtcgaccgcatcggcgacgcggtccgcatcatcgccaagatcgccgcacagacgaacctgctggccctcaatgccgcgatcgaggccgcccgggccggcgacgcgggccgcggcttcgcggtggtcgcttccgaagtgaaggccctggccgcgcagaccagggaggccaccgatctcatcggccagcacgtctccgagatccgtggctcgaccgacgcggcggtgtcggcgatcgcgggcatcacggcgcgggtcgaagacatgagccgcgcggcgaacgccatcgtcgattccgtggagcggcagggtgcgaccgcgcgggagatcgtgacggccttcgcggaggcgaccgacggcaccgagcggttcgacgcggagggtgcgggcgtcgccgagatgcccgaggcggccgagccggcgacgaccgccgtgctgaccgcggccgacgacctgacccaggacgccgcccgtctcggcgaggcgctcgcaggcctcctggagagcctccgtgcggcgtga

SEQ ID NO: 6788 - DNA, 825 bp, Methylobacterium sp.
atgctgagctacctgggtgacaagatcgtcggcctgaccctcgcggtcctgaacgcgctcgcgccgctcgaagtccacgtggacaagggcgtcccctatgccgacgggagcgcgcaccgggccgacatctaccggccggccggcgggaagccgcgtccggtcgccgtgttcctgtacggcggcgggtggcggaccggatcgaaggacgaggttgcctacgtgggcgcggccttcgcgcggcggggcgtcgtcgcagtcatccccgagtaccgccacgtcccggcggcgagcctccagaacatcctcgcggacaacgccgccgccgtcgcctggaccatcgcgcacgcggccgagtacggcggcgatcccgcccgcgtcaccgtcgtggggcattcctcgggggcctgggccgccgcgatgctgggcctcgacgcgacctggctccagcgggccggctcgagtcccgccaagctcgccgggatcgtcgggctggccgggccctacgcgacttcggcgctgaccgatccgctggaccgccgggtgttcgcgggcagcgatccggccctgcagccgatcaaccacgccgcggatccccatccggcgatgctgctggccaccggcgcggcggatctcgacgtcaaccccgccggaaccctggcgctcgaccgggagctgcgcggcttcgacggcagagagacgatgaagatctaccccggtatcgggcacgggcagatcgttcacgcgatgagcttcccgttcagcctccggtactcggtcgcggacgacgtcgcgcgtttcgtcaagggcgcccgtgccggcccgtga

SEQ ID NO: 6789 - DNA, 246 bp, Methylobacterium sp.
atgcgcatcacagtcagggatcaggtgaaggccgccatcatcggcaccatggccgaagcgcagaaggaagggcgctgtccgttggcagcggccgaggctgcctttcccggcacgccgaccgtcgtcttgggcggctgctacggcgagatgctgtcggacgatgaggacgcttggtggaagaggatcgagcacaccatcgatgccgaggtcatccgcaacgctgtcgcctctgcctccgcccagtga

SEQ ID NO: 6790 - DNA, 408 bp, Methylobacterium sp.
atggaccacctgaccgaccaccgttcaaccttcatgctggagaaggtcggcgcgatcgtcgcggcctacgtctcgcgcaacgcgatcgaggtcacggcgctgccggccctgatcgaccaagtgcacacggcgatcgcggtgctccgctgcgcgccgtcggagttcggtggggtcgggctgagccagtcgcaggtcgatgcctcgatccagcaggacggcctgatcagcttcatcgacggccggtcctaccagaccctgaagcgccacctcacggcgcacggcctcacccccgagcggtaccgggccaagtacggcctgccggccgactacccgatggtggccccgggctacgccgcgcggcgctcggagatcgcccgggcgatccagctcggccacaaggcggcctga

SEQ ID NO: 6791 - DNA, 114 bp, Methylobacterium sp.
atgttcgcccagccccacgccctcatcctccgccatcgcgagcgcgtcgccgtgctcatctcctccgcgctgttcctggcgggcgccctgccgctcttctgggcgatcggctga

SEQ ID NO: 6792 - DNA, 273 bp, Methylobacterium sp.
atgacccgaaccctcttccgctccgcgggcctggccctgctgagcctggccgtcccggccaccctcgcggcccaaggcctggcgcccgaccagaccggcacgggcggcggcccggccacgacgatcacggcgccgaacaccaacagcctcggcgtgaccaagccccccggcacgtccctcggcccgggcgaggtgccgccgcgcgccgtgcaggagcacgagcgcgcccggctcaacaagatcgagcgcagcatctgcgacggctgcaactga

SEQ ID NO: 6793 - DNA, 972 bp, Methylobacterium sp.
atgccggcagacatcctcgacgaactcgggccgctgttcctgggcagccgcctcaagcgcctcgccgaccgcttccaggccgacgccgcccggatcctgcgggacgaggggctcggcatccagccggcccagttcccgctcctcgccgccatcgaccgctacggcccgctgaccatcggcgacgccgccgccgccctcggcgtcagccagccggcggccacgcgcacggcggcgagcctcgtcgcgctcggcttgctcgaagaggcgcggtcggacgcggaccttcgccagaaggcgctgtcgctcagcgatgcgggcgaggccctgatggcgcgcgccaaggacgcgctctggccgcgcgtcgacagggccgtcgcgagcctgtgtgccggcctgtcgggccccctgctggaccaggtcgccgcgctggagcgcaggctcgacgccgtcccgttcgcggcccgcatccgccaggacggcgcggccggcgacgccgcgacgggcctgacgatccgggactacaccgacgcgctggcggaccgcttccgcgacatcaacgccgagtggatcgaggcgatgttcgcgctggaggagaacgaccgccggatgctgtccgatccccgcggcgagatcctggaccgcggcgggctcatcctgttcgtcgagtcggcggatctcgggatcgtcggcacctgcgcgctgatgcggacggaggcgggctgctacgagttgaccaagatggccgtgtccgcgcgggcccgaggccgcaaggccggcgagcacctgctgcgggcggtgctggcccgggccgaggccatgacggtcgagacgctctacctgctgaccaacaccaagtgcgcggccgccgtgcacctgtacgagaaggtcgggttccggcacgacccggagatcatggaccggttcggccggcgctatgcccgctgcaacgtggccatgcgctatcccctgtga

SEQ ID NO: 6794 - DNA, 1245 bp, Methylobacterium sp.
atggacatgcaggtcgagaaagcccagggccggcctctgaaaggcatcgaccggaacaaggtgatcgcgcagtcgctgcggcagttcgcgcgcctcccgggcctgcccgacaccaagaagggcgtgcgctcgtaccagagccacgtcaaaagcgacccctggctgccgctcctgttcgtcgtctgcttcgtcctgccgaccctggccgccgggatctactacgggctgatcgcctccgaccgctacgtcaccgaggcgcggttcgcgatccggccgaccatcggcaccgccgacaaggcgacgcccgacacggtcggcacgaatgccggtgtgatcaaggcgaccgtcgcccaggaaacgctcatcgcgcaggagtacatccacagccggcccatggtcgaagcggtcgcggcggaactcccgatccgcgcgtggttcggtcgggacgacatcgacatgttctcccgcttcaacccggagaagccggtcgagaagttcctgcggtactggcgccgccgggtcgacgtcgacgtcgaatcggcctccggcatcatgtcgctgaccgtcgaggccttcgatcccgacgagtcgctcgccatcaccaaggcggtcatggcggatacggagcggatgctgaacgacctcagcctgccgtcccggaaggacgccctcgacgtgagcacgcgcgtcctgaagctcgccgaggagcgggaggccaaggccaacgccgccctgaacgagctgcgcaaccgcgagggcgtgctcgacgtgatcaagtcgaacaccgccaccatcaagtcggtgtcggaactgcgggagacgcgcaccaagctcgccgtccagctggcggtgctccagcgggacctcggcccgcaatcccgcagcatcgtcgacctgaagcagcagatcggcgatctcgacgcgaacatcgcgcgggtccagcagcagctggccggcaccgcgccgaccgagaagcggcgcctctccgacgcgctcacgcggttcgaggatctcgagcacgagcgcgagaacgccgagaagtatcaccgcgacgtgcagctggcctatgaccgggctcgcatcgttgcccagcagcaggtcgtggccctggtgccgatcgtcgagcccatcaaggccgggtcctcgaccgagccgcgccgcatcctgatgacgagcatcatcaccgccggcgccgccgtgctgttcgcggccgcgatgttcacccgccgcatgctcatcacctga

SEQ ID NO: 6795 - DNA, 240 bp, Methylobacterium sp.
atgtacaagctcccgcccggcagcctctaccggctccgcaccctcgcgcagaccggcgcccgcttctatcaggtcagcggctacatgcggcgcatggaggtcctgggactggttctcgcgacgggtcggacggatccggacgcgaagaccgtcgagtaccgcatcaccgaagccggccgagccgaactcgaggagcgtcacggtccggcctggcccggctcggccgaggacgaggcctga

SEQ ID NO: 6796 - DNA, 378 bp, Methylobacterium sp.
atggattcgggcgaggccctttcggatcgacgtgtcgggccggccctgcgggccgtcgtcgccctgctggcgctctacgccctgctgctccaggcctttctcggcggcctgatgccgttgccggcagcgaccgacggcctctgcgcgcagcatgccgacgcgtccgctccatcgggcacgcccgtcccccacgaccacggcgattgctgcacggcggcccaggccaccggcccggcgctcccgccgcgccccgcgtccgtcggcttccgatgggccgcgaccgcggacctgcggccggcctggcccctcaccgggagcgtcggcgcccgcgcgccgcccggcaccatcgcgtccccgagggggccgccgaccgcctga

SEQ ID NO: 6797 - DNA, 1551 bp, Methylobacterium sp.
atgctcctgcgcgcgaccgctacagcgatcagagctcacctggacgatcgcgcctcgcgcctgatcgcggcggccggcacatgcctgctgctctgcctcgcgctgctcggcgtctatctctgcctggacctgcgggacgtcgcttggcacaacgcccgccgcaacgccgggaatctcctggcggtgatcgaggagggcgtcggccacagcctgcgggtctacgacctctcgctgcagaactccgcacggctggcgagccgcgccgacatcacggccctggacccggatattcggcgcctggcgctgttcgacacggcggtggcgggctccggcctcggtccgatcgccgtcacggacgcggccggcgacgtccggctgacgagcgatcccggcgtgcggacccggcccaacatgagcgcgctgccggaattcgagttccatcggtcgaatcccgaaggcggcctgatcctgtccgggccgaccgtatccctcatcacgggtgagcccatcatccgcatgacccggcggatccggacgcccgacggctcattcgccgggatcgtctcgggatcgatcaggctcgcgcatttccaggcgctgttcgagcgcctgcacttcgacgacggcatcgctctgaacgtctttcatcgggacggcacgctgctgatccgggcgccggcccggccggcggcgctcggccagaacatcagcgcgagccccggctacaagatgtaccgggccaagccgcgcggcgagttccaggggcgctcgttcctcgacggggtcgagcgggtctacagcttcgccgacctcgacgacctgccgctgatcgtgaccgtggcgacggacgtcgacagcatccgcggcgtctggatctacaaggcggcgatcgtcgccgtcctgatcctgtgcctctgcgtcctcgccttcggcctgacgatcctgctgcaccgggaggtcgggcgccacgtggccgcggaggcctccagccgcgaggccaacgccgcgctcgccgtgctcgcgcgaaccgatggcctgacgggcctgccgaaccggcgcagctacgacgagcacttcgccgtggagtggaagcgggccgcacagctgcggacgcccctggcgctgttgatcgtcgatgccgaccacttcaagcagttcaacgaccgcttcggtcaccagcgcggcgacgaggtgctgaaggcggtggcggagtgcctgcaacgcaccctcgataccgccgggctgagcttccggatcggcggcgaggagttcgtcgccctgttgccgggtgtcgacgcgacggccgccagcgtcgcggcggagcgcgtccgccgggccgttgtgaacctccgcatccctcacgccccggaggtcgggggcatcgccacggtgagcatcggcgtcgcctgtgccgacccggccggcggcgatccgcccgaagggctgttcacggcggccgatgcggccctctacgcggccaagaaggccgggcgcaaccgcgtccgcgccgccgcgccggcggatcccgtggccctggcgctgcgggcctga

SEQ ID NO: 6798 - DNA, 399 bp, Methylobacterium sp.
atggacctcacccacgttcgcgccttcgcggccgccctggcggcgaaggaccgggacgccgtgctggcacagatggccgagggggtcgtgctcaacaccccgctcgccgccgagcccgtgcgcgggaaggcggcgatccggccggtggtcgacgccctgctggcggcggtcgacgccttcgagatccgcgagatcctggaaggccccgcgcacgtcgccgccttcttcggcgcgacggccggcccgcaccggctcgacgggatggatgactggcgcctcgacgcggccgggcgcatcgccgagatgaccgtcctgtggcggccgctgccggaggcgatcgccgtccgggaccgcctggcccgcgccgcggaaacgccgacttccgcggcgaccgggtga

SEQ ID NO: 6799 - DNA, 363 bp, Methylobacterium sp.
ttggagttcagctggttcaccaagtgccagatgatggcgtcaaactatgcccagcactgggagatggttctcgagcctgatctcggaagtctgattcaggccgtcgccactgatgcgcggaccagcttcaccgggccgcaatcgatgcggcgcgtcgccgaacgactgacgctcgttgcagactcgcttgtcgcggcgagcgacgatcgggctcgcgctgccgatgtgcgccgcgaggacggtcgttgcacggaagcgctgcaatacttggcgtcgcaactggcgagcacggcagccagtgtcgaggcatggaagcatgcgtccgcctccgcgactgaaacaagtcaggcgccgtcggcgtga

SEQ ID NO: 6800 - DNA, 219 bp, Methylobacterium sp.
atggagatcaagcgcgatctgatggacatggcgcatgcggacacgatcgtgaagtccttgaagagtcgtggcctgaccagggacgaattcgaggacgtggtttcgggcctggtcgatgacggtctgctttcgctggagcgagctcaggtattgaccctcagattcgagcgcacagaaccccaaagcccaagtctcgtggatgatcgtgacgtgcgatga

SEQ ID NO: 6801 - DNA, 222 bp, Methylobacterium sp.
atgccgacaccgcccgacgcctacctccgggacatccttgcacaggcggaacaggacctcgccgcggccgagctgcgccgggcccagcaggcacggatcgtcgccggcccgctcaatagcccggagacccgtgccgccgcggaactgcttctgcgcgagattgaccggaccatcacgtccatccgcgcgaaccgccatctgatcgcggacatcctggcctga

SEQ ID NO: 6802 - DNA, 219 bp, Methylobacterium sp.
atgggttccagcgatcccgagacgcgcaggcggcagctcgaccggctgcgcgcggcctacgaggcccgtgcgggccggccggacctctcggccatcggcagcggcgcgcggcactcgcgggcgctcctgggacggatcctcgtggtgctcggcggcctgccggacggggccggactgccggcgatcgggccgggcgggaacggacgcgcccagacgtag

SEQ ID NO: 6803 - DNA, 420 bp, Methylobacterium sp.
atgggatcgatgcggaacgcgttcatctacgcggccatcctgtcgacgctcccgctcccggcggccgcggcggagacgtgccgcgaccattaccggagcgaggggacgccgatgctccaggccatcacctacaagacgtggatgatcttcccctcggtgagccccagggccgcgttcgaccgggtgacgcgggcggtcctggccgaggggttcgtgggcgtgcacgtggagaaggcgctcgggaccctgacggcccagcaggagacatccggctcggggcgaccgcagacgctgcgggtcgtcgtgcgcaaggccggggcgggcagccgggtcgacgccctgttcatggtgcaggccggccagatcggtcaggacgtcgaccagaacctgtgccgcatcgtcgatgccgcggcgcagtag

SEQ ID NO: 6804 - DNA, 498 bp, Methylobacterium sp.
atgccgctggttgtcatcttagccgccctgtgcggcggactccctgtgcttgccttcggctggcagacgttcggcttctacacggtaatactcgcttcctgtgtcgccagtgcggccgccgtactggtgggtggcggactcgcgctcctgagggccggaaggtcccggaccgcgcaggatccggcgaagatcttcgacatcgacaggctcacgagcggcggccgcagcgactttcggctcgttccgcggcgcctctacttcgacatcgagcacggtcgcgagatcatcaaggatgagatcggcatcgaggccacgagcatcgaccaggcgctcgacgacgcccggagcgtgatccgggacatggttcaggaactcgccgacgagggctacgcggaggattgggtgctggtggtgcgcgatgccaggggggcttcggtcgcgcgcctgcccatcgagcggacgcccgcgcaggcgcggcccgaccgccgctccgcctga

SEQ ID NO: 6805 - DNA, 159 bp, Methylobacterium sp.
atgccgtccgcctcgctcatggatcagatcgcccccgttcgtaccagccgcacccgcaggaggcctcatccggcccttgtcgtggcgtctgtcgccctcgccatcggcctctggttcgtcatctacgcggtggccggacgcgccatctggttctggtga

SEQ ID NO: 6806 - DNA, 1857 bp, Methylobacterium sp.
gtgacccgctcccaggccgcccgccagactgcccgccaggccgcccgccagaccgcccgcgtcgtcgcgctcaccgcggcgatcctgctcccggtgcaggccggatcgcgcgccgccgaccgaggaccggcagacgggccgggcgacaggccggacggcaccccgcactttctcgagcaatcctggacgccgcaggagcgcgcgtggttctaccgggcgagccagggctcgcagatcatgccgtatgcctggttcatgtccctggagcgcccggacgacgacacgctcttcgtcgcggacgggctcgcgcgcttcggctacctgccgaacccgtacgacgggacgcgcggatcggaccgcagcgggctccccatcgggttcgtgaaggacgtcgacgatcgcggcgagtggatcggcatgacctgcgccgcctgccacgtgaaccgggtcgacctgcgcggtcggtcgatcctgatcgacggcggcccggccgatgccgacatgttcgccttcatcgaggaactgggccgcgccctcgcgcggacgcgcgacgacccggcgcgcttcgagcgcttcgcccgccgcgtcatcccggcggaactgtcggcgccggggaccggcccgtccgagcccgaccgccgccgcctgcgggccagcctgacgcggctggccgaggacttctcccaatacgtcgcgtcgagccggaccgcggtaccctgggggccggcgcgcctggacgcgttcggcatgatcttcaaccgggcgacgggcatcgatctgcgcgacccgcacaacatcgccccgcccgacgcgcccgtcagctacccgttcctgtgggatacgtcgtggcacgaccgggtgcagtggaacggctcggccgcgaacgggctcgccgtcgagcgcctgggccggaacgtcggcgaggtgctgggggtcttcgcccgcaccgacatccgggagccgaccctgccgccgctctggttcgagacctcggcggaccgggtcaacctcctgcggatcgagaaccagctgggcgccctcacggcgccggcctggcccgaccggatcgcgccgcgcaccgaggcgcaggcccgggacgccgcggccggcaaggcccactacgaccggtactgcctgtcctgccacgcgatcgccccgaccggcgcgaaccgcacgctgacggtgaccctgacgccgctggcggagatcgggaccgacccgaagatggcgacgaacgccgtgtcccggcgcgcgcggaccgggatcctcgaagggatccggatgccgttcctggcgacgacgccgccgctggccgccgagacgagcagcctcgagctcgtggccacgctcgtcgccggcgcgatcctggcgcccctcgaccgcggacccgacccggcgggcgtcggggcggaccagagcgtcatcctcgaccggctgctcaagcgcggcgccgccgccctcgaggcccgcaacgcgatgctcgacgacgtctcgaccgccggcggcaagggcctcgtcgccgcgttcgtcggggcgcggagagaccgcgacctcatggtctacaaggcgcggcccctcaacggcatctgggcgacgggcccgtacctgcacaacggctcggtgccgaacctgtacgaacttctgctgccgtccagccggcgatccaggacgttccgggtcggcagccgcgagctggacgaggaccggatcgggttccggtccgacgtcgggccgttcctgttcgacaccgcgctgccgggcaatgccaataccggccacgaggggccggcctacgggaccgagcagctcgacgacgcgcagcgccggcagctcctggaatatctgcgaaccctgtag

SEQ ID NO: 6807 - DNA, 921 bp, Methylobacterium sp.
gtgagactgcctgtcaccggcgacggccggttctgggcccttgccttcctgggcctcggcctcccggcctgcctcgcgctgggctggatcggtctcaccggcgagaccccgtccacctccgccctcgccgtgggcggccggctcgccgccatcgcggcgttcctgagcctgggcctcgccgccctggccctggcgacccggggccgggccgcgctgttcgcgctgctgtgcttcccgacctcgctcgcggccgcctccggaccggacgggcccgtcctcgcgctggcggcgctcgcggccgcgctgctcagcccccggccgatgacgggccggcacggatcggcgcgccgcgccggcgcggcgctggcgatcgccctggtggtgctggcgcggccggcctgcgcgcccctcgtggggatgctgctcgtgccgttcccgcctccggggcgacgcgtccgcgcctggcgggagcggctgccgctcgccgcgttcgccctgctgccggctctcctgccggccgcgagccccggtcttccgccccccggcgcggcgggggacggattcgtgtccctgcccgtcccgctgcccgggttcctctccggggtctgggccgccgcgctgctggcgccgcccgtcgcgctgcggcgcggccccctgcccccgcccgcggagcggctgtggctctcgggctgcgcgctcctcggcctctggctggcggtgctgtcgcaggccctcgccccggcgggcggcctcggggggatgcaggcccgggacctgctgccgctggcgccgatgctgatcctggccttcgcccgggggcggatcggcaccgcggcggccctgcgctggccggccctgctcccggtgctggccgccgccctcgacgcggtggtgctgccgatgatcgcgctgcgggcgtag

SEQ ID NO: 6808 - DNA, 219 bp, Methylobacterium sp.
atgaccgtccgcctgttcgctgccgccgcgctcgccgcgaccctcgccgccgccctcgcgacgcccgcctccgcgcagggatccgccgcacggcacggcctgtccaacgtcacagcggtgatgctgcccgagatctccgtgacctaccaccggcccgtgccggccgaccgctccgccggcccgcacggggccggcccggccggccgccagccccgctga

SEQ ID NO: 6809 - DNA, 207 bp, Methylobacterium sp.
atgacgaacgcgaccgatcgaagggccggccgccgcggcgtccgcggcggccgtgctcaggtccggacggtgccgccgggcctgctgctggccggcggcgtgggggcgaacgccccgctgacggccgtcgacctgatcgcccaggcccgcgcggcccggcgggaggccgaggcccgcgacggcgcggaccgcgcggagcagggctga

SEQ ID NO: 6810 - DNA, 600 bp, Methylobacterium sp.
atggatctctacgccggatcggcgcagatccggctgcacgaacaccagatcgcgcaggatctcggcatcagccgcacgccggtccgggaagccctgacgctcctggagcgggagggcttcgtctccacggtgccgcgacgcggcctcttcgtgacgcgcaagaacaagcgcgagatcgtcgagatgatcaccgtctgggccgcgctcgaaggcatggcggcccatgccgccgcgcggaacgccgaggatgccgatctccgcgcgctcggcagggccttcgaggcgttcgacatcgcgactctacccgaccatctgaaagcctacgacgaggcaaacctcgacttccatcggacgatcatccgtctcggcggctgcgggttgatggtcgagatgacgaccaacctgttcatccacatgcgggcgatccggtcggccttcctccatcgggccgggaggctcgaagactcgatgcgcgagcatgctgccatcatcgccgccttgcaggcacgcgacgcggatcgggccgcgatcctcgtccgcgatcacgcgctcgggctgatcgcgcatgtcgaggcgcactgggtttggccagaggggtga

SEQ ID NO: 6811 - DNA, 600 bp, Methylobacterium sp.; identical to SEQ ID NO: 6810

SEQ ID NO: 6812 - DNA, 288 bp, Methylobacterium sp.
atgatcgtcttgatagccgcagccatcgtcagcggcctcgcgacagccgcgatcctggcgccggtgagcgccctcgccgcgctgatcatcgcacccctggcagccagcgcgtcggccatcctcgcctgcatcttcatcgcttggcgcaacacgcgcgacgatgtcgggccgcccaacctcgagacgcaggccgacgcgatggtggcggtcctctgcgaggttgcccagaagggcaagatcgtcccggtcgccgcgccggtccgggtccgcggccaccggtcggcctga

SEQ ID NO: 6813 - DNA, 114 bp, Methylobacterium sp.
atgtacgctttggccaagaccagagagagaaccgactgggagctggtcgtcgtcttcggcagctggatcgtcttcgagatcgcgatcctgatgctgtgcttggtgtcgatgtag

SEQ ID NO: 6814 - DNA, 267 bp, Methylobacterium sp.
atgaagacgctgatcagcctgaccgtcgccggcctcctggcgacaggcgcggccgccacggccgcggagaataccgggacccgcatgcagggttcgcccaacgcggccggctacacgggccagggcgcgacgggcaaaggcgagacgacgggcacgacgaccggatctccgggctcggagatgccgaagcaggacagccggatgaaggggccgccgaatgcggccggattccagcccggcggcggcggcggcggctcggcaaggagg

SEQ ID NO: 6815 - DNA, 675 bp, Methylobacterium sp.
atgcggcgcccgatacggaaggagaagcccatcatgacagcccatcggttcgacgccgtcctgttcgacctcctgacggccctgctcgacagctggtccctgtgggactcggtcgccggcagcaccgaggccggccgccggtggcgggccgagtacctgcggatcacctaccggacgggggcgtaccggccctacgaggaactcgtcgccgaggccgccgaggcggtgggcctgccgcgccgcctcgcggcggatctcgaggaccgctacggcgagctccggccctggcccggcgtgacggagaccctgcgggcgctcgcggcgcgctccgtgcggctcggcgtcgtgaccaactgctccgaacgtctcggtcgcatcgacgcccattgcgtgggggtcgagctcgacgcggtcgtcacggcggagcgcgccggcttctacaagccggatccgcgtccctaccggctgggactgcaggccctcggggtcgagccggcgcgctgtctgttcgtcgcgggctcggccttcgacctcgtggggacggcgcaggtggggctggcgacgtactggcacgaccgcgtgggcatggcggctccggacggcgcgtcgcccccgctggcgcacgagaccaccctcgatccgctgcgcgcctggttcgatccgggcgcgcgctga

SEQ ID NO: 6816 - DNA, 315 bp, Methylobacterium sp.
gatgccggcgccgtggtccgcgcctacgatcccgagggcatggagcaggcccggatcctgatgccggctgtggattacgccgagaacgcctacgcctgcgccgagggcgccgacgcggtggtgatcgtcaccgagtggaacgcgttccgggccctcgatctcgaccggctgcgccaggccatgtcgtccggcgaggcggcccccgtgctgatcgacctgcgcaacatctacgaccccgcgagcgccgcgcgccacggtttcacctattgcggcgtcggacgaaccaaggagagcgtcgcccggatcgggtcttga

SEQ ID NO: 6817 - DNA, 177 bp, Methylobacterium sp.
gccgggcgcgcatccggggacgcgtcgccagattgcgacgcgctgccgacgctggagctgctccgtctgtgggaatcgctgcgggagccggtgagccggcagcgggtgctggccgccgcccggcaggaggcccgaaccctgcgggcgagccgcgcggaggacgcggcggccggctga

SEQ ID NO: 6818 - DNA, 147 bp, Methylobacterium sp.
atggcggcgccgatcaagacggtcaggccggggcaggtcccgggcgcgggggtgaccgccgcggcggaccagacgatccgtcctctgagccttgccgagttcatcggtcagcgcgcggcgcgggcgaacatgcaggtgttcatcgag

SEQ ID NO: 6819 - DNA, 273 bp, Methylobacterium sp.
atgcgccgcgactccgacgggaccggccggatctcggctctgacgcggatgcgacgccgcctcggccggctgcgcgacccgctggccacgccggcggcgctgcaccgacgctgggcgggcgcggcgaccggcgcggatctcgaggcgcgcctgatcgccgtcctggccccgcacgtcgacacggcgttctacgcgagctggtacgggatcacggccgatccggtgcgcgactacctcgtccacggctggcgcgcgggccgcgacccgcgcccc

SEQ ID NO: 6820 - DNA, 129 bp, Methylobacterium sp.
atgatgaactctgttctcgcgcttctcaccgtcgtggcggtgctggtggtcacggcgctgatcaagctgccgctcctgccgttccgcttggtcggccgccttctgcggagccgcccggcggcggcctga

SEQ ID NO: 6821 - DNA, 741 bp, Methylobacterium sp.
atgagcccggcccggagcctcccggccgggcacctccggaccagcctcgccgcgctcgtcgccctggccccggtcctctcgctcggacagggggcgtcccgggccgacgaggcgcccgccgcacccgtcttcaacaaggccgaggccgcggagatcgcggtgccgctgcggcaggacccggccttgctgcgcagcttcggcacctgcccggccgacaccttcgcgcgggagcgcccgttctggcggtgggcgttcgcgccccgccggcccaccgagcgccgctgcgcgcgcgagcccgcttcctgctacgcgctctgcacccggtggtcgaacgcgccggcctgcttcgacctcgccctcgccctggaacaccactccctcgacgtcgccgacatcctcgacaaggagcggctctacgccctcgcctgcgcgggcgggttcccggcgggctgcaccaaccgggcggccgggatccggaacggcggctacgcggaggatcccttccgcgacgcgccgcgcgccgacacggatgcctgcctcgcccggagcttccgtctcgattgcgaccggcgcggcgcctggggctgcgccatgctcggccaggcctatcgcctcggcgagggcgtcgccgccgaggcgtcccgggcccgggcggcgttcgacatggcctgtgcgatcaacccggacttcgcggcctgcaccttcgccaaacggcagctggccgagatgggcgcgccgtga

SEQ ID NO: 6822 - DNA, 399 bp, Methylobacterium sp.
gtgagcgccggcgacgccggaccggcttccgacgccctgcgggccctctacgggcgggtcgacccaatgcccgaggggccgccggccccgggccacgcccgcgcctccctgtgcgtggacgtgggcgacggggacgacgtcgccgccgccgagcgctggatgctggcccatgccagccggctcacccgcgtgcgcagcaccggctgcggctgctgcgtgatcggctgggacatcgaggggccggcggcgctcgtcgccaccctgccggcggcgctcggggcaacctccgactgggccggcccggccgcgaccccgcggcgcgcggcgagcgcgcggggccggcgcttctgggcgcacgggtgggagcgctggtgggagcgctgggtccgccgccgctga

SEQ ID NO: 6823 - DNA, 210 bp, Methylobacterium sp.
gcccgccacgattgcaacgacggctacggcggatcgggctcgggcctgttcgacgcggagggccatctcatcgcgatgcagagcgcgtcgctctcgatgaaccagcgccacgccttcgacatcgagttccattacggctcagccctgctgatcgagggccggctccacgaggccctcgaggctcaggcccgcgcgacccgggaccgctag

SEQ ID NO: 6824 - DNA, 93 bp, Methylobacterium sp.
atgtcacgagggatcgagaccgacgccctgcccgagacgcccgaggccgaagagccccggattccgagcgcgcctgcccaccccgtcacggga

SEQ ID NO: 6825 - DNA, 570 bp, Methylobacterium sp.
gtggcgatcgcgatcccctgcgggaccatggtccacgcggacttcgccgtgagcctcggatcgatgatgcactcgctcggcgagatgccgatgtcgatcgtcgtcgggaagtcgtcgatcgtcgccgatgcccgcaacctcggcctcgaatacgcgcagaagtacggggcggagtacgtcctgttcatcgacagcgacatgaccttcccgaaggacgcgctcctcaagctcctcgtccggcaggtcgacatcatcggcgcgacctattcccgccgcaccgcgccgttccacttcctgggcgacatcctgccggagcagccggccgacgcgccgaagggcctgctggagatgtcccggatcccgaccggcttcctgctgatcaagtccacggtcttcgagaagctgaagaagccctatttccgcttccgcgtcgacgaggaagccggcgtgaacatcggcgaggacttcgatttcagcgatcgggcacgcgccgccggcttccggatctggtgcgatccgtatctcagcaaggagctcggccatatcggcgagcaatccttcaagctctga

SEQ ID NO: 6826 - DNA, 714 bp, Methylobacterium sp.
acgctggcggcgctgctgcgggtctgcgggctgcggccggcgcgggcgccggtggaggacacgggctggctcggggcgatcgggcaggagaccctcgagcgggacgcgttcctggacctgcaggcgcggctggtggcggggcatttcgaccacggcttctaccgggcgcgctacgggctgtcagaggcggaggacgcggtgcgcgactactgcgacaccggctggaagaagggccgcaaccccaggcccgacttcaaaggctgggcctaccgcgcgcaccatccctccgcggaagcgacgggcctcgcgcccctcgtgcaccacctcgcccgggccctgctacgcggcgacgacctcgcgggcgaagccttcgatccgcgctacggcacgttgccggccgaagaggacgctgacctgttcgagcaggcccggctgatcgagccgttcttcgacgcgccttggtacctcaagcgctacccggacacccgcggctttgagaacggtccggcgatccacttcctatcccacggacaggaggaggatcgcgacccgagcaagaccttctcaacgcgcttctaccgccgggcctacgggcacctgctgggtcccggggagtcgccgttcctgcactatgtgcgcaccggccgggccgccgggctgatgggctgccccgaggatctcggcacctacccgcccatggaggccccggcggcc

SEQ ID NO: 6827 - DNA, 162 bp, Methylobacterium sp.
atgcccaggaccgtcgaccgtccccatcccgcgcgacgccgcgccgtccacctgccgcgcccccgcgccggcgccgccgccaccggcctgttcctggccggcctgatcctctcggccgcgacggtgccgctggtcgagcccgccgacgccgccaccggcacc

SEQ ID NO: 6828 - DNA, 531 bp, Methylobacterium sp.
atgctgacgcttgaacgccctgactcgatcgcgccggctgccacggacgttccgcttggcaccctgctcgccgcctgtaacgctcagcgggccatgccgctggtgttcacctacgacgggcggaccatccagcgcggctaccacgtcaccgaggtgaaagccgggcagttcgccgccctcgattgcggggccaacccggagtcgtggtcggagatcttcatccagctctgggacgtgatcgacggcgaccgcacccacatgacggccggcaagttcgcggcgatcatccgcaaggtgtcagagcacgtcggccttgatcccgccgcgcggctcaccttcgaggtcagcgacggcgtggtgccgatgcagctccactccgccgatacccccgagctgatcgacggcgtgctccgggtcgcgctgtcacctcgcgctgcgagctgcaagccgcgggaccgctggcttgaggagcagaacaaggccagcgcctgctgcgatccttcgactaccgagcagccctgctgcgggtga

SEQ ID NO: 6829 - DNA, 540 bp, Methylobacterium sp.
atgctggaccttgccaagatcgatgtggcggtgccgcctcgcaggaccgccgacgacattcagatcggcgccctgctcgccacctgcgacgagcacccggcgatccccctcgtgttcgtctacgacggtcacgccgtgcgtcccggctaccacgtcaccgaggtgaaggccggccagttcgccgccctcgactgcggcggcaaccccgagtcctggacggagatcttcatccagctctgggacgtgatcgacggcgaccgtacccacatgacggccggcaagttcgcggcgatcatccgcaaggtgtcggagcacgtcggcctcgatcccgccgcgcggctcacgttcgaggtcagcgacggcgtggtgccgatgcagctccactgcgccgatacccccgagctgatcgacggcgtccttcaggtcgcgctcgcgcctcgcgctgcgagctgcaagccgcgggatcgctggcttgaggagcagaacaaggccagcgcctgctgcgctccctcgaccacgaagcagccctgctgtgggtga

SEQ ID NO: 6830 - DNA, 510 bp, Methylobacterium sp.
atgctggacgttgccaagatcgctgtggcggtgccgcctcgcaggaccgccgacgacatccagatcggcgccctgctcgccgcgtgcgacgagcacccgtcgatccccctcgtgttcgtctacgacggtcacgccgtgcgtcccggttaccatgtcacggaggtgaaggccggccagttcgccgccctcgactgcggcggcaacccggagtcctggtcggagatcttcatccagctctgggacgtgatcgacggcgaccgcacccacatgacgaccggcaagttcgcggcgatcatccgcaaggtgtcggaccacgtcgggctcgatcctgccgcgcggctcaccttcgaggtcagcgacggcgtggcgccgatgcagctccgctgcgccgatacccccgagctgatcgacggcgtcgctcaagtcgcgcttgcccctcgcgctgcgagttgcaagccgcgggatcgctggcttgaggcaaagggaacggcgaaggcatgctgcagctga

SEQ ID NO: 6831 - DNA, 861 bp, Methylobacterium sp.
gtggtccgcgcgatcgaggccgcggcggaagctgaggccgagatcatcgtcgtcgataacgggtccgaggacggaacggacgcggcgctgaagcgctggtccgcgtccgtctcgatcgatcgacgcgacgttctgctcctcgcgcagtcgcgcccaggtgtcgccgggtctcggaacgccgcgatcgcgcgcgcgtccggagacatcatcgcgttcatcgacgacgattgcgtcgtgtcggaccagtatctgcgagatctgatcgcgcactatgccggcgacacggaaagcgtcattcgcggtggccgtgtcgaactgggatcgaccgaggacatcgacttcaccacgaagaccgaggccctggccagccggctgacctatccggcccatcccgggggcttcgtccacggctgcaacatgacctgcagccgggccgtcatcgagcggatcggcgggttcgacgcggcgttcggccccggcgcgacgttccgcgcggccgaggacacggacttcatctaccgcggctgggcggccggcgtggcggtcgagtacgtgcccgacatgagcgtcaagcacttccacgggcgccgggacccgcgcacgatcgaccggctgcactggaactaccagttcggcaacggcgcgctctacgccaagcacatcggccgcagcccgtggctgatcaagcacctgtactggtccgcccgcaacgccgcccgcgagctggtcgggggcccgtgcttcgacgcgcaactcggcctgacgtggcgcgccatcgtgaccgccaatctgagcggcgtcctggccttcgcctggcacagcgcgcggacgctgctgacgcgcgcgcccgcccgggcctag

SEQ ID NO: 6832 - DNA, 552 bp, Methylobacterium sp.
atgacgggcgccccgctccagggccacgcggagttctccggcgacgcccagcaccggtaccgcctcgaccgctggtggtcggacgcgccgcgcgcgctcgtctgcggctgcaacccgagcatggccggcgccgaggtcaacgatccgacggtgtggcgcctggtcgagctgctgcgccccatcccgacgatcggcgggttcacgatcgtcaactgggaggaccgcgtcgcgaccgacccggcggcgatgcgggcgtggcgcatgcacgcgctccacaccgacgaggccggctacaaccgggcccgcgacgccaacctcgcgcggatccgcgcgctgtccgcggcggcgccgatccggatcgtggcctggggcgacctcgtcccgatggagcgccagaccacgctcgtcctgcgcgccatgagcctggactggacgcaccccctctacgcgttcggcacaaccgcctcgggcgccccgctgcacccgatggcccgcggccggtcccgcatcccggccggcacccttcccaccctctggcgagagcacgaatag

SEQ ID NO: 6833 - DNA, 309 bp, Methylobacterium sp.
atgagcatcaagacgccgccccccggcgcccttcatcatgaggaggactgcggggtctcgacgcttcggcaacagagaacggaacggctcctgagccgtatcgcgggggcggtgcagatgccgccctcgacgttctacaggccaccgaacgccgtcgacacgggagcgtccgccgcggccatttcggtggcctcggtcgccagcgacgctgagtgcgcggagctgctggcagctttcaacctggtccgtgatcctgaggatcgacgcaggctcctggagctggtgcagaagacggcccagcgcgcctga

SEQ ID NO: 6834 - DNA, 291 bp, Methylobacterium sp.
atgacgatcacctcgacgaagaccgcgatcctgtcctgtctcgccctcgccgccctggcgaccgtgcccggacgagccgaagcgcgcgggttcgggcacggaagcttcgggcaccatggcggcttccatcacggcttccaccacggtggtttccatcacggcttccatcaccgcttcggcggccatggctggtggagcccggcgggcggctacgccgcgagcagctactacggcgactgtcacctgttcttcagcccggtgtggggccgctacgagcgggtctgccgctga

SEQ ID NO: 6835 - DNA, 729 bp, Methylobacterium sp.
atgcatcaccacggcctgcgcatcctgctcgtcgacgatgacgcggaggttcagcgtgtcgtctcgggatacctcgacgcgcacggggtcgacgtcgtcccggcgtcgacgcgggccgaggcgcgcggagagctcgcggatccgtcgcagttcaacctcgtggtgctcaatcttcgcccgggcgcggagaacggtctcgacctgctgcgggacctgcgcgcggtgagcgatgttcccgtcatcctgacgacggcccatcgctgcgaggagttcgaccgcgtgctcggcctcgaactcggcgccgacgactacatcgtcaaaccctacggcctgcgcgaattcctggcgcgcgtgcgcgtcgtcctccgccgcgtcgcggcgcaggcctcgtcccgaccggcggaggcgccgtgccggcgcttcgacggctgggtcctcaaccgtcgacgccggcgtctgatcaatcccgacggggaagaggtcgtcctgggcaagcgcgactacgcgctcctggcggcgttcctcgacgcacctcagcgtccgctcagccgcgagtacctgctgcaggtcacccgcgtccacgacgacgtcttcgatcgctgcatcgacgtgcagatcctgcggctgcgccggaagatcgagcgcaggcccagcgacccgaagctcatcgtgaccgagcgcggggtcggctacgtcttcgccgccgcggtcgagagcacgtcccactag

SEQ ID NO: 6836 - DNA, 177 bp, Methylobacterium sp.
atgaaccgagatccgagagccaggagcaagcaggccgacggcaaggcccggacggcggagtccgaccgcgagaccgatgcccgcgcacgtcaagcggtggtggatgcctggcggcgggcactgctccggatgcgcgagcggcgcgccaccgaggaccgcgccgatccgggccactga

SEQ ID NO: 6837 - DNA, 237 bp, Methylobacterium sp.
atgccccgcttcttcatcgacctgcacgacggaaccgagctcgtccgcgacaaggacggctacgaactgcccggtctcgacgccgcccggtcgcaggccgtgaagatcatgacgcggatcgcgcaggggctctccgaccggcccgggcgccaggattacatcgcggcggtccgcgacgacacgggcgtggtgcggatgcgcttccgcgtgtcgctcgatgccggcccggtcggctga

SEQ ID NO: 6838 - DNA, 423 bp, Methylobacterium sp.
atgcccatcatgccctggatccacgatgccctctatgtcggcagcttcgccgccctcgtcctcgtcgcacggcaggcgctcgtccggcgcgatctcgggctctccggccttccgggcctcgaacgcctgcgccggtccctcgggcccggcaccgtgtcccctgagtggccccggttcacgtcgccccggaccagcggcaacaccgccttcgacgcctggcgcgacggcgagatcggccgcatcgagggggagcgccgcgcgctcgaaacgcgtctccgggatttcgagggtttcgtagacgcgctgaagcgcgcccaggatcgcgcgaccttcgagcgcttcgtggcggaacatcccgcgggatcgggggcggcggtcgacatcgtcggcaccgccgatcacgccgaacttcgaagaggctag

SEQ ID NO: 6839 - DNA, 279 bp, Methylobacterium sp.
atgacgcccgatgagatggacgacagggaggagcatcctcggatcgaagatccgcgatccaggcccacgctgttccttcgccggctgcctccccagttccggggtgagcgggacggtctgacgaccgacgccgcgtggctgttcgatgccttctccggctccccggaccggcgtgacatcaagctcgggcgcggcacgcatcggatgcatctcgaagccgggcgcagggccctctggcgagcctccgccgcatgtctgagtgggccggtcccggcttga

SEQ ID NO: 6840 - DNA, 279 bp, Methylobacterium sp.
atgaacacgctgaagatcgcctccgtcgccgcaggcctctgcctggtgccggctatgagcatggcccaacaatcggtgagccaggacaatctcaagcgctactgcacgggagactacctggagcattgcggccagttcgcgccgggtggcccggaagttcaggcctgcttccgcgagaaggccaagctcctgtcgcccaactgctcgatcgcgatcacggcgtaccagaaggagcaaaacgaggccggcgccattcggaaggtcagcgtgacgcgctga

SEQ ID NO: 6841 - DNA, 294 bp, Methylobacterium sp.
atgacctttctcaagaccctgctggccagcctggccctgtgcgcggctctcctcgtctgggccggcctcgcgatcggcccggaacagccgatggaccggaccagtccgggtctgaccaccgccgcggtgctggccagcgacggcatggcgccggacggtcgaccgggcgagccgtccgcggcctccggcggcccggatcggcgcgatctggatcgagcggctctggaccgcctcgcgaagcgggtctccggccaggtccgcgacgcgtccgccgcggggacgccggccggctga

SEQ ID NO: 6842 - DNA, 285 bp, Methylobacterium sp.
atgcttagacagatcggcgcgggaccggcgcgcgcggtcgcgacgcccgacgccgccaccgcgcgggagatccgcgcgtccatccaggccgaaggcctgatcagcttcatcgacggcaggtcctacaagacgctcaagcgtcacctgacggcttacgggctgacaccggaggaatatcgcgccaagtacgggctgccgcgagactatccgatggtggctccgggttacgccgccaagcgctcggagatcgcgcgatcgctgcagctgcgtcacagggcgggatag

SEQ ID NO: 6843 - DNA, 270 bp, Methylobacterium sp.
atgcgacacgtgatcggtacctcgtcggccgcggctttcggcacgctctgcgtcctggcgctcgtcggctggacccaagcggccgacacggtgccgatgcaggccagcgggggcgcgaaagcctccgcggtggcccgtgacggcggcgcctgtggcgggggggcctggccgtacccgcccggcgcctgcgcgggagccggcccggtcggcgatccggcggcccgtcgcgtccggctcatcgcggtcgacgccgcgcccggccgtcggtga

SEQ ID NO: 6844 - DNA, 216 bp, Methylobacterium sp.
atgccgcacttcagcgacgaccccggtgccgacgaagatcccgacctgctcctcgcgctgcgccgcatgctgcgcggcggagaacgcgctccgcggcgcctgccgacctgcgccgagcgtttcggcgtgccggcgccgcgcgattgcgcgcgtgacgcgcaggatgcggtgctggccggcccggacccgcagccgccccgatcccgacatcgctga

SEQ ID NO: 6845 - DNA, 186 bp, Methylobacterium sp.
atgctcgacgtcatcgcccgcctcctgctctcggccggcatcatggtcggtacgacctacctgccggcgctctcgcaggccgtcaccgggcagccggccggcacccggatctacgccgcggacgcgcccgcctgcccggcgaagcccacgatggccgggatccgcgccctggcctgcctgggctga

SEQ ID NO: 6846 - DNA, 1017 bp, Methylobacterium sp.
atgccgatgtcgctccgccacgcggccgtcgccgcgcgcctcctcgtcgccgcgctgctgctcccggccctcggcggcgcggcgcgggccgagacgacctccgtccgcatcggcctccagtacggcctcgtctacctgccggtgatgatcgcgcagagcgaggggctgttcgacaagcgcgccaaggcggcggggctcgacggattgtcggtcacgctgacccgcttcagcggctcgacggcgatgaacgacgcgctgctctccgacagcgtcgaactcggcaccctcgggtcggccggcgccctgatcgcctgggacaagacccgcgggagtcagcagatcaagagcctcacggccctgagctcggtcgtctacacgctgttcaccggcaagcccggcgtgaccgccctgaaggacttcaccttcggcgacaagatcgcggtcccggccttcaactcgccccaggcgatcctcctgcgggtcgcggcggcgcagcaactcggggacgccgccaaggccgacgcgctgatggtgagcctgccccatccggacgccaccgcggcgatgcgcgccggacagggcattgccggctacttcgcgacgccgcccttcacgcaggtgctgaaggcggatcccaagatccggacggtcatgacctcgaccggcctgatcggcggcggcgacatcaccgccgcgaccctgaacgccaagcagggcttcgtcgacgcgaacccgaaggtggcgcaggcgatccgcgccggtatggaggacgcggtggcgctgatccgcagcgaccccaagcgcgcggcgtcgatctatctcgcctccgagcaggttcagatcgaccgcgcgcaagtggaggcgatcctgaccgacggatccatcgtctacgacgtggcgccgaagggcatggtcgccctcgccaaggcgatggcggcgcagggcttcctgcggaaggtgccgcgggactggcaggagatcttcttccccggcctcgagggccgcgacgggagctga

SEQ ID NO: 6847 - DNA, 1377 bp, Methylobacterium sp.
atgtcggtcacgtcggcagccttggcaacggacacggcgggcgcgcgcccggccgcgtcccagtcgatcgaggagaagcggaagagcgctatccgcggcgcgttcttctccgaatacatcgacatgttcgacatctacctgccggtggtcgcgctggcgccggtgatgttcatgttccagccgaagaacctgtctcctcagatggagacggtgctggcctcgctggtgttcatcacaaccctgctcggccgcccgatcggcgccctcatcttcggcctgatcgccgacaaggtcggccgccgggccgcctcgatctactcggtggcgggcttcggggtgatcacgctgctgatcggcctgctgcccggctacgagacgctcggcctcgcctcgtacatcctgctggtgctgctgcgcttcctcgacgggatcttcctcgggggcggctacacgggcgcgatgccgctcgccatcgagtattccaagaaggacaagcgcggcttcgtcggcggcctgatcatcgcgggcttcccggccgcctatgtcagcatcaacctcatcacgatgctgatgttctacctgttcccgctcgacgggcccgggtcgccctacacggtctggggctggcggatccccttcatcgtcggcgcggcgctcgccggcctgctcgcgctctactacgtccacaaggtctcggaatcggaggtctggaagaaggaggccgccgccggggccgaacaggccgaggcatcgcccatggcgggcctgttctccgggaagggcgggcgcgacctcctgcaggtcctgctactgatgaccggcttctggacgacgcagaacatcatcacgatctacatgccgaccggtctgctggtgaagaccctgcacctcaacggcttcgcgctgaccgcgacgctgatgatctgctacacgatcctgttcttcagctacatcggctccggcctgctagggcagctcatcggccgccggcggttcttcgtgatcgtcggaccgctgatcgcgaccgtcggcgcgtacatcctctacacgctgaccgtcacgcccgacatggcgttcggcacccgcgtgctgctggtcagcctcctggcggtgatcgtgacctcgccctggggcgtcatcgtcacctacatcaacgagcgcttcgccacggatgtccgcgccaccggcttcggcatcggcttcagcctctcggtggtcatcccgtctttctacgccttctacatggactggctgagcgcgctgatgccgctcgcgctgacgcccgtggccctgctgatcgtcggtggcctgatcggcaccgtgggcgcgctcatcgggccggagaccagggacgtcgatttcggcaccggccactga

SEQ ID NO: 6848 - DNA, 906 bp, Methylobacterium sp.
atgaacgggaaccggatcggcttcatcgggctcggcaacatgggcggccgcatgacccgccgcctgaccggggcggggatcgatgtggtcggctacgacaccgaccgggaagccgcttcgcgctggggcgcgacggacgcggcctcgatcgccgcggtcgtcggtgaagcggacgtggtcctgatgtccctgcccgacagcaaggtggtcgagcgcgtcgtgctcggcgagggcggggtcctcgcgggctgccgggacgggcagatcgtcgtcgacctcagcacggcctccgccagctcgacgcgccgcatcgccgcggcgctggccgagcgcggcgtcgcctacgtggacgcgggcatctccgggggcgccgccgcggccgagaaaggcacgctgaccttgatggtcggcggcgatcccgccatcatcgaccggctgggctgggtgttcgcgccgatcgcccgaaaggtcgtcgtgatgggcggctccggcgccggccacaccaccaagctgctcaacaacttcctgaacgcggtcagcctcgccgccaccgcggaggtcatggtcgcgggccggaaggccggactcgacatacaccggctgctggaggtgctgaacgcctccagcggcgtcaacttcgcgacgctgaaccgtttccccaagatcgtggacggcgactacctggaaggcggcctgaccggcaagctgatgaccaaggacgtcgtcctctacaccgatctcctgcacgagctcggcgtcgcctccctcaacgcttcgggcccgatggcgagcttcggcctcgccacggcgctcggctacggcgacgtcatctccaaccgcgtcgtcgacgccatcggcgacgtctccggcggtgtccggctccacggcaaccgacacgagaactga

SEQ ID NO: 6849 - DNA, 765 bp, Methylobacterium sp.
atgaccgggcccgcgccgagcccggagagcctccggcacaccgtccagggcgagctcggctactgggacgcggagcaggcggccctggccgagctggccccgggctttctcgacgcctgggcgcggctggcgatggtccccgtgcgcaagaaccatctcggcgccaaggaccgcgccctgatcgcgctctcggccgcgacggccgcgacgcatctctacgcgcccggcacccgccgccagatccgcaacgccctcgacgcgggcgcgacggccgaggagatcacggaggtgctggcgctcacggcgaccctcggcatccacgcgtgcaacatcggcgtgccgctgctgctggaggtgctggaggaggccgggcagcggagcggccccgcgccgctgacgccgcggcaggagcagctgaaatccgacttcacccgcgaccggggctactggcacgcattctgggacggtcttctcgagctcgatcccgacctgttcgagggctacctcgacttctcggcctggccctggcgccacggcgtgctcacgccgaagatgaaggagttcgtctactgcgccttcgacgcggcggcgacgcacctctacgtgccgggcctgaagatgcacatgaagaacgccctcggttacggagcgaccaaggaggagctgatggaagtcctcgagatcgtcagcctgatcggcatgcacggcgcggaactggccgcgccgatcctgcgcgatgaactggccgcgcggggccggggctga

SEQ ID NO: 6850 - DNA, 111 bp, Methylobacterium sp.
atgcgcatgcgagggttcccctggaaaagctcggcctttcgaatgcgcgaaccggcgcagcttttcgagaggcggatctacgataccgcgatggatgcggccggaatgtaa

SEQ ID NO: 6851 - DNA, 168 bp, Methylobacterium sp.
atggccagctcgatgctggtcaccctcgcgtggctggccctctcgatcttcgtctgggcccagctcgacgccgagaaggtgctgctgctcttcgcctacctcaccgctctccaagccggctatctcgtcggggcctatatcagcgccgatgccggcccgagccgctga

SEQ ID NO: 6852 - DNA, 249 bp, Methylobacterium sp.
atgcccgccgacgacgtcccaacccacgatggccgcgcgcccccggctggggagagccgcctccgctcgatcgccaaggccgtgagctggcgcgtcgtcgggagcctcgacacgctgctgctgtcctatctgttcaccggcagcgtgctggtcgccggatcgatcgcctcgaccgagaccgtgaccaagaccgtgctgtactacctccacgagcgcggctggggcctgattcccctcggtcgcgcctga

SEQ ID NO: 6853 - DNA, 135 bp, Methylobacterium sp.
gtgccgatcattcccagcccgagacacgcggcgcggcgatcgctgttccagagcgggatcggcctgcggctggcgctcgccgcgctgctctcggcgctggtctggctgaccatcgcctgggcgctggcgacatga

SEQ ID NO: 6854 - DNA, 360 bp, Methylobacterium sp.
atgaccttccagaccaaagcccgccccttattagccgccctgctcccgccgaccctgctcacaaccgtgacggctccggccgtcgcggccgaacccgtttccaccttcatggcctacacggcgccgctcgccgctccccttggcgagacagcccctcatatcccgctgatcgccgcaagcgcgctgatcgccgcttcggccctcgcgatgttcctccccttccgtaagcccgctgcgccggcccgcgtcgaggcgcctgccgcgcccgtcgagaccgcagcggtcgggcccatctactgcccccgcacccgccgttggcgtgacgcctcgacgggccgccttgtgaaggctccccgctaa

SEQ ID NO: 6855 - DNA, 267 bp, Methylobacterium sp.
atggccgaataccacgtcaccacctatccgccgcacgtcggacccgccgagatggcgcttgtcgcgcgccgcgtcgataccgcgggcgatcgcttcgtcggcgccgtcgtcgccgtgctcgacagcctgtcgctgcgcgacacggagggcggctggcgggcctaccgcgcggccctcgccgcggccggatcgctgcgccggggcgccgtcgcggcgcgcctcacggtcgcgggcggctacgtcgttctggtggagcgcgtcgcgtga

SEQ ID NO: 6856 - DNA, 345 bp, Methylobacterium sp.
atgcagccccgatccctcgacgagctgcgccggctgctgccgggcgtcggcatctcgatctacgcgatggagcccggtgggcccgtcaccctggagcttctggaggagggcgacccgggcgagacgccgcaggcgatcgtctggaccgcaccgagcgagcgcgaggcttgggagaaggccttcccgccgacgccggccgagcccgtgccccagggcagcttcatgccgcccgagggctcgccggctcgcgccgagctggccgcggccgtagaggacccgaccgccggcttagccgccgagctggccgcggaactgcccgccgacgctggcgggctgttcgactga

SEQ ID NO: 6857 - DNA, 168 bp, Methylobacterium sp.
atgaaccgacagcccaaggggcagaatttggtccgcgccacggtccacctggacgcagctttattggccgagctggacgacgccggccgcgcgcgcagcctgtcccgcagcgccatgctcgcccagctcctgcgccagatgctcccgaagacacggaggacatcctga

SEQ ID NO: 6858 - DNA, 351 bp, Methylobacterium sp.
atgttcgatgcagacgacacccccggctacctccacgacgcctaccgcgccgccctcgataacgggctgctgagcctcaacctgacccgcgtgggcacggacaaccgcatgtggcaggcctctagccgcttcgcgaagtccagcggcttccatgtcgagatcgaggccaacgccctggaggcggtcatgaaggcgctcggggcctacaccaagatcggggccccggcgcccgctggcctgttcgacgacgagcccgcccccgagggtaagcccctggacgacggcttcgacgcgatccaggacgcggtctacggcgccgacgagcccgaggacgaaggcctgttcgactga

SEQ ID NO: 6859 - DNA, 438 bp, Methylobacterium sp.
atgaagtccctcgccgtcgccgccctgggagctgggctcggaatggccgcgaccgcggccagcgcgctcaccaacgcagtcgccgccggcacggagctgatctcgggcgagccccgggccgcgcgccgccggcaggcccgcaagggccatcggttcgtcatcggccgccgcggcagccggagccgctaccagccccaccagggctcccgggagatcgcccggcgcgtccggcagatcatggacggccagctcgtcgcctggacgcccccgggcaccgaggcgccggccgcggacgccgccctgcgcgcggagaaggcgatccccgcccaggtgctgatcgacgccggcctggaggccgagcgccgggccaagcgcagcgaggcggcccgcaaggcggccgcgacccgcgcccgcaagcgggaggcggccaatggctaa

SEQ ID NO: 6860 - DNA, 570 bp, Methylobacterium sp.
gtgaacctctacaagccccgggcgaacaagaagaacccggacaagctcaagtacgaggtgaacctgctctatccgaagtcggccgacctgtcggcgatcaaggcggccgtgatccaggccgccaaggccgagtggggcgagaaggcggtcgacctgctcaagaacggcgtcatcaagcagccgatcctggacggtgacggcccgcagggcgtgaacaagacgaccggcgagcgctacaaggagctggaggggatgttcttcatccgctgcgcctcgaatctcaagccggcgctgctgagcccgaaggtgacggccgcggtcgagggcgagcacctctactcgggctgctacggctacgcggcgatccacgcctacacctgggagagcgacgagcagggcaggggcgtctcgatcgggatcagcatggtccagcacgcgaaggacggcgagcgcctgggcggcggccagcaggatccctcgaagttcttcgagacgatcccggacgacgacagcggcacgggcggcgctgcggccgacacgggcgacggcgcgggcgcgctgttctcctga

SEQ ID NO: 6861 - DNA, 1293 bp, Methylobacterium sp.
atgtccgccggccacgtccagcgggatcatgcgcaatggtccgccagcgcaagcgcccggctctgggcgtgcgccggcagccttgccctgtccggtcgcaccggacgggctgacagcgagagcgaggcggctgcctggggcaccgcctgccacgaggtgtccgaggactgcctgcggaccgggaaggacgccgtcgagtggatcggccgcttcgtgcagacgaagcggcaccggatcgaggtcgacgaggagatggccgagacggcccaggtctacatcgatcacgtccgggaagaagtcgcggccgcccgcgccgacgacccgggggacgatcagatcctgtggctggagcagcggttcaagctcgacgcgatcaacccgcccttcgaggccggcggcacggccgacgccgtcatctacagccgcccgacccgtaccgtgaaggtgaaggatctcaagggcggccgggggattgtcgtcgaggcgctcggcaacaagcaggcccgcacctacgccctgggcgcggtcctggcgatgcctgggctcgacattcagcacgtcgaggtgacgatcgttcagccccgggcgccgcaccgggacgggcccatccggtccgagaccttccacatcgtcgacctgctcgactggacgaccgagctgctggaggcgatgcggctcgcgaagctggccgacgacacctacggctcgaacgggtccgaggacgggtccttcgacgagtgggccgagcggttcctgcaccccggcgatcactgcacgttctgcccgtgcgccgggtcctgcccggccctggcggtcgccgcgaagtcgaaggcgctcctgttcttcaaggatgagagcggcgtcgagcaggagaacacggtcggcaagctcacgccggccgaggtcgccgagatcctcgaccgggccgacatgatccagaactggctcaacgccgtgcgggcccacgcccacgcggaagcggaggccggcgtcgagatcccgaactaccagctcgtcgccaaggtcgggcgcgagcgctggaacgacggcgccgaggccgacgtgatcgccgcgtgcgagtgggccgagctgccccttagcgaataccagaatgctccgaagctgagaacgcccaagcaagtacgcaaggcgctcggcccggatctcgccaagctcgtcgagagacactcgacggtgcccactgccggaacatccctggtccggcaggataagacggtgcgcactccggtccaaccgaaggctcacctgttattcgacgtgattgacgactga

SEQ ID NO: 6862 - DNA, 540 bp, Methylobacterium sp.
gtgagcatttcgatcaccatcaacggcgacaacgcttccgaggcgatccgtgagatcttaacgctggcgggcagcatggggatgtcgcgggggaccgacacgtcggccgccgcgctcgcgaccggcatgtctgatgcgtcatccgacagtcgccagacggccgagcccgcgaaggagccggccaagtcgacccggaagaaggccgacaagccggccccggccgccccgccggagcccgcccccgaggtgaaggccgccgacgccgccgacgaagcggccgagagcgagaaggtcgtcgaggccaaggccgaggaagccaaggtcgacccggccgaggtgttcgaccggaacgtcatgcgcaacgcgggcggcgagtacgccaagctgtacggcatggccgcggcccaggaggacggcccgaagatcatcggctaccctgccttctcgaaggtgccggacgaggagatcgagaaggccactcgggcgctccgcgcggccatcgccgagaatccctacggccgcacgaaggccgccgcctga

SEQ ID NO: 6863 - DNA, 255 bp, Methylobacterium sp.
atgggcacgctgagtccccgcgagcgcgaggcgcttctgctgcgcctggaggccttcgcggacgccccgcgcgagcccagccgctacgccgccaacaccgtccaggccgatctggtctccgcgttccgcgacggcgaccgccactacctgctggtcgtgccggccggcggacaacctgtccgggtcgacgtgaccggccggctcggcgccctgttcgcctacctgggcgaagtgatcgagaaggccggcatctga

SEQ ID NO: 6864 - DNA, 216 bp, Methylobacterium sp.
atgggcctgcgcatcagacacacgcgggtgccgccgcaggtctggaagaaggccctcaagatcaagggcgggaaggacgacgcccgcatggaggcgatgcgccgctggccggcgctcgcgaaggagttccgcgtccgccggcccgacttcgccgaggccgcgctgatcgctgagtacggacggctccaggagggcgccaatgacctgtttgcctga

SEQ ID NO: 6865 - DNA, 264 bp, Methylobacterium sp.
atgtccgttatctgtctgatccaacggacgggggaggcaatggcggggttcaatagcacgaagttcctcaaggcccacttccccgactgcgcgaccatgcgcagcctgctcacggcctacggcttcgagccgccggccgcggacaccgccgagaaatggtggcgtcgcggatcggtgccgggcgcgtggcttcctgtcctactcggcatgctggagctggagcacggaaagcctgtcagtctcctgccgtacctggaccgctaa

SEQ ID NO: 6866 - DNA, 417 bp, Methylobacterium sp.
gtgcgcgagcccagcttccagccgcaggacgacaacgtccggaagcacaagctccacatgatcgcaggccgcatcgcggagctgcgccgggatcgaggctggacgcaggccgaactggcgcgccgggctgggctcaaccggaacgtcgtcaacaccacggagaacgagacgagcttcccgacccgggagaacctcgcccgcatggcgagcgcgctcgggatcgagctgaacgagctgacggacgtgttcgtcatagaggcgcaccaccgggcgccggctgcgctcagcctcacggaagccaagggtcggccgggctacatggccgtccagatcaaccggatgctcaagacggccacggcgctcaagatattccagctcatcgccgaagatgacgcagacgctgctgacagaggctga

SEQ ID NO: 6867 - DNA, 999 bp, Methylobacterium sp.
atggctgcggctcagatctacttcggcgagtggctcatcaatgagcaaagggccgcgcgcgacccgaaagggtcgggcctagacttcgcggacgtgtgggccttctatgcgaaggaggccttgccgaagctcgtctccggcgagaacaccgcgcgcagcggccggcacctcctggaggccttcggcgacctgccggtcgcagacattgggcaagcccatctcgacgactacgtgcgcgatcggcgcgccggccgcatcggccggccggccaagctcagcacgatctggctggaggtggcgaagctcaaggcggccgtgaacttcgcgatcaagcgccggaagctgccggcgactgcacgcctggagctggacagcctggagccgccggaggttcgggaccgctggctccggccggaggaagtcgacaggatcatcgcggaggctgagacccgccgcgagggcggccgcctgtcccgggccgaacgcttcctgcacctcgcgatcgagacggccgcgcgacgggccgtgatcgagaacctccagtgggatcaggtcgacctggaggccggcgtcatccactaccaccggcacggcgacctgcgctcgaagaagaagcgcccgagcgtgcccatctcgtcgcgcctgcgaccgatcctagagcgcgcctttgaggagcgaatcacgtcctatgtgttggatacgtcatccgacatctaccaccacatcgaacggatcgcacgagcggcagacgtgaagggctttcatcctcacctcctccggcacaccgcggcgacatggatggcgcgccggggcgtcccgctctggaagatcgccggcatcctcgggaacacgatgcagatggtcgagcaggtctacgcgaagcactcgccggacgggctcgccgatgccgtggagcacatttcggcggcccggaagccggcccaggcggtgcgcccaaatgtgagcgcaaacgacgatttgggcgcactttccgtctga

SEQ ID NO: 6868 - DNA, 453 bp, Methylobacterium sp.
atgctcgttcgcctcgccattgaagccgaccgccccgccctggtcgagctgtgcgtccaggcagtcgaggagagcgtgcggggtatcccgccggaccgggagatcatcaacgagacgatcgacagctccttcgcgaccgcggagccgaccttcttcgtagtcgagcgccagcgagagctgatcggcttcatgatggcctcgatcggaagctacgccttcgcctctggcatcttcacgacccagcaggtaatgttcgtccgtcccgatatgcgcggcactcgggcggccgcactcctgatccggcatctgatcgcctggagcactaggctcggcgcgaaagagatcacaggcggcaacaacaacgggctctacaccgaacagaccgctcgcctgctggagaagcatggtttcgagcgcgtcggggtgtttatgcgccgtccgggagtgcagtaa

SEQ ID NO: 6869 - DNA, 492 bp, Methylobacterium sp.
atgatcctggagcctgtcacctacgccacggccctccaggtcggccagggcatgcgcgagcgcgacgtgatggagttcgccgcggtcgcgccggtgggcgccgaggatctggcgtcctggcttgcccagcgcttcggccggcggtccgagctactctgcgcccggaccaacgacggcgagcccgtctgcatcggcggcgcggtcgaggtgcggccgggctcggccacgctgctgttctacggcaccgaccgcttccccgagatcgccctggggatgacccgcttcatccgccggcactacttcccgagcctcgccgcggcgggctcgcaccggatcgagtgcgtcaccctcgacagctaccgggagatgcagcgctggctggagacgctcggcctggagcgcgagagcaccctgcgcgcctacgggcgcgaccgcgaagacttcgccatgtacgcctggatcgacgccgatgctcgttcgcctcgccattga

SEQ ID NO: 6870 - DNA, 1611 bp, Methylobacterium sp.
atgggcacgatctggatccgtgagttcacgggcggcctcgacacccgcaagctggccgaaacctcgaagggcggcacgctcgttcaggcggtcgacggccacatcaaccggggcggcgagttcgagcagcgcgccgccttcgtgccggtctacaccctgccgaagggcaccgtggggctcgccttcaccaaggccgggccgaccgtcttcggctcgatccccgacccgggcgtgcccaacggggtgaactaccagcgcctccagcacccggacggcgcgaccgagctggtcgcggtccggagcttcgacctgttctccgggaagatctttgcggtcggcaccttcgcggacggcgacatctaccagttctacgacggcaagcgcatcacgaactacggcaccaacaccgccgtggtcccaggctcgccggtccggaccttcggtcgcaagctgtactacctgacaggcccgaacctgatctactcgaacctcgcggacccgaccaatttcgacgcggacagcggcacgaagctgccggacgggacgacgaccgacgtgagcgcgccagacgcggacgggaagaccacgaagacggagacgacccgcaagacgaacgcggacggtacggtcacaatcaccgtcgtcgtcaccaagccggacggctccgtcacgaccacgaccagcaccgagcccgccccgacgacgggcgtgggcgccggcttcaacgacctgtccgaagaggactacgggtccgaggatctgacggcgatcggccgctaccagaactacctcgcgatcttctcggaccggacggtccaggtccgctacatggacccggacccggcgctctcgaagggcatccagtcgctgcacaacacgggcacgatcagcccgcgcagtgtgacggagttcggcgacaccgacctgttctacctcgacgcctccgggctccgctcgctcaaggcgcgcgacgcctcgaacgcggccgtgagcaccgacatcggctcggcgatcgacgtgctgctgacggacttcgtcgcccagcagagcgccgaggacgtgcagaacgccatcggcgtgatcgagccccgcgatggccgcttctggctggcgatcggcgatacgattttcgtgttctcctacttccccgcggcgaaggtgagcgcatggacaatctacaagcccggctttaaggtcgaggagatcatcgtctacaagcggcgggtctacttacgatctggcgaccagatctatgtgtatggcggcctaggcgcggagctgctgtacgacgacaccgaagccgtggcttggctaccctacctcgacggcgaccggccgaccgagacgaagacgctccaggggatcgacgccgcggtccgcggctcctggcgcgtcgacatcggcatggacccagcgcaggtcgaggccagcgacaagatcggcgtcgtcacggagacgaccttcatggcgaaccggatcccggcgagccatcaggcgacccacttctccctgcgcttccgctcggacggccgctacctgccgaacaagccggcggtgctgggctcggccgcgatcacctactcggccgaaagcgacaaggcccggtcatga

SEQ ID NO: 6871 - DNA, 720 bp, Methylobacterium sp.
atggcccgcgggcagacgctgctcaagctgctggacgacctgcgggccgaatgccggctgtcgccgaacccctcccacaacgcccagcagcgcgagacgcaggtccgcctgctccagcgcatgcaggagtggctctacgacgactacgactggccgcacctccggatcgagcgcacctttccgagccagcgcggccagcgctactacggcctcccgaaggacatcgcgctcgaacggatcctgcacctggaggtccgcttcgggacgcgctggctcccggtcggcacggggatcgacacggagtgctacgccgggatcgacagtgacggcgggcagcagggctggccggtccggcggtggcggatctgggaggacgaccggatcgagctgtggccggtgcccgaccaggacgccgggaccgggatcggcgatgacggctcgatcaaggtcgtcgggatccgcaacctgcggcccttccgcgacgacaccgatgtctgcgatctggatgaccgcctgatcgtcctgtacgcggcggccgagctgctcgcggcggccggcgcgaaggacgcccagctcaagctccagcaggccgcggcgcgctacgcgaagctcaaaggcgacctgacgccccggcggcgcgtgcagatgttcgctgagcgccccgagcgcgccccgctgcgcggcatgccgatggtcgactaccgcccggcgagcaagtga

SEQ ID NO: 6872 - DNA, 660 bp, Methylobacterium sp.
gtgcccaagacggtcacgcccgccgagatccagatcctccagcgcatgcacggcgacgacgcggtgcatgacatcctgcccggcgagcccgtgcagcgctcgaagcagcaggagctgggccggctggccggcatgtactcggcccgggatgaggacgggaagccgcacctccaggtcatgttcccgagccacaccctgctcccgatgacgatcgacgagctggggctgcccgacgagttcttccgcgccacctcgcgcgcccggccgacgacccgcaccgtcgaggtgccggtcgagcagacccacggcgccccgagcaccccgccgacgcaggtcgggtgggacaacacggagttcgagccgaccgaggtcccggccgatccggagacgcagcccgagctggcgggcacgatggtcgacccgcgctcccagcaccagaacgacgagccgcccggcgtcgcactcgcggcgaccaacgacggcgacgccgacaagctccgcgcccgcgccgaggcgcagggcaccgggccgggctccgtcccgacccagaccggcgcccggacggacggcggcccggtcgagacggccggcgccaagacggccgagcagaagtcggccgaggtcgccccggcggcggacgccaacgccctgttctcgtaa

SEQ ID NO: 6873 - DNA, 1083 bp, Methylobacterium sp.
atgccgtttactgcgaacgaactggcgaacatcgccaactccgctctcgactactacctcaacaagggcaaggtcgagaagcagaacatccaggagaagcccatgtcgaaggccttcgaggcctccgctgggcagttcccgggtggtaagggtctggtctcgatcggtgtgaagggcggccagggcggcggctccttccagggctacacccacgacgatcaggtcacgtactacaacccggcgtccaacctgcgggtcggctacgcctggaaggagcaccacatcggcctgggcctgacccacaccgagctgaaaatcgacggcatcaccgtcgtcgaggacggcgcggaccagaccacgaccgagaaggacggccgcgagcagttcgccctggcgaacctgctcgaaggcaagatggaggacttcgacgaggacaagaaggcgtcctgggacaagctgctccacggcgacggcaccgccgacgcgaaggctctggccggcatccagtcgatcatcctcgacaacccggcggtgggctcgaccggcggcctgtcccgcgtcacctacccctggtggcgcaaccgggcggccaccgccgccgcggcggccgcgggcaccggccaggacgctatcgccagctcggcggctggcggcggcgtgctgatgcagttcctccagaaggaggatcggcagctcaagcgcttctcccagggcggcgtgaagctgcgccggttcgccggctcggacttcatcgacgccatggagcgcgagatccgtgcaaacggcaactactcgctcagcggcttccgggccgcgggcaccgtggatgggaagatggccgacccgacctgggacggcaacgagatcatctacgacccgaccctggacgacatgggcctcgccaagcggatgtacgcgatcgatatgcgtcgcatccgtctgatgtacatgatcggcgagaagaacaagaaggcctcgccgccgcgtccctacgaccgctacgtgatgtaccgcggtctcacctcgaccgcggtcatgatcgcgtcgcagctcaacacgagcggcgtctacgacatcaagtaa

SEQ ID NO: 6874 - DNA, 1029 bp, Methylobacterium sp.
atgcctttcgaccgtgaagatctccccgaggaactggacgaggctctcgaagtccaggccggttccgaggggacggacgggcaggccggcgccgatggcgccaagcctgctgatggcgagggctcgtccgcctcgcaggcgaaaaccgaagacgaaggccttctgggcgtggtccgcgacgcggccccggccaagaagcccgacgccgcggcggcctcgccagccgaaggtgccgaggcgggtgacaagcccggcgaaggcgctcccaagcagccggacaacgagaactactcggatgtcccgttcaataagcatccgcggttccgccagctcctgagcgagcggaacgccaacaagggcgacgccgagaagtatcggcaggtcgacacgttcatccgtgacaacgggatgaccgcccaggaggcggcagacctgctcacggtgggcgccatggcgaagacgaacccggcgaaagcctgggaactggcgcgcccgtgggtcgagaacctcttgaaggcatgcggggaggtgttgtccccggatctgcaacaggccgtccaggaaggacggatgacgcaggaggccgcctacgaggtgagccgctcgcgcgcgtccgtcgccgccatggaggcctcgcgcgggttcgaggagcgtcgtcggcaggagcagtcccagaccgagcacgcgcgctcgatcacgactgctgccgaggattgggagaccgatcgccgggcgagggacccgaactacgacacgaaactcgaactgatccatcgcgagatcgcgtggcgccaccacaacggcgatgtcccgaagacgccgcaggaggtcaaggcccagctcgacgacgcctacaaggccgtcaacgctgcgctcaagcccccggcgacgcctccggcggcagccccgggccggcaggcgcccccgcgcaccgcgaccaagcccgtcacgggtggatcagtggctggtggcaacgcgaagcccgcgccgcggtcaatgctggaagtcgtccagcaggccgcaggttaa

SEQ ID NO: 6875 - DNA, 2226 bp, Methylobacterium sp.
atgttcgacgccccccagaccgcactcgcggacgaagcgcctccgaccgctgccgaggtgacgcccgagcaggtcggtccggcgaaggagcaggccccgaccgagcaggagctggcgctccagcggcggatctcgaagacgatccgcgaggacaagcgccacttcaagaaggccttcgagcagatgcgcagtgatatgcgcgtcgcgatgcgcggtcacgacaaggattggtcggacgacaagtacaaggccaatatcacgggccgtcacgtcaaggccaagaccgccgcgctctatgcgaagaacccgaaggcggtagcccggcgggccgacaagattgacttcaagatctggaacgaggatcagcagtcgctgctgatggccttccagacgatgcaggctgcccagcaggccgcgcagatgtcgcaggcccaggcggccggcgacccgaacgcgctggcggccggcgccacggcgcccgagccgcagctcccgccgggcttcgccgaggcccaggccctgatccaggacttccaggagggtatggccgcgcgcatgcaggcccagcggatcgcgaagacgctggagaagctgttcgctcacgcgatcaaggagcagcagccgctgggcttcaaggagagcatgaagcagaccgtccggcgcgcctgcacgaccggcgtcggctacgtgaagctctgctaccagcggcagatgggcccgtccccgagcgtcgagtatcggctgaacgacagccgcgtgcgcctggagcacctcaaggccctgatcgaggcccagcagggcgacgaaggctccgtggctgacctggaggccgaggccgccgagatcgaggccatggtcgagagcctgtcggccgagcccgagatcgtcacgtccgaaggcctggttttcgacttcccgcagtcgaccagggtcatcccggaccgcctgtgccggtcgctcgaaggcttcgtcggcgcccggcatctgacgctggagtacctttacaccccggaggaggtgaaggagatcttcggcgtcgatctcggcaagaagttcaagccctacctcgccagcgggaagctcgctgacgacacatccgagagctaccagcaccagagcgacattctcgacagtgaggagccggccggcgagcagccgaagggcgatctgtgccttgtctgggagtatttcgacaaggcggcggggctcgtctactacgtctgcgacggtcacgagggcttcctcaagcctccggccgctccggatgtctacgtcgaccagttctggccggtgtgggcactcacgttcaacgcggtagagagcgaggacgagcttttcccgccgtccgacgtggcgctgctgcgcgacatccagaaggagtacaatcgctcccgggacggcaagcgcgagcaccgccgggccgcgcgcccgcgctgggtgttctcgaagggctcgttcacggatgaggacctgtcgtggctcgggaccgccccggcgttctcggccacgggcctcaacatcgatccgacgaaggacatcaagacccagctccaggccgtgcccgtgccgggcgtggacccgaacctgtacgatgtcggggagatcatggccgatctccagtacgtcgtcggcaactcgacggccgggctcggcgcgccgcagaagggcaccgcgaccgccaactcgatcgcggccggcgccaacgccacggccgaccagtcggcggtggacgatctcgacaacttcctcaccgcgatcgtccggggcgccgggcagatcctgatgcgggagatgtccgaggagaccgtcgtcaaggtcgtcgggccgggcgccgtctggcccgagatgacgctccaggagatcgcggacgaattgtccctggagatcgaggccggctcgacgggcaagcccaatcaggcggtcgagatcgcgaattgggagaagatgctgcccttcatcatgcagatgcaggggatcagcccgcagtggctggctcgcgagacgctccggcgccttgacgaccgcatggatctcaccgacgccctggtggacagtcttccgtccatcgtcgcgcagaaccggcaggcccaggccgctccgggagatcccaacgctcagccggacgcccaagggcacaacggcgcagcaaacggcccggcggcccctggtgggcccgccggacgtggcgcaccgatgggtgcgcagtctaaggctccaccagtctga

SEQ ID NO: 6876 - DNA, 408 bp, Methylobacterium sp.
atgcagcttgatctgacgacggcctttgcgttcatcgcatgtatcctgagtgttggcgcgctcgtcttcaagtctggcggtcaagctcaggctcagaagtcattcgagacctactcgaccaaggtcgacgccgaccgccagaaatggcgcgaggacttcgagaagtcggttgagcagcggttcggcgccgtgaacggcgcggtgacgctttgccgcgagcaggttcatgacgttcgcgaagatctcgcgaggaactacttaactaaatccgaggtcaaagagatcgagcttcgtgtctcgaacagccaagacaggatcctcgaccatctcgataagatcgacactcggcttaacgagatgcagacccgcgtactcgaagcgatcaacaaggcaacgtcccgtggctag

SEQ ID NO: 6877 - DNA, 1158 bp, Methylobacterium sp.
atgcagtcacgcctgccgacgatctgcgccaattacggcgtccgagcccagaacgacttaggctacactcgcaacaaggtcgccggactgttcggcaacggcgatgtcgagagccagggcttcaacaccctccaggagatctcgccggtcgttgcgggctcggccggcggctacggctggatgcagtggaccgggccgcggcgccgcgcctacctcgcctgggcctccgcgctcggcctcgatccggccgccgatgagacgaactaccgctacatggtccacgagctgctgacgatcgagacggcggcgcaccgtgcgatcctagcgtgcgccgacacgcccgaggcggccgcggccgtggtctgcacgaagtacctgcgccccgggatcccgcacctcgaccgccgcatcgccagcgccaaggccgcggtgagctacatcggaccggcgaagggcgccagctcgcccgacgtgggcccggtcggcgtgcccatcagcccggcggcgccgcccgtgcgcctccagcgcggccagtggcccgaggacgccctgacgcgcttcgaggtccaggcgatccagcagcggctgctcgatctcggctaccatgtcgtaggcttcgtggacgggaagtggggcgagcggaccgccgcggcgatcaccgccctccaggagaacgcccacaccgcgctccagcggaccgacgtggcgatcgacggacactacgggccccagacccgcgcgctgctcgccgacgacgccagccgtgccaagccgtcgcctcagcgtgccggcgtgacggccaagacgctcgccaaggccggcaaccccgttgtgaaggccggcaccaagatctcctgggcgtcgctcgggtcggtcctggccggcgcgggcgctctggccggcacgctgtcgtcgacctggacgacggagctgccgtggccgttctccatgctggcgggcttcctgccgccgtgggcgatgctctgccttgtcgtggccttcaacctctacacgggcctcaaggcctccggtctgatcggcacggccgtcgagcgggtgcgccaggggatcgacaacacgggcgccgcccaggatgggcccgccaagctcacgctgcccaacctacccttcggtctcgacaagctgctgccccgatga

SEQ ID NO: 6878 - DNA, 1305 bp, Methylobacterium sp.
ttgttctccttcaccgcctttcagcaggcgcaaggcgacgacagcttccccggcaccgagctggatgttgagctggacacgacgaacaacgccctcgacgcgctgctcgacgccttcaagacagtcctgcgggcggacgggaagctcgccaacggcatcgtcacccgcaacagcctcgccgccgacctgatcctggggatcggcgcagcccggccgtggagccccacgcagccctacctcgccgacgagaccgtcacccgcggctaccggatctaccgggccctggtgccgagcctgggcgtcgacccggcggccggcggcacgagctgggagttggccgccgacctgtcacaggcggtcgtgatcgccgatgggggagtgggcacggccgcgctccaggacgggagcgtcacgaacgccaagctcgccgccgggatcgacggcgccaagctcctggacggctccgtgccggcctcgaagatcggcgccgggctcggcaccgtgccgatcggcgcccgcatggcctacgccggcttccgggcgccggccggctggctgttcgaggccgggcagccgatctcgcgaaccgattacgccgacctgttcgccgcgctcaccgagacgctccaggtggacatcggcgccgggcagaagaccctgctcaacgcctcgaagtcgatcgcggggatcggcctccgctcggcgatcgtcgagggtgtcgggatcccggccggcgcgcggctggtgagtgacgccaacggccagctctcgatcaacgccgcggcgacggcgagcgccgtccaggcgacgatccgcatcttcccgtacgggaacggcgacggcgcgacgaccttcaacgtgcccgacagccgcggccggaccgacttcggccgcgacgacatgctgtcgagctattggggcacgggcgccgggcgccttgtcgcgaccgtcgacggcggcagcctccaggccggcgctttcgacgccggggcgggcaaagagcagaccctgctcaagatcacaaacctgccgaacaatctgccggcgggcaaagtcacggtaaactttccgaagcagaacctcgcgacatacggcgctttggcgactgcatcggtgacgactgccagtggagcccttcccgttcagaacgtctggacgggcacggtgaacggcgaaagcaatccgcagcaggcaagcgcggatttccaagtcgacgggacaaacgcgaacccgaccgggtcgcagccattcagcatcgtcccgcccgctcacgtcacgaacaagatcatcttcgccggagtatag

SEQ ID NO: 6879 - DNA, 321 bp, Methylobacterium sp.
atggcacgctttccactcaccgctgccgcgcttgagcacgaggccgaggagctgatctcgggcctgctggctcagccggcgttcaaatccgcaatccaggagcttctgatggcctccgtgaaggaactacgtgacgcgctcgacggcgcgaaggcgagcgtcgacagcctgaccgccaaggtcggacaggtctccggctccgggatcgacccggccgatctggatccggtgctcgcggaggtcaacacccttcgctcgaccgtcgaggccctcgcggcgtcgctgcccgagcccaagccggccgccgcgcccgccgcctga

SEQ ID NO: 6880 - DNA, 1353 bp, Methylobacterium sp.
atgagcatcaaggctctccgccagaagcgcgccgacctggtgaaggaggcgcaggccaccttcgaccttgcggcgaaggaaaaccgcggcctcaccgaggccgaggcgcagcgtgacgacgcgatctccgccgagctgacgcagctcgacgccgatatcggccgcctggagcggcagatggagcgtcagcgccagctcggcgccaccgtcgacgacaacgccgagagcgagcgccgcgcccacgccgagccgcgcggcaacgacaagcccttccgcagccttggcgagcagctgcgcgccgtcatgtcggcctcccgaccgggcgggcaggtcgacccgcgcctgagcatggacggcgccggcttctcggccgggccgaccggcatgtccgagggcatcgcggccgatggcggcttcttggtgcagaccgacttcgccgccgatctgctggccaacacctacaacgcgggcgagatcgccagccggatccgcaggatcccgatcgggccgaatagcaacggtctgcgcgccaacggcgtcgacgagaccaaccgggcgaatgggtcgcgttggggcggcatccaggcgttctggaccggcgaggcggccctgaagcgccagagccagcccaagttcaagcgcatcgccatggagctcgagaagctcaccggcctctgctacgcgaccgacgagctgctgcaggacaccacggcgctcggctcctggatggagcaggcgtttaaggacgagatgctgttcaaggtcgaggacggcatcgtgaacggcaccggcgccggcatgccgctcggctacctcaactccggttgcaccatcgcggtggcgaaggagatcaaccaggccgctggcacgatcgtcgccaacaacatcctgaagatctggacccgcatggctccggcgaaccgcaagaacgcggtgtggctggtcaaccaggaggtcgagccgcagctcttcgcgctgatgctgctggtgaagaacgtggccggcaccgagaacgtcggcgcgatcgccttcccgcaggtcacctacacgccgcccggcgccaacgggaacgaatacggcatgctgatgggccgaccggtgatcccggtagagtacgccgcgccgctcggcacggccggcgacatcaccctcgccgacctgtcgcagtacctcggcatcgacaagggcgagatgaagacggattcctcgatccacgtccgcttcatctacgacgagacctgcttccggttcgtctaccggttcaacggccagccgatctggcagcagccgctcatcccctaccgcggcacggcgaccctctcgcccttcgtcaccctcgccacgcgcgcctga

SEQ ID NO: 6881 - DNA, 237 bp, Methylobacterium sp.
atgcggtgggcgatcatccgacagcagcaggtgctctaccgcgggacccgcgaggaggtcctggccgcggccgagcgctacgacctgatctgccacaccgtgccggggatcccgcagccgctcgacggccgcggcttctacccggacggcgccgagattccgccgcggctccgccagggcgcggtgatgttgccggaggacatgcttccggtccggcttcggaggcgcgctgcatga

SEQ ID NO: 6882 - DNA, 372 bp, Methylobacterium sp.
atggttgagcaccgccgcaagccgcccatcgtggcgacgccgcgccggaagcactggcgcgagcacgtgcggctcagcagcggcgagctgcggccgacggtctggaccgccatccgcctgccgaacggcgatcagcgcggcaagacgttcacccgcgccacccgcgtgcagctccgtctgagagaccaagccgagagccggcagttcctgttcctgcccggcaccaagatcccgcgaccggccgccctctactggcaggacatggtcagcctgccgctggtcttcgccgaggtcgaaggccgcctctggcgctcgcggcggccggtccgccgcttcccgcaacgtccgctccgtgaggcgagccatggctga

SEQ ID NO: 6883 - DNA, 153 bp, Methylobacterium sp.
gtgctccttgacgcctcgcatctgccggtgatggaatcggaccggacctttccgtccgaggcgcaggcgtcggccgccgcgctggcgttctcgaagctcgtgacccgcgccggcaagacgctgaccgcgccgacgtcgggcggcctgctctag

SEQ ID NO: 6884 - DNA, 657 bp, Methylobacterium sp.
atggatcgcaaaagccggcacttcagaacgttcgccgacgacatgaagcagttcgccgatttctcggacgtcgctgaccgcgacctggacggccagacaccgttcctgccgaacggctatttcagctacggcgacgcattggccctgacaactgtcctcgccacgcgcaagccggcccggtatgtcgagatcggaagcggaaacagtacaaaattcgctcgccgcgcaataggcaagtacaagctcgacaccaagatcgagtgtatcgaccccaatccgcgctcaagcgtccgcgacattgcggataactggatttctgacggccttctcgatgttgacccgtcctactttgaatccctgaacgatggcgatgtgttgatgctcgatggcagccatctcctgttccatggtagcgacacgacgcatttcttccttcgaatctacccgcttctccggccaggggtgatcgtgcatgtgcacgacatccatctgccgtatgagtatcctgaggtttgcgacaggctattttggaacgagcaatacatccttgccatgatgttttactacaagcctgcatccgatattatcgccccaatcaagtacatgcatcgtgagggcatgtgcgacgagggtgccagcttctggttcgaggtctag

SEQ ID NO: 6885 - DNA, 330 bp, Methylobacterium sp.
atgcgaccctggccgatcctggtcctcctcgccgcgctgctcggcgggctggcgagtgcgcccgcgcgcgcggcgcccctgccggtccccgcgagcgccgaggccgccgcgcccgcccccgcggtgcagcaggcccactggcgccaccgccgccactggcaccgccgccaccactggcggcgccactggcaccaccgccgccaccactggcaccgtcgccatcactggcaccggcaccaccatttccgccgccactggcaccgccaccacgtctggcacggccggccgtacggccgcccgtacggccaccggcacgtcacgttctactga

SEQ ID NO: 6886 - DNA, 366 bp, Methylobacterium sp.
atgcgttcactcgttttcggcgccgtccttgccgtcgtcatgcctctcgccgcgcaggcccaggacgccggcgacgccgcggccggcgagaaggcgttcgccccctgcaaggcgtgccacaacttccagaagaacggcgtgggccccgacctgaagggcgtcgtcggccgcaaggcgggcacctacgagggctacaactactccgccgccctgaagaactccggcatcacctgggacgaggccaacctgcacgagtggctgaagaacccgaaggcgaaggtgcccggcaccaagatgatcttccagggttaccccgacgacaagaagatcaacgacgtcatcgcctacctcaagacgcagtcctga

SEQ ID NO: 6887 - DNA, 165 bp, Methylobacterium sp.
atgtcgatgatcgccaccggcgggtgcctcggaagcaccctgctctgtctcctgaccgcgtcgtcgggaccgctcctcgccctggcgggcttcttcggcggcggcacggccgggggtctgctgggcgccctggcggtcgcggccctcggccggggtcgcgcctga

SEQ ID NO: 6888 - DNA, 303 bp, Methylobacterium sp.
atgcgcgtcacatccgccattggcctcgccaccgtgttgctctcagcggggtccgccgtcgccttcgcccccgcgctgttcgcggcgggaccggccgccgtagcccagctgtgtacggagagtgcagggaccgtctcttgtgcgaacggttatgcgggcttccgaggcccctcggggaagctctggattggcaaagatcgccgggggaccgtgatcgtcagcatcgatgatcgtcggaacgatcaggagtcactccggcgcgagcaggatcacggacgcttcgtccttgagcaggcgtggtga

SEQ ID NO: 6889 - DNA, 99 bp, Methylobacterium sp.
atggccgcgtggtcgatcgtggatctcctgtcggtcatcggatctcgccccgcggacgaggcgcgcatcaccgcgcaggcagatcggatcggagattga

SEQ ID NO: 6890 - DNA, 267 bp, Methylobacterium sp.
atgaccacagtggtcacggagggcaccatgcaggagatccagcttcgggacgccaaggcgacgctgtcggccgtcatcgaccaagcgaagcagggcgcgccctcgatcatcacccgccacggccgccccgaggccgtgctgctcagcttcgaggactggcagcggctgtcccgcgtcccgtcgttcggccgcctgctcatggccgcgcccctcgcggcggacgacctcccctccccgtccggcgggctcagaagcgccgagctgtga

SEQ ID NO: 6891 - DNA, 1347 bp, Methylobacterium sp.
atgcaatccacccctccgtacggtgagccgccgctcccgatcagttccgacgcgatcgccgacggcccgaaggtccccggcgcggcgcggcgtcgctccgtggtcgcgggcgccatcggcaacacgctcgaatggtacgatttcgccacctacggatatttcagtgccgtcatcggccggaacttcttcccgtccgacagcccgacgacgtcgctgctctcggccttcgcggtgttcgccgccgccttcttcatgcgcccgatcggcggcatcgtgttcggccacatcggcgaccgctacggccggaagacggcactcctgctgtcggcgggcctcatggcggtctcgaccttcctgatgggctgcctgcccacctacgcgtcggccgggctcctcgcgcccgtcctgctcgtggtgctgcggctcggccagggtctctccgtcggcggcgagtacacctcctcggccatcttcctgtccgagaccgcagcaccggcgcgccgcggcctgaccggcagcctcgcctgcatcggggccgcaggggggatcctgctcggctccattgccgggacgctcgtcaccggcctgctcacaccggaagacgtgcaccagtggggctggcgcctgccattcctcttcgggatcgtgctcggcgtcttcatcttcgccctgcgtcgacatatcgacgacgatcacgtcgagaccgtgtttcgcgaagatcgggcgcctgcggaccagcgctcaccgctgcgcacggcggtcgagatcgacggctccgccatgctgcgcgccttcgcgatgaatctcggcctggcgtgcggcttctacgtggtgttcgtctacctcgtgacgttcatgcacactgtgtcgggcctcccgcaacacacggcgtttctcatcaactcgctcgccatggtggttcaagccgtgtgcatcccgatcgccggagccctgtccgaccgtttcgggcgcaagcgtgttctggtcctgaccggggcgggcctgacaatcctgtcatggccgctcttcatgctgctgaccaccggcgacacgcttctgatcgtcctgagccaggtcgcgttcgcgatcctgatcgccggcaacgccgccgtcgttccgacggcgttcgtcgagatgttccagcaccgctcgcgctgcacggccctggcgatcagcttcaacgcctcgatggcgctcgtcgggggaaccgccccgatggccgcgacgtggatcgtccaccacctggcctggcccacggggccgggcctctacgtcgccgtgctgtcggccatctcgctcgccgcagtcctcacgatgcgcgatcggaccggagaatcgctcgcgtga

SEQ ID NO: 6892 - DNA, 672 bp, Methylobacterium sp.
atggagaccccgaccggggatcacagcggcgccttcgaggcgtccccgctcgccgcgattgccgtggcggtcgcccgcggtgacgtcgcacgcatcgccgcgctggcgcccggcctggatctctccgtccgcggcggccggaacctcacccttctcgaatgggcgatctggaacgcgcggccgcgcgcggtgtcggccctgctcgacgcgggggcggacccgtccgtgccggggctcgatcaggagaccgcgctgcacatggcggcgatggtcgaggacccgacctacctggagatcctgctgcgtcacggcgcgccggtcgacccggtgagcccgcgcggtcagtggacgccgctgttccgcgctgtccagaaccggcgcgaggcgcagatcgcgctgctgctgagggccggtgcggacttgaaccgggtcgacgccaccggcaactcgctgctgcacgtggccgcgcaggtcggagcggccaatccctgggtgctgaggctgctcgaggccgggatcgacccgaccctgcgcaacgcgcagcagaagaccttccagccgtacttcttcaccacccccgagcgcctgctgaacgattccgggcgcgagacccgcgcggcggtccgggcgtggcttgcccgcagaggcgtcccggcggatccggaccgctga

SEQ ID NO: 6893 - DNA, 87 bp, Methylobacterium sp.
gtgaggagcgacaccatgctgaccgccctctcgccgctccacctcgccgccctcagcctgatcgtcgcgtatctcggctggggctga

SEQ ID NO: 6894 - DNA, 225 bp, Methylobacterium sp.
gtgcagagggcgcgatcctggtaccggcgctacgggcgcctgggcgcgccgcagacgccgcgaccggccacgcagggcccgcaggccgttcgcggacgctcgctggaggactgggcgcggctcggcggcggtctgctcggcccggaatccgcagatgccccgcgtcctgagatccgcgccgaccgagcggtcgccctcggcatcccgatcagtccgccggactga

SEQ ID NO: 6895 - DNA, 522 bp, Methylobacterium sp.
atgcgcctcacgacacgcacgccctcccggccgcgatccctgatcgtcggctgcgccgccgcggcctgcgcgttcctggccgtgccctcggaggctcccggtcaggccggaccgggatcggaggaggcgctcgtgaacggaatccagaccatccggcgcggcgacaccgtcacgaaggtcgaccggaccggcaagggtgcggtgctgtgcatgcgcggcatcctgcgggcgatgcgcgccgtcggacaggcgtgccacgacggcgccgacccggacttccagcaggaactgcgcgccgcgctcgcgcgcatcgatcggttcatcgccgacaacgccccggacagggccgtcccgtcgcgcgacgggacgacggaaccccagcatcggcctggcgcggtctgcggccgcgacgcggaggccatgtacgaggcgctgcggaccggcggcgccgcgggcctgcgcgcccaggtcgacgacctgctctcgatcccgcgcgagccggtcatgaatccgtgcctgtga

SEQ ID NO: 6896 - DNA, 525 bp, Methylobacterium sp.
ttgctgatcgtcgcgcatgaggacatcctgccccgcgtatgcgggacggatggtcagagcacgatgttcgagatcgcgcaggatgatctgtccgatacgcagacacgggcgttgctggcgctccatctcgccggcatgcacgcatcctcgccgccgggtagcgtgttcgctctcgacctttcaggccttcaggcaccgggcgtgaccgtctggacggcgcggcgcggcggtcgggtggcgagcgtcggagcgctcaggatggcgacggacggcaccgcggaagtgaagtccatgcggacgcacccggacttcctccgcctgggagccggcgcggcgatcctcgacactatcatcgcggccgccaccgcccgcggcgcgcggcgtctgagcctcgagaccggatgcgggcccgcattcgcacccgcgctcgaactctaccggcgtcgcggcttcgtgagcggccccgccttcgggacctacgtgccgagcgacttcaaccagttcctccatctcgcgatcgcctga

SEQ ID NO: 6897 - DNA, 111 bp, Methylobacterium sp.
atgactttccacagcgccgcgatattggcggtctggtccgttctactcttggttattggggccttaatcccccgcctcctgcaggcgagccggacaccgcggctggtgccg

SEQ ID NO: 6898 - DNA, 666 bp, Methylobacterium sp.
atgaagcggctcatgtcaacgcctcccgaccgccggtcccgcaagcgcctcgccacccggcaggccatctccgacgccgccacgcagctgttcctggagcgcggcttcgacgccgtgacggtggatgagatcgcggcggcggcggatgtcggccggatgaccgtgttcaaccatttcccccgcaaggaggacatgttctacgaccgcgacgaggaggggcgcgcactcctgcgcgagaccctgcggcagcgcgatccccgggtcgcgccggtcgagacgctccgccagctggcgcaccggctggtgacgggccggaacccggtcgtggaattctcggcgcgcagcggcgccttcgtcgcgacggcggccgggagcgagacgctcaaggcccgggcccgggcgatccgggacgaactcgcgggcgtggtgcgggtcgcgctcgccgaatccgtcggccgcgggccggaggatcccgacgccgacctggcggccggcctgctgctggcgacctggagcgtggccttcctccgggcgcaccggaccttccgggcgacgcggcggacggaggcggcgaatgccgccttcctggcggtcgtcgaccgggggacggccggcctcgtggcggcgctggccggcacgccgtacgcggaggccgccgcgccctga

SEQ ID NO: 6899 - DNA, 114 bp, Methylobacterium sp.
atgaccgacgccccagacccgccggaaggaccgcccgggaaaacggcgctcctggtggtcctcaccctcacggccgttgccgccgccgcctacgtcctgatccacatggactag

SEQ ID NO: 6900 - DNA, 1527 bp, Methylobacterium sp.
gtgaacacgatctccgccgcggtccagaaacccgcccccaaacccgatcgggatctcgcaccgtccccacatccggcgggcgaccgtcagacgctgccggatccggcggagcggggcgccttcgacctggtcctgcgcgcggtctcggggggaactcccgcggcccgacccgagaccgacgagggtgagatgggcgaaccggagagcgagaccggggaggacccgcgacccgaggctggcgcatctcccgcgccgccgtcaccggtcgatcccggcaacgccgccgcggcgctcgccgagatcctgagcgccgccgtcctggctgcccgtccggagatgcccgcgggacacggggccggtgctccgggaccggccccatccgccgcatccccggcgggccccgacgcggccccggaaaccagcctcgcggggaatctcgaggcggcccgcgcggacgcgtcgccgcgcgccgggtcgagcccgggccccctgctgcagggcagccccccgaagatcgaggtcctcgaccgggcggttcacttcaagcccgtcctgcccggggcggcccggcacgtcctcccggccgccgcagcggcaacgtccccgttgccggccggcccgaacgcggcggacgctcagcctcgggccgatcgccccggaccggtggttccggccgtcgccgggcccgatccagctccgatcgcgacggccgcccaagtcgccgcccagattgccgggacggtcgccgggaaggtggccgccgcgccgccgaaggcgacggtcgccctcgcgaccgatcccgagccgcgagccggcgatgcgtcggcccgcgccgccgcgacggggatcgacgggccgggggagctcacggcacgcgaggacaaccgttcccgctccggcatcgccggactccgcctcgcccccaccggccggcaggggccgccgggcggccccatccccggtcccggcaacggatccgggaccgagccggcccggctcgccgccgtcctgccggcgatcgcggcggccatcacggaggagatcgagcgcgcgaccgcggccggaccggagcgtcgcgtcggcgccgatccggcgatccccgcggctcaggacgggccgctccgggtgctcaagatccagctccggccggaaagcctcgggatcgtcacggtggagttgcggctcgtcgacggtcagctcgagacccatctgcgcgcggcgcgtcccgagacggcggcgatgctgcagcgggattcggcgatcctcaccgaactgctcaagcaggcccattaccggcccgagatcattgtcgagccggttcgccccggcgacgccgggttctccgcgggcggatcaccgtcacagggccaatccggcctcaccgacggcggcgcccggccgggtcacggcggggacggacagcggcaggaagaccagcgcgcggcgaagcggccgacgatcggcaggcgcgacggggagcggacagatgagacggtacgtcctcgcgacggcggcgtttatctgtag

SEQ ID NO: 6901 - DNA, 135 bp, Methylobacterium sp.
atggccgaaatctgcatcacggaagaccagaacggacggtggaccgtctacaccgccggactggtggcgaccgatctgacgcgcgaggccgccgaagccttcgcggcgagctaccgccgcgtcgcggccggctga

SEQ ID NO: 6902 - DNA, 267 bp, Methylobacterium sp.
ttgacccgatcgatccccgcccccgccctcgtcctcgccgccgccacgctggccgcccttccggccgcggcccgggcgcaggatcggcccggccccggggcggcgcctccggccgagaccgcgccgaagccggcggccgacacgaaggatccgggcaagaccgcgacggaggccgtcacccacccgtccgccgtgccgccgacggagggcgcggtcggcaccggcaagcccccggccaccggcgacgccccgacgaccggccggtaa

SEQ ID NO: 6903 - DNA, 201 bp, Methylobacterium sp.
atgcaccgcatccgcctcggccttcggcggagggcccctgtgccgccggcgccggcgctgcccgagagcctgacccgctacgtgtcgccgccggctcccgaggccggcttgatcaccgcaccgctccgggacatcggcatggcgctgctggtcggtgtcgtcgtcgcgctcgtcggcggccggattctcgaagcctggtag

SEQ ID NO: 6904 - DNA, 513 bp, Methylobacterium sp.
atgcgcggcttggtttcgactgcgacgctctccggagtgctggcgcttgtcttcagcatgccggcatcggcggcctccgatatcacggtcgctgccatcgccaccggtcgcctctatgttgtcgggacgaccgatcgcccgcacacggccgtgattttggacaaccggttcaaaacggaatccgacgagaacaggaagtttcagtacgagttggtgtatcatcctgccaattgtgtggtttccgccgcaatcgatggaacgatacacgaagcggttgtcagcaattgtgggcagcaggtggtgcccggaacttggctggacccgaagcccgcgatgaggaggccgactcctctggaacgggtgctctccccgacggtcgaggtgccctccaccgtcttctgcccctcagttcagacagagcgctcgcaggatccggcacgcatcgagcttgctgaccgcacgccgccggtcttcaccgtcgtgacgggaatgaatttctcgccgcgctactga

SEQ ID NO: 6905 - DNA, 96 bp, Methylobacterium sp.
atgatcctgagggccgagcaggtatcgaccggcttcgtcggcggccgcattcgcgtgcgggctgccgaacagcaggacgcacgtcgccgcaactag

SEQ ID NO: 6906 - DNA, 945 bp, Methylobacterium sp.
atgatgagacctcgctgggtacgccgcgatctgctgaaatcgtgcttccgggatctaccgatctgcgcggccgcgtccctgctgccgaccagccgctcgagcgcggcgatcgacgcctccgtggacccgacgcagggccgcacactcgtcttcgatgagcccttcgcggagatcaacggacggatctggaatggcggaccgaaggccacgaccgggccgtccggcttctacggccgttccgccttcgctccccttgccggagcggaaggcttcaaaccctacgagatcgtcgcggatgcggaggccacgggcggcacggccctccagatttccgcgaagtatatcggacgcaagatgagcgtcgtgaactactatgggaacaacatacccgactatcagtggatttccggaaatctgcagaccggaagccggagcggtgtcgtatcggtcggctggcgccacggttatctcgaagcgcggatgaagtttccgcggcatccgctcacgtggccagccttctggcttctcaaccgagaaggcatcaccaatgccaagcggagcattgaggtcgatatcgtcgagcacaagggtttcgagccgaagctctacggcgcgtacctgcacgaatgggggcagcccggtgagcacaacgaaggcaccggcgttcccacacccgtcgacatgaccgaacagtactgccggtacggcgtactgatccatgacggccaatgcattccttactttgaacgaaaaccgatcatcaatcctaaaacgaatcagctcaatgtctggacactcacccgcgcatcggagatggaacaggccggcgacgtcttctggccgctcctcacattggcgttgcggacggatgtcccggcccctcaactgaccgaagcgcagaagctcacccatatgcgcgtcgattacttccgcgtgtacgcgtaa

SEQ ID NO: 6907 - DNA, 885 bp, Methylobacterium sp.
gtgcgtgacgccgtccgcggacggccgggcaccgcgtcaccgcgcggttcgacggggcgcgcgaggaccgggctgtcgcggcgatcgctgggcctcctggtcgtcctcgcggcgacggcggtctggctcgccgtcgccctcgtgcccaacctcctcgggaagggcggagccctgtgggcgatcgtgcacggcgcgtgcgtcccccacgcgttgcgcggacagggccccgcaccgtgcagcctggtcgacctggagggcggggtcgagaagggatacgccatcctcaaggacctccgcgggccggcgcagttcctcctgatcccgacggcgcgcatcaccggcatcgagagccccgtactcctccagcccggcacgacgaactacttcgccaaggcgtggcgcgcccgaaccttcgtggaagggcgtctcggccatccgctcgaccggcgcgacgtcagtctcgcggtgaactcgcggctgcggcggactcagggacaactgcacatccacatcgactgcgtccgccgggatgtccgcgacacccttcgccgcctcgcacccacgatcggggatcgctgggcgcctctcgcggagccgctggtcggtcgcccgtacagggcgatgcgcgtgctcggggaggatctcggcaccgcggacccgttcgacctgctggcgcgcgacgacggcgcgcgctcggccatgggcgagcacgccctggccgtcgtgggcgccgagtttccgggtgcgaagccgggcttcgtgctcctggacggtctggtgaccagccgcttcggcaaggcctccaacggcgaggtcgtgcaggaccacacctgcgccgtggcggcggagcccgcgtcgagcgggtttcggccgctggaagactga

SEQ ID NO: 6908 - DNA, 300 bp, Methylobacterium sp.
gtgcggaacgcgggcgccgccgtggggcccggcaccggacgcggtgacgccgccgcgcttttcgcgctccgaatcccgcgcggccccttctcggacacctatccgatgggccatgcctcgagaggcctcgtcatcggcgccggactgggacatgcctgtccgcaccccgatgccgtcggcggccgcaaccgatccggcggcgctctgccgggatcgcggcgcgaacgacaggggtgggacgacgcgcgcgaggacctgctcgacgcgcgctccgggagccgggaggccggcgaccgctga

SEQ ID NO: 6909 - DNA, 165 bp, Methylobacterium sp.
ttgctgttcagccgtcaagctgaaccgaccattcggacgtcggatctggtcggagccacggccggggtcgcactcctgggcggcctgtgcttgctgctcgtggccctgctcacgagcgaggcccaggggttcacggatctcacgtcgatcctcacggacaggtag

SEQ ID NO: 6910 - DNA, 282 bp, Methylobacterium sp.
atgctgacgaccctgctcgccgcgatgatccgggaggtgcccgtcgtctggtcgacctcggtcgatgacggaccggtcgatcgcgtgaagcccgacatcgtcctgaccgagatggccgagcggttgctccatcagaccgtcgaggacgacttcgctgtcgcggcgcgggtcgccgggcatgccgcggccgttacagcggggtggcgccggtcgcgcgaagcttcgccgcatgggcaaggcgcggggctaacgcggcccgctgccttcgaccgtcgtggttga

SEQ ID NO: 6911 - DNA, 174 bp, Methylobacterium sp.
atggctgtggagagcgcgaccgcgacggctgagtccttcacgatcccgacaggccaccacgtggacgtggccgaggccatcgaaatgcgctctccggcgaccagcctccgcgccggcgctccgccgcacgtggccgagagcgcgatcaacatgagtttcccgaggacgacatga

SEQ ID NO: 6912 - DNA, 114 bp, Methylobacterium sp.
atgttcaagaacaggccgaacctccatgcgacagccgtgatgaccctcgtgtgcctcggcgcagccaatgtcgtgatcgctccggcgagcgtgctctacctcctgtatgcctga

SEQ ID NO: 6913 - DNA, 225 bp, Methylobacterium sp.
atgcaggcatccgaatgctgcatcatccgggtatctatcgccgcgagcctcggctggctcatcgcgattaccctgatgtggaagcatggcgtgctggccgcgctgatcgtcagccccttgttcgggaccgcggcggcgatcgccgccatgacactgttctggttcgtgagcctgttcgtctcctgcgaacccatcgggccgcgagcgtctgacaccaaccggtag

SEQ ID NO: 6914 - DNA, 285 bp, Methylobacterium sp.
gtggcgaagccggcggcgccgccgcagcaggccgagggcgcgccgggctccggccagccgccggactctccgggccagggcgtcgacctcaacacggcgtccgtcgaggagctgaacgccctcggggccggcatgatcgggcgccggatcgtcgcgttccggccctacggctccccggaggatctcgtgacccggcgtgtcctgaagaaggccgattacgaggcgatcagggctgccgtcgcggtgcggcagaccgagtccgctggcgcgggccgcccggattga

SEQ ID NO: 6915 - DNA, 255 bp, Methylobacterium sp.
atggaagcgatcggcgtcgaggaccggagtggcggccggcgcgacgccagcgcccgcctgcgtcggatcgcggccgcgaccggcgtcccgctcgcggccttcttcggggcgccggcgccgcgcccgctggccgagctcagcgagctgatcggcctgtggcagtcgatcgccgaccaggagggccgcaacgcgatcctggcggtggcccgggcgcgggcggccgggacgaaggacggggcgggcgggccggcctga

SEQ ID NO: 6916 - DNA, 294 bp, Methylobacterium sp.
atgggcctcaccgcgttcgccgtgttcgtcattccgtgggtcctgctcgcggtgttcctcacgcggtccccttcaacgcttcgcctggggaccgcttccgcgccgtggcggtctatcccgacccataaggagatggcccgcgccgaccgtcgcgcgctgcacccgcatgagcggcgggcgggcgagacggacggagtctcgggccgggaccagcgcgttcggaccgatccgcccgcgggcggtgcgctgggcacgagcgtggagcccacggaacccgacgacaagctcagctag

SEQ ID NO: 6917 - DNA, 180 bp, Methylobacterium sp.
atgttgaccatgaccctcgcgctgttggccgttctgattgccggggcgctgtgtctcggaatgatctccgcgttcctgccgtttcagcgtccgcgcgaggagatcgagttggcagagttcgccgacgacgaattcttcgacatcggcggcccgatcatcgatttgcaggctacacgctag

SEQ ID NO: 6918 - DNA, 696 bp, Methylobacterium sp.
atgaacacgacagtcacagcgatcgcgtcggcaatccttgccggcgctctccttggggcgccgaccggagccaaggcgcaggcgggcagcttcgccaaccacggcttcggcaaccacaatttcggagctgcggccgtcggcggcggcttcgccaaccggggcttcagcaatcccggcatcggggccggcgccgcgggcggcttcgccaaccggggcttcggcaataacgccttcgggccggctgccggtgccggagggggtagcttcgccaataacggcttcggcaaccacaatttcggccgaccggccgtcggcggcggcttcgccaatcccgggttcgggcacgggttcggcgcccatcggggctacggtcatcatcgccactacggctacaaccgcggctactacgggcgcccctacggctatggctacggctacggacggggcggatacgcgctcggcgggctcggcctcggcgtcgccgtgggcggtctgtacggcggctacggttatccgggatacggctacgacaccgggtactacggcggttatgcgcccgtcacgtacggctacgccgacaccgaaaccgaccgtgtcgcggacgatgaccgctactgcgcgcgccggttccgatcctacgatccgcagagcggaacctatctcggccgggatggacgtcgccaccgctgccggtga

SEQ ID NO: 6919 - DNA, 132 bp, Methylobacterium sp.
gtgaccggcatcgatggtccgacgacgcgcgggcgactgcagcagatcgacacccacgccctcctgaccatcggcccccaccggcgccgctccgccgtcgggtccgcgcgcgagccggagcctgtgccgtga

SEQ ID NO: 6920 - DNA, 213 bp, Methylobacterium sp.
atgttgtgtaccgaaggagaagggcagcgcggcgttccgggcggtacccgcgccggtcccggcgcggcgcagccggttccgcgttccgatgcggcgggcgagatcggctctgcgcgtctgctgcaggggcgccgcgagatcgtcatccgccacggtgaccacgcctatcgcctgcgggtgaccgccagcgacaagctgatcctgaccaaatga

SEQ ID NO: 6921 - DNA, 153 bp, Methylobacterium sp.
ttgctggtcgtgctggtgttcgctgcactgattggaggagcgatcggcttcgcggttgttctaccgaagggtttcctgctcgcgctgctggccgcccaggccggggcggccgtcgccgtcggcctcgtcgtcctgctcacccgccgccgctga

SEQ ID NO: 6922 - DNA, 273 bp, Methylobacterium sp.
atgagtagtgaatcgacaggtcccgtcacggtccgcggcagcgtcggggtcggcgcgggggtcgcccccgcgacggtgcagggcggcccgctcccggcgacctcgggcggccgcgacggcgcggtcgggccgctggcgatcgagcggttcccgcgcccggtcggccaccgggaccgtcccgacgcgcggctgcggccgcccctgagtccggacaatccccggcaccgggtgcgccggattgacggcgcgcgcgccccgcaacccggccgctga

SEQ ID NO: 6923 - DNA, 162 bp, Methylobacterium sp.
atggacaggcacggccaggaggcgggcgcggacacggctgcggaggcaggtctgggcacggccggggacacggccggggacgcagccagggacactgccagggacactgccgaggcccgggcgccgtcccccgcgcgagcctccgctcggacggccacctga

SEQ ID NO: 6924 - DNA, 141 bp, Methylobacterium sp.
gtggcggcggtctgcatggggttcctccgggggatgcggtcgttgccgcggtggggccggttcgggctctgggtctggatgggagccattcgggcgcgcgccgtcgtttcccgcctgggcgggatcgaagcgatgcggtga

SEQ ID NO: 6925 - DNA, 924 bp, Methylobacterium sp.
atgcggtttgacgtcaggcacatctcgagctgccttgtgctggcgcaggagcttcatttcgggcgggctgcgcagcgcctcgcgacgacgcagccgggtctcagccggctcgttgcggaactggaggccgaggtcggcgtgaagctgttccgccgtacgactcgaacggtcgaggtgacggaggccgggcgtgccttcttggccgagtgtaggatcggtatcgaccatctggagcgggccgtgacgctggcgcggcgcacggcgaccggcatggccggcgtcctgcgcgtcggctacatggatttcgcgatcaacggccggttgccggagctggtccgagcgttcagcgaatttcgaccggcgatccggctggagctgtcgcacgtgccctcgcaatcccagcgcgaggccctgcttaacgaccgcatcgacgtcggcttcacgctcagcgcggtcgagaacgagcacttcgagagcctgctgttcgaccgcgactcctatgtggccctgctgccggtaacccatccactctcgaacgcgcgcagcctgaccctcaaggatctcgccagcgagccgttcgtgctggggtctggcgggagctggagcgcctatcgcgaagccttcttcgcgatttgccatcggcgcggctttcacccgaccatcagccaggaggcctcgtcgagcgagggtatcttcggcctcgtcgcggcgggaactggtgtgagcacctatgcgagctgtgtgcgcaacgtgcagcggcgcgggatcgtaatccgctccctcgacgacgtgcctgataccatcgcaacctacgccacttggatgaagccggcccgatccaccagccttgaagccttcaccaccttcctggcgacggtgtggggctcggcgccggcgcgttccaatacgcggtcgaagttttga

SEQ ID NO: 6926 - DNA, 822 bp, Methylobacterium sp.
atgaagctgtttgacgccgacctcgtcttccctcgggtcccggcgaccatgccaagtccgtggatgcccctcgaggttgggcgggccatgggggcaatctgcaagccccacgacgcgggcggagggacctcgttcctcgggcttcatttcgacgatcactgcttcggcccggctcctgagcatgtggcacacgctgtcttggccctccctgtccgagcgttcgacctcgaacctgacacgcgccgtgaggatctccgcaaggccttttatctggcggctcccggcttcgggcgccgtcctgacttcacgctgggggccggcgcgttcatggtccgcagcttcgagggcgcggacccccgagacaccgtgtacctgatctggccggtgcggtgcgacccgggtgaggcggggttggattgccacaacggcatgggtcggaaggcttttcggttcgctgccgacggcgccttgcgggatgtcagtgcggacgtgctgccggcggatccgctcctgagctccgacgaccgcgtgcgtcagacgaagtacggcggcagcgttctgtttctgctcgacgacaagctgccttatgcgcccaccatgcgctggatcatggaattcgatcctgactcgccaccgctcgagaaggacgatccgaaggccgcgggcccttgggcccacttcggcttcgtccactggaccggttctcgcttcgagctcgtagatcgaattacccgatcgcaatggccgtgtcggaaattccatgacgccccggcctgctcgacgtatcccgacgacttcgaggatccctttgtcatcccttga

SEQ ID NO: 6927 - DNA, 354 bp, Methylobacterium sp.
atggcggtcgagtcgtacggggattaccgtgactatttcgattcgaagcccgtgaccgcgaagcgcgcgccgcgcagcgcttcccagaagatgactcccatcgacatcactacagacctgagcgccgtgcgacgccgcgccgatggcgaccgccgtgagatgtaccgctacgacactgggtcgaggctgatcgctgacatgaggcctcgcaactgggacggcgggcatgttcccgtgcaaccgcacagttggtcgccggatggcttctggagcccgatggtacagtcacgcgaggggcgcgagcggcccgaccagtcattcgaggggcggggacggcccgagcgcttcaggtga

SEQ ID NO: 6928 - DNA, 450 bp, Methylobacterium sp.
atgcgctttgccgtcgccgcccttctctccgccgtgccgctcgccgcagcggcggacgatctcccgccgccggtggccgcggccatcgccgaggtcgaggccgcctgcggatccgcgccggcgacgctcgatccgttcgtcatcgaccggcaggacgtgaacggtgacggggtgccggacttcatcctcaacgtcggcggcctccgatgcggcgacgaagaagtctcccagtgcggcctcatgggatgcccgaagatcgtcctcgcatcctcgaagaacgggttcgtcgtggtgctggacatctacgcgcacgacctccggtttcgcccgctgaatggccggccggcggcttcggcggacgacgagggatggaattgcggctcggtccggagggggccgggccgcacgaccttcctgtgggacggaacgcgcttcgcctgcgccgagtag

SEQ ID NO: 6929 - DNA, 90 bp, Methylobacterium sp.
atggcttggtccgcccccgtcgtctccgagatctgtgtcggcatggaagtcaccagctacgagtccgctgagatcgacaccttccactaa

SEQ ID NO: 6930 - DNA, 96 bp, Methylobacterium sp.
atgaagcccaacacgatcgcgccgatctccagcgaccgacgcgggaacgggccggaccggcagagcctgccggtcgcccagggagaggaggagtga

SEQ ID NO: 6931 - DNA, 81 bp, Methylobacterium sp.
atgatggagttcatgaacttcgtcagcaccacgtccccgtacttcgggtccgggatgatctcacgcttctcggcagagtga

SEQ ID NO: 6932 - DNA, 144 bp, Methylobacterium sp.
atgaccgatcttctcgtcaccctccaggagccagccgaacccgccgggcaggccgggccggaatccgagacgtcggccctgcgcgcgcatatcgcgcggattctgcgcaggctgcctcccgccaaggcgacgaagacgacctga

SEQ ID NO: 6933 - DNA, 219 bp, Methylobacterium sp.
atggtagagcggtaccatttccgcctgagggggccggacgaggtcatcgaggacgaggagggcgtgctggcaaactcgatcgagatcgcggtggccgaggcgacgcagctgatcgccgagatgcacgcacggggcgagttgcccgatcccgacgagcgctggtgcgtggagatccacaccaccgacggtgtcgtgcttcgttcccttcagctgtactga

SEQ ID NO: 6934 - DNA, 369 bp, Methylobacterium sp.
atgtcaggacctcgccccatcgccgtcctcgccgaggacgaagagttcagccgcctcgtcgcggcggacatgctgacggcgttggggttcgaggtgctggaggcggaacacgcccagggcgcgctccagcatctggaggcatgtgacggggccgtcctgctctacaccgacatcaacatgcccggcacgatggacggccgcgcgctcgcgcacgccgtccgggcacgctggccggagacccggatcatcgtctgctcgggctgcgatccgcgcgaggcgaccgcgctgcccgaggaggcccatttcatcgccaagccctgtggggagaaactggtgcgcaaggcgctcaaggccctgcacctgcactag

SEQ ID NO: 6935 - DNA, 1875 bp, Methylobacterium sp.
atgatcatccgccacacccgcaggctgcagcgatcgggcgaggcggtcgcgagccgcgatggtcggctcgtcgcgcctgccccgacggagcccgactgggatatcctgggtctgatcgatctcggcgggcgcgccacggtggtcgcgctcctgggtccgaacgacgcgcgcgcgttccgattcctgaacccggacggcacagcgctggcgtcctgcgctgcggactttctcgccgcgccgtgggacggcgccggcccgctcgactggcaggccgaggcgctccacaccgacgacggcgacgcgtcgaacacgcgggccatgatcgaggatcttcacctcctgatcgaagccctcgcgcgcgcggctgccgcgagcccggagcacgctgtccgggtcgtcacgggcggcggttccgatccgcgggcgcaggcgatgcacgcggcgctggcacgcctcaacgccgcaccggcgggggctccgccccacctgcccgaactggtgacgaaggcgatcgtcgcgcgcggcggccaggagacggcccatccggacggcggcgatctgcgcttctcgatctacctgcccatgccgggcttccgctttgtcggctacgcggcggaccggaacgagacgctgtgcacgctgatcggcaagaactcgcgcctcgcatcggccctgctggacgttcgcgcgaacacggcctacgcccggccgaacctgggaagcgtcgggttcgacgccgcgaccctggtgcaggtccggttgtggcggcagtacctcctgccggcgctgatcgacggcgcggcgcggtcgacgcgcgtcggggtggtcttcgagcacgcgcacatcagtcacgccatctggaacgagctggccgcggtcgacgacgtgctgtcgctcggtcgcgcgccggcggtgttcctgttcgcgagctgcaacgagccgatctctcccgtcgacgccgtcttcccggagctcgccgggcacgtgtatcgcgggatcgaaggcccgctgcccctgctgcaggccgccgtcgccggcgcggcgatcttcctgcccttccggtcctaccgcgtgagccagcgattggccgatcgtctcgcggccctggcgcggagcgcggaacccgcgctcgatgctcgcctgacggacgcggcgcgccgggccacgatcgtcctgatcgggctgcgcttggagaaccgccagtgggtccggcagctcgacggctacgtggcgctgatccgacgcctcggccggcggcgcggggagaggttcctcgtcatcgtcgacgggcacaacacgctcgcgggcgcggagggcggttacgtcgagagctactgcgagagcctcgtgcccgcggaagggagcgtgccatccatcgtccggaaggagctcgagctgatcggggcgctgcgcgcacgggtcgccgacgtctccaacgtggagttgatgccgctcgtgccctgctcgatgggggcgagcctcgtggccgcgctccacaccgacctgttcgtgacgcatttcggggccgggctcgccaagtataagtgggtcgccaacgcgcccggatgcgtcatatcgagccgatccgtgctcagcgggaaggacgatctgcgcatctacgacaccgagatctttcgcgagaacgtgtcggcctgtcactactttcccgccgagcgggtgacggacctcgacacctcgaccaacgccctgcatgtccccggcagccgggagcgcgaggatttcgatctcgacctcgaagagttcgccagcttcgtcgagcagaacctgccgaagcggcgcgccgcgcgcccgcactggctgagacggctcaccctcttcaggacccgcgccgccaccgacgcggccaggctctga

SEQ ID NO: 6936 - DNA, 99 bp, Methylobacterium sp.
ttggtcatccaccagggcgagcaggagatgctccagcgtcgcgtattcgtgccggcgctccccggcgagcgccagggcgcggtggagggcttgttctag

SEQ ID NO: 6937 - DNA, 138 bp, Methylobacterium sp.
atgctcgaaccactgctcttcatcggcctcatcatcgcggctgtggctgccgcgacccggctcgggatcgccgctgcggcaccgatggcaccgtcgcgcctcgacgcctgggacggacgcgccgacgcggacgcctga

SEQ ID NO: 6938 - DNA, 132 bp, Methylobacterium sp.
atggccacgaagatgatgaccaggggcatgaccgtgaccgaccacatcgtggcttggtcgatgctgactggcttggcgctcgccgtcctccagctcgccctgaccgcggccctgccgacgcacttcgtgtga

SEQ ID NO: 6939 - DNA, 633 bp, Methylobacterium sp.
gtggtcgacgagggcatccgcggcgaagaccatggccgagaacacgatcagcccgacctgcttacggtggctgtcgcgctcatcggtatcgcccgtgtcgcgcgcttcggacggcccgtgctgttgcgcgtggcccgcgtgagggggctgcgacgcgctctcggtcgatcgctccccgtcatccgcgcgggcgtcgtcgggcgacaggctcagggccgcggccgcgacgagagccgcgagcagcgcggccgggtgaacagagagcttcgtcccgcgggcgccctgcgggatcgggagaagctcgggatagcgtcgggcgatctcgttgatgagagcgcggaaatcgctgcctcgcatcgggctgtccaagacctcggacgcgatgacgtagctgccgtcgatcctggcgaaatgcatgacggcgtcgccatccggccggcagaagacgaaccaggggtccgcctcgtcgctcaggccctgctcgctgccgatctgcaggccggcccggatcagcgcggcctcgacgcggtagaattccgcgagctcctgctgcgaccagccgccctggcacgtcgttgcgggtcggaagaacgagatgaccgcgcccatcgggacctcacgtccgcacagtga

SEQ ID NO: 6940 - DNA, 420 bp, Methylobacterium sp.
atggcccggcgcagcggcactccggccgggaccttcgccggcccgcgtcgggcctggatcggaagtgcttgtctgagccagcacgagacccggcggttgatccggacgcgcgcccccggccgcgtccggtggaacggccgccgcctctctgagatggcccggcgcatcggcgctcccgccccgcccgtcgccatcttgaccgcggccttgatcggtggcctcccccgggagctgcgtgaggtccgctgttggacgcaggcccggatcggacgccgcgctgggaccgccggcgacgctgtgcttcacccgttcggatgcacctgcgccgacgccggagggatccgcatccgcgaccgcgtcgtgccctccccttgcctgcggcgagacgtccattcgcagaccgttgtccgggctacctga

SEQ ID NO: 6941 - DNA, 141 bp, Methylobacterium sp.
atggccggcatcccgggcgtgcggtgccgtgtcttggtcatgttccggcgccaccgcgctccgaaccggtccctcgccagcctgcctgtgatccgcttcggcggctctggcctcgatctgcaggttggctgccggtgctga

SEQ ID NO: 6942 - DNA, 117 bp, Methylobacterium sp.
gtgaacggcgggaccctgtgcgtgcggtccattgtcttggaggtgcccgggcggctcgccgcttcgatcgtcctgcccggggcctggatcggcagcgcgcacctgcgcgccggctga

SEQ ID NO: 6943 - DNA, 666 bp, Methylobacterium sp.
atgcgtgagatcaccggctccctcttccagtccctcgacggcgtgatccaggcaccgggcggtccggaggaggatcagaccggcttcgcgcacggcggctggaccttcccgtacttcgacgcgtcgctcgccgggccgatgggcaagctgctcggcggcgatgacgagctgctgctcggccggcgcacctacgagatcttcgccgcctactggccgcacaacgccgagcagccgatcggcgcgaccttcaacgcgatccgcaagcatgtcgtcaccggaagcgacgccgcgctcgactggaacaacagccgccgcctcgccggcgaccccgtcgcggcggtcacccgcctcaaggagagcgagggccccgacctcctcatccagggcagcagcaggctctatccggcgctgcttccggcgggcctcatcgaccggctcgtcctgatcacattcccggtcatgctcggccgcggcaagcgctggtacgcggacgacccggcggcggcccgcacctggacgctggtcgagcagagccactcgccgaagggcgtccacgtcgcggtgttggcgcgggacggggcggtccagaccggcagtttcgccagcaaaccacccagcgcggacgagatcgcgctccgcgagcgccaggcggcgggtcgctggtag

SEQ ID NO: 6944 - DNA, 345 bp, Methylobacterium sp.
atggcggtcgcctgccctgttctgacgcccgaagagcgcaaggcgtccgagatcctggacgccgcgcagcgcgcgatgatggagacggtgcacgcggcggtggcggaggccgccgcgcgggtgcgccagcagagtctcgacgccggcctcgatctcgccccgccgccccgggcctatttcgagtccgtggtgcaccagcggatgtacctgacgctctgcggggcggcggtcggcacgttcgcgggcggcgacgccaggacggcgatcggcctcatccggaatcagcagctgatcgccaaccgctactgggcggccgggatcgcggtgacgccgagggcgccgtga

SEQ ID NO: 6945 - DNA, 279 bp, Methylobacterium sp.
atgccatcgacgccgcctcgcctcgccttctcgcacgccgggcaggatttcatcgtcaaggcgcggcctgtgtcggatggcatcgaggtgcgcggcttctggcatgctcgctctaggggccggacccggttctttgtcgttgtgccagccgacgcccttgagaaggccaagcgccccgattgggctgatccggtgcaagccgcgctgaagctcgtccggaagcagattgtttcggcgatcgacgagggcgagcccctggccgaggaccctcagccttga

SEQ ID NO: 6946 - DNA, 99 bp, Methylobacterium sp.
atggccttgaagatcttttcttacgcaatgatcggcgccttcgtgggcggccttgccatgacagtaatgggctctgcgggggtgctgatgggcctttga

SEQ ID NO: 6947 - DNA, 216 bp, Methylobacterium sp.
atgcgccgcacggccgagatcctgaccaccctcatcctgttcaccgtcgttatgtcggcgctgggatgggtagcgagcattacagcgcccggcatcggcgactggctgtcggccaggatcggcgaaggcgggatctgggctggcttcgcggtgctctgggtcacggccggcgtgctcctctaccgcgagaaggctggcagggcggccggtaagtag

SEQ ID NO: 6948 - DNA, 2526 bp, Methylobacterium sp.
gtgggcgacgcgcgtcccaggcagacgacggcgcgggtcctcctcgcgagcctgatcggcacgacggtcgagttctacgacttctacatctacgccacggcggcgagcctgatcttcgggccgctgttcttcccggcggcgctgcaatcggcggagctgatcagcgcctacgcgagcttcggcctcgccttcgtggcccggccgatcggcggcgcggtcttcgggcatttcggcgaccggatcgggcgcaaggcgacgctggtcgcctcgctcctgctgatggggctcaccacctcggccatcgggctgctgcccaccttcgcgctggccggctggctcgcgcccgtcctgctctgcctcctccggttcgggcaggggctggcactcggcggcgagtggagcggggccgcgctgctggcgctggagaacgccccgccgggctggcgtgcccgctacgcgatgttcgcgccgctcggggcgcccctcggcttcttcgtggccaacggcctgttcctcgtcctgaccctgaccctcagcgcggagcagttcgcggactggggctggcgggtgcccttcctgctcagcgtgcccctggtctggctcgggctctgggtccgcaccaatctcggcgagaccgaggagttcgccgccgccgtgaaggacgcgcagcccccgcgcgtccccctcgtcgccctgatgcgcgaccatgccgggcaggtcgtcgccgggatgttcggggtcgtcgcgtgcttctccctgttctggaccgccaccgccttcgcgctcggctacggcacgacgacgctcggctactcccgggcctcgttcctgacggtcgagctcggcgcgatcctgttcatggccgccgccatcgtcgtcgcgagttggctgtccgaccggctcgacccggcccgggtcttgatcgtcggctgcgccgggaccatcgtgtcggggatcctgctggcgccgatgcttggcagcggctccctcgcgaccatcttcgccttcctggccttcgccctgtgggtgatgggcttcgtcaacgggccgctcggcgcgtggctgccgagcctgttcccgccgcaggtgcgctacacggggacctccgtggcgttcaacgtcggcggcatcatcggcggcgccttctcgccgatgatcgcccaggcgctggccgcgcagagcggcctgaccgcggtcggcttctacctcgcgctgaccggtgggatcagcctcatcgccttcgacacgagcgcccggcggcgggcgctggacgcgctcgcccggagcgagcgccgctaccgcgcgctgttcgagcagagccacgtcgcgctgtgtgaggtcgatctctccgaggcgcaggcccacctcgccgaggcgcgggccaccggcgccctcgggcccgacctccgcgggcaggccgacgccgcgctcgtcgccgcgctcgtcgccgaatgcgcccggcggatcgcgctggtcgacgtcaacgacgcgacggtgcggctcctcggctgcggctcccgcgaggcggtgctcggctcgatgagccgcttcctgccgccgggcaacgacctcgtcctgccgctcctgcagcggatcgaccgggcgggcggccgcttcgaggcccagggccgcctgatccgcgccgacggacgggaggtgaccgcgatcctcgtcgtggcgctgccggacgacgaggcggccctcgaccgggtcgcctgcgcgatgatcgacgtgaccgagcgggagcgcgccaaggaggccctgctcgcggcccaggccgagctcgcccgcgcgggccgggtctcgaccgtcggggcgatctccgcctccatcgcccacgaggtcaaccagccgatcggcgccatggtgatgagcgccgaggcctgcctgcgctggctgcggcgcgagacgccggacctcgaggcggccgcgcgggcggccgagcgcgccgtccgcgacggcatgcgggcgagccggatcgtgcagcggacgcgcgagcagctccgccgcgaccgcagccagcccgagatcctcgacctgggctccctcctggcggaggtcgcgaccctcctcgaccgggagatcctggcggccggggcgacggtgcggacggtgatcgccgcgaccgaggcgcgcgtcctggccgaccgcgtcgagctgcagcaggtcgtggtcaacctcgtgacgaacggcctgcacgccgtgcgcgacctgcccgagccccgccgcgcgctgcggatcgcgctgaccgcccccgcgccgggccggctgcggatcgcggtcgtcgacagcggcaccggcatcgatccggagcagctgcccaggctgttcagcccgttcttcaccaccaagcgcgacgggatgggcatcggcctcgcgatctgccggaccatcgtcgagtcccatggcggcacgctgaccggcgggaacaacgacgggccgggcgcgaccttcgcggtcgagctgccggcggccgagccgggcgcggcgggcggcgccgcggccgagcccgccgccgccggctga

SEQ ID NO: 6949 - DNA, 231 bp, Methylobacterium sp.
ttggcggatcctgaattcgagattggaaaattcgggccgaacgacaagagatcggtgctccggcagatcgcgcacgccctcggagtgcccgaagacgctttcctcgacgagtccgaggcgctcgccacgatcgacatgacgggggatttgctgcgcgtctggcacgcgctcaccctgtcggaccgccgcttgctgctgcagatggcgcgcgggatgatctcccgcggctag

SEQ ID NO: 6950 - DNA, 210 bp, Methylobacterium sp.
atgagcgatgacgtggcggccctgctcctcgcgctcgcgaccgagaacgccgagctgcgccagcagctcgccaccgcgcaggacatgctgatggagaccgccatcgatgccggccatctccacgcccgcatcgaggcgcttcaggccgagcgcgacgcgtggcaggcggaggccgagcgcttggcgcgccggcccccgcgttccctgtga

SEQ ID NO: 6951 - DNA, 195 bp, Methylobacterium sp.
atggccatcgatagatccggtgagcgtgccgcgctcgataccgaggtagaggacacccaggacaccatcgcgaagcttcgcgaggctgccgacggaacgccgcccggacacagttcgcgcgtggcgctgaagaaggccgaggaaaagctggccgagctggtcaagcacatcacccggcgcgaccggacgggttag

SEQ ID NO: 6952 - DNA, 129 bp, Methylobacterium sp.
ttgatcgccctgtccggtatcgagcgcgcacgaaccgcgccgacctgcggtggggcggccattctcgatctcgctctctgcctgatcctgtccgtgactgtcgtcgggctgctcctcctggccctctga

SEQ ID NO: 6953 - DNA, 225 bp, Methylobacterium sp.
atgccgaagcacgcccgcctggccctggccgccgcgcttctgtcggccctcgcggcgggcgccgtccgcgcggacggcacatccgctttcggggctgccaacgcggcccagctccggggctacaccgcgagcccggcccagatctacgttccggcaggcggcccgagcgccaagcccgcggcccctgcaacgcagcggccgaaggcgccggcgcgcagccgctga

SEQ ID NO: 6954 - DNA, 198 bp, Methylobacterium sp.
gtgacgatctgcgcgcgcaccggcggcgagccgccgctctgccgcatcgcggcccgctgcacctcggaggcgctgctccgcgaggacctgttccgagaggatggacgccccttcagcgggacggagcgcctgcgggcgcaggcgatctcgcagggctgctacgccaccctggaggccgccgcgcgatccgcgcgctga

SEQ ID NO: 6955 - DNA, 339 bp, Methylobacterium sp.
atgcgcaagatcggtatcatcgccactgccgccgccatggctctcggcagtgttgccgtcaccacgagcgccgaggcgcggccttacggctaccacggcggctacggcggctacggccacggctactaccgcggccgtcgcggcatcggcaccggcgccgccatcggcctcggcatcgccggcctcgcggccggtgcgatcgccgcgggcgcggcccgcgacagctactacggcggtggctacggctacgccccgtcctacggctacggctacgccccggtctacggcggctacggctacgccgctccgggctacggctactacggctacggctactga

SEQ ID NO: 6956 - DNA, 102 bp, Methylobacterium sp.
atgaagggattcacgaaaattgtgtcgtacgcggcggccgcggcggcggtctgcatgctcgcggttgtggtggtccaatcggcggggctcctcgccgggtga

SEQ ID NO: 6957 - DNA, 1530 bp, Methylobacterium sp.
atggccgcggcgctgcttgcgccggcttccggccgcgcggaaacgacggtgaaggcggtgctggaggccgagatcgtcaccctcgatccctacttcaccacggcctacatcacgcggaccttcggctacatgatctacgacacgctgttcgcgccggacgcgacgggcgtgttccggccgcagatggtcgacacgtggtcggtgtcggacgaccggctgacctggcgcttcaccctgcgcgaagggctgcgcttccacgatggcgcgccggtccgggccgccgattgcgtcgcctcgctgcggcgttgggcggcgcgcagtgcgctgggcggccggctcatggatgtgacctcctccctggagcctgtggacgaccggaccttcgtgctgacgctgcgggagccctacggtctcgtcctcgacacgctcggcaccacgtcgagccccacaccgttcatcatgccggcccgcctcgccgccaccccacccacgacgcagctcacggaggtcgtgggatccggtccgttcgtctacgaccgcaccgcccacatccccggcgaccacatgctgctgcgccggaatcccgattaccggccgcgtcccgagccggccgacttcctggccggcggcaaggtcgtgaaggtcgacgccctcgacatccgcgttatccccgacggtgcgacggcgacgggcgccctcggcacgggcgagatcgactacatgcagtacgcgcccttcgacctgatcggtcagatcgaggccaacacgagcttggcggtgatgaacttcaccggctcgcacaggttcacgggccactatcgcattaacacggcgtccaagcccttcgacgacccggcgatccggcgcgtgctgctgcgcctcgtcgatcagcgcgaggttctggacgggttcggcctcgatccgcgcttctcgcagacctgcgacgccttcttcatctgcggctcgccctacgagacgcatgtcgggacggacctcctgcacgacccctcggtggcggcggcccgggctgctctgaaggcgaccgcctacaagggcgaaccggtgaccgtgatggtggctaacgatctcgaggcggcgcgcgtgtcctcgaccatcctggccgaccggctgaagcaggccggcttcaccgtcgacctgcaggtcatggattgggcagccctgctcgcccggcgcaccaagaaggccggctggagcctcttcggcatccacgcacttggtctcgatctcagctcgccgctgacgaattccgcaatcaacttcaactgcaaggacgcggcgagttccggcttcatgtgcgacccgcgcatggtcgccctgttcgaccgcttcgcccgtgagccggatccggacaaacggcgcgtcatcgccggcgagatccagaccatcgtctacggcgaagggctggtcgtcccgttcggccagttcgcgcagcccgcggcctatcggaggtcgctcaccggtctgatcccctccgccatcccgctgttctggaacgtcgcgaagccatga

SEQ ID NO: 6958 - DNA, 264 bp, Methylobacterium sp.
atgctcaagtccctcgccgccgcggcactgctcgccgtcggcatcgccgcgccggcctcggcgctgcccgtcgcgggttctccgcttcccgccgcgcaggacgggctgatccagcacgtctacggcggctgcgggccctacggccatcgcgggccttacggtgggtgccgccccggcggccagtggggcgggtatgtcggtcgggcctgcccgcgcggcttccacctcggtcgcggcgggcggcgctgctggccgaaccggtac

SEQ ID NO: 6959 - DNA, 138 bp, Methylobacterium sp.
atgaccctcctcactgccctgtccctcctccccttcgccgccatcgccaatttcgctctcgtggtggcgctggccaatcacttcgacgccgacaagccggccacgggcttcaccggcccggttccgaacctggcctga

SEQ ID NO: 6960 - DNA, 192 bp, Methylobacterium sp.
atgtcagtctccgcaggccaggaggatcagatgacggctccgttctccctcatcaggcgatggctcgactgccgtcgcgcgcggagcgaactcgcgtcgttcagcgagcgcgacctcgcggatctcgatctcgtcggctgtgacgtgaagcgcatcgcctcggcgcggtccgggcggagaggcgcggcctga

SEQ ID NO: 6961 - DNA, 147 bp, Methylobacterium sp.
atgcgctaccgggccgtaagtgtcttggatgtgtcggcgatggcttcggaagagaacccgacggacgagaccctcatgctccgcgagcacatccgccgtatcctgcgcaagctctcccgcgcgcgggccgagcttcagtacggctga

SEQ ID NO: 6962 - DNA, 306 bp, Methylobacterium sp.
ttgctctcctcccccttcgaccgagccctatctacgataccggcctccatcggccggggggccgagtcgatcggtgacgacgtggcgaacgcgaccttcgagatcctgaagggcatccgggcgcgcgtggcgatgccggctatggcgggcggcttcgacgcgcgtgtcagcgcgatcgcggcggccgtcgttgccctggagaaccggtccggatgccgatcatccgccgaaagaatgccctgcgccgcgtgggagattgaccgaaagcaaggcactcggcagagcgacacgatacagctcagctga

SEQ ID NO: 6963 - DNA, 675 bp, Methylobacterium sp.
atggaccatgcggccgacccagatcccgtcctgatccgcctgcgcgagggcttcgagcgcgtcgccctcgtgctgcgggccgatctgtgggcggccgcgggcgatgcgggtctgaatccgacacaggcgcaagtgctggccctgctcgcggggcgtccgggcggcctgagggcgaaggagatcgccgcgcagctcgccgtctcggcaccgagcatggccgacacgctctccgcgctcgcgcgcaaggccctgctgacgcgcgcgcccgattccacggatgcccgcgcggtgatcgtgcgcctgacggatgaaggccgtgcgctcgggcgcgccctcgccgcggccacgtcacaggtgatgtcggccctcgcgcggctgactccgcctgagcaggcggatctcctcctgacccagatcaagctcatccggaccttgcagcaggcgggtgccattcccgtgcagcggatgtgcgtcagctgccgccatttcaggccgaacgcccatccgggcgaggcccagccccaccattgcgccttcgtgaacgccgcgatcgggacccgggatctccggctcgattgcggcgagcatgaagcggccgatcccgacgtccaggctgccacctggacgtccttcgcgaatggatcgccgcccctccgagcaccacgagagacctga

SEQ ID NO: 6964 - DNA, 720 bp, Methylobacterium sp.
atgacgaggatcaaggcacggggcgtcggcctcgtggcggcggctctgtgcgcgctctccaccggcgcctcggccgagcccatccgggcgcagccgaatcccgctgtcctggcgtcgttcgacatcgtcgagacgacgatcgcgaccaggggcgacaccgccgtcttcaccacccgtgtccggggcgaggcgggcaaggacaagccggatgccaccggcaagttcgagggctcgagcgtttacgcctacgtctggccgacgaccctcgacagcgacgcgatcggcttcgacaaggctcagggtatcgtggcgctcgccgtcaccttccaccccgatttcgacgacgcggcctacggtgccaggaaccgccacgtctggcacccgcactgggtggtgctcgccagggacgcggcctgcgggggcggcctcaaggtcgtcgatatcccggacggcgcgaagccgaaggttccgccgacctggccgaaggtcccgctcctgatcgacagcccggactacccgaccaccttccggggcgacacggttcaggtcgagatcccggtctcgctcatcaccggcatcaagggtgcctcgttcgacggggtgacgtccggcctcaaggtcaacggcaacctgcacgcgccgctgctctgcgtgagcgacgtcttcaaggtcgcctcgggcaacctgtcgctgccgggcaaggtgacccctcagaagtag

SEQ ID NO: 6965 - DNA, 549 bp, Methylobacterium sp.
atgaccatcctggcccccgaactggtgaccggtcgctggttcaacacgcccgcgccactctccctcgccgcgctgcgcggcacggtcgtcgtgctgcacgcgttccagatgctgtgccccggctgcgtggcgcacggcacgccgcaggtcgagaagttgcaccggatgtttgccgggaacggcgcggtcgcggtgatcggcctgcacgcggtgttcgagcatcatgccgccatgaccgaggtcgccctcgaagccttcatacacgagtaccgtctgcccctgccgatcgccgtcgaccgccgcggggatgacggtccgatcccgcagacgatgcggcgctacggcatgcgcggaacgccgaccacgatcgtcgtcgaccgcgacgggcgggtccgggaacacgccttcgggcaggtcgacgacctcgcgctcggaatcctggtgggctcgctgatcgcggtaccgggcacgggatcggtgcgcggggcattggcgcctgacgggtgcgacgaagccggctgccggctcccggaggaaacgcggccatga

SEQ ID NO: 6966 - DNA, 1623 bp, Methylobacterium sp.
atgtcgagtttcgacgagtcggtcgcgcgccagcagcggttcatgggaccgctcctggtggcggcgatcctgttcggcctggccgggctgccggtcgcggtctggctcgacctgcgcggcctgtccgagcgcatgctcgccacgcaggcgatcgagaccggccggatcatcgaccagatgcgcagcttctacgccagcgacgtcgtccaggcggtcaacgccgcgaccggtcgggtcgagacgcggcacgattacaagggggtgccgaacgcgatcccgatccccgcgacgctctccctggaactcggcgagcggatcagcggcggggacggcgcggtgaagtaccgcttcgtctccgatctcccgttcaaggaccgcaagccgcacgatctcgacagcttcgagacccaggccctggcggacctccgggcgcaccccatgaccggcttcgtcagcgagacgacggggtcgatcttcgaccggcaggtgcgcatcgcggcgccgatccgcatggaatccgcctgcgtgcgctgccacaacgcccatcccctgagcccgaagaccgactggaaggtcggcgacgtccgcggcatccaggagatcgtcctgcaccagccgatcgccgccaacgtcttcgcgttcaagtacctgctcggctacttcatcctggcggcgctcgccggcaccaccttccttctgctgcaggcgcgccagtcccgcctcatcgaccggatgaacagggagctgaccgagtcgaacggcttcctggcgtcggtctcggtgcagatcgccaagtacatctcgccccaggtctacaagagcatcttcagcggcgagcgggacgtgtcggtggcgaccgagcgcaagaagctgacgatcttcttctccgacatcaaggacttcactgcgaccaccgagcgcctgcagcccgaggagctgaccgccctgctgaacgagtacctgaccgagatgaccgccatcgcggtcaggcacggcggcacggtggacaagtatatcggcgacgcgatgctggtcttcttcggcgacccggagagccggggcgtccgcgaggacgcgcaggcctgcgtccgaatggcgatcgagatgcagaagcgcctgggccagctgaacgcccgctggcggcgatccggtatcgagcgcccgttccaggcccggatcggcatcaacacgggctactgcaacgtcggcaatttcggcagcgacgagcggatggactacacgatcatcggcgcggaggcgaacctcgccgctcgcctgcaggcggccgctgtcccgggcggcatcaccctgagttacgagacctacgcgctggtgagcgacatcgtccaggcgagcccgcaggagccgatccgcatgaagggcatcagccgcgagatcgtaccctacgccatcgagggcgaccttaccgccgaggccccggagacgatcttctccgagcatgcccgggggatcgacttctacgtcgacgtcgatgccctggagatggagggcgcggcgcggctccggaagcgcctgctcgacacgctcgccgccgtcgaccgccggatgaccggggcgggcaccccctcggacgacggcacgcggccctccgcggccggctga

SEQ ID NO: 6967 - DNA, 1890 bp, Methylobacterium sp.
gtgacgacgccgctcgaccggcgacggctgaacctgcgctggctctgcgccagctgcctgatcgccacctgcggcgcggccctcatgggggcggcgctgcgcatgtccgtcgacaccgatctcgcgccggcaaagccggcgttccgccagggacccgcccaggtcgcggaggggcagggggtggtcgggcagcgcggcgaccgcctcgtgcggcgccaactcgtcgcctcggaccgggaggaattctccgcgccggtgacccaccaggtcggcgcgcgcgagatcatccggacccagcccttcgtgcgactggtcacgagcctgtcctccggcgacgcggtcgatgggcagatcccacccttcgatccgacgcgccagctcgccgaggacggggaggtcgctccggtcgccgacgagccgggggacgatccgtccgggaccacggtcacgatcacgcgctccgcgctcgcgggcacgccggtccccgacgacgcgcccggactgagcgacgaggacgtcacggccctcgtggagaggcagtcggatgaggcgcgacagacggggccgcggatcgccgtgccgctcgcgccgcagcggctgctctcgcagattctggtcgccgcgccggccgacgccgccgcgacggccgccggcgccgatacgggccgcgacccgttccacgcgatcgaggtgcgggtcgttccggagaacatcacggacctcgccgagacccagcccgcctccggcctgagcctgaccgagacacgcgacgtcgtgctcaagcgcggcgagactctggccgacgcgctggcggcgaacggcgccgagccggcgcgcgtgaccgccatcctggccgccttcagcgagcatgcccgcaccgggctggccgaggggcagcacgttgacctgctcctcgtccggtcgcacgccggcgaggcagcgcgccggatcgcccgggtgacgctctacggcgcgggcggcgtcgaggagatcgtcgcggaacgggattccggcggcttcgtcacggtggcgccgccgtcggcccaggtcgcggcgtcgcattccggcgacgacggcgacggagagggttcgggcgccagcctctacaggagcatctacgaggcggtcctgcgcaacggcctgcccggcatcctggccgagcgcatcgtcggcatcttcgcgttcggcctggacatgcagcgccgggtcgccccgtccgaccggctggaggtgctgttcagcccgagcgagaaggcgggcggtgcgccggaggtgcgctacgtcgccctgacgctcgacggggtgaagcaccgcgcctaccgtttcgaggcgcccgaggccgggacggcgagctacttcagcgagacgggcaactcgctccgcaagttcctgatgcgcatgccgatcgccgacgggcggatcacctcgccgttcggcacgcgcgttcacccgatcctccactacgcccgcttccacaacggcgtcgattgggccaacaaggccggcacgccgatcatggcgacgggcgacgggacggtggcgtatgccggcccgcgcggcggctacggcaaccgcgtcgagatccaccacgccaacggctacgtgacggcctacaatcacctgcagcggctcgcgcacggcgttcaggtcggcgcgaccgtccatcaggggcaggtcatcgcctacatgggctcgaccgggctctcgacgggcccccacgtccactacgaggtgagcgtcaacgggcgcttcctcgacccgatgacgatccgcctgcccgacagccagggcgtttcgcccaggctgatgacggctttcgagcggcaggtggcggccacgaacgcgctccgccaccacggcgccctggcgatgtccgccctgccgctctga

SEQ ID NO: 6968 - DNA, 1212 bp, Methylobacterium sp.
atgaacggtgtcgccccctcgatccgccctgccgcgcgagccggagatccggacgcggcgtttctcgcgaccgtcgcgacgcttcggcccctcatcgcggagcaccggtcggccctggctgtcggcccggacctgccggagccggtcgcggaggcgctcatcgacgccggtctcgcgcagctctggcttccgcggggcctgggcggtcccgaagcgcatccgctgagcgtcctggcggcgatcgaagctctggcggaactcgacggttcggtcgcctggtgcgccgcgatctcgtccgggggcgcgtcacgcttcgccgacctgatcgacgcggacgtgatgcgttcgctcatccctgccggcaggaagttcgcgggcagcgggagcggccagccgacggggacagcggttcgccatggatccggctggcggatcaacggacgctggtcctgggcgagcttctgccgctacagttccgtgtccgcattgatgtgtgtggagatcgagggcgagcggccgaagctcgacgagaacgggcggccgtcgctgcgcggcgtcttcatcgcctcgaaggatgtcgaggtcgtcggcaactggaatgccggggggctccgggccagcgggagtcacgacgtcgcgtgcaccgatatctgggtgccgaacgagcagaccatcgacggcgcgagccttatgatgcctcgcgacagaaagcccctctacatgctgcccatggcatcggcggccgcgatcgccgccatcggtgttccgctcgggatcgcccgggcctcgatcgacgcgttcatcgacctcgcgcagacgaagacgccgcatggcggcaaggtgcccctgagacttcgcgaggatgtccaggtcgcgatcgcgcgtgccgagacgagcctcggtgccgcgtgcgccttcgcccgggacacggtctccgaattctggtgggaagccgagaacggccgtccgataacgctcgcgtggcaggccaagcttcggcgggcctgctggtacgcgggccatgtcgggaagcaggtggtcacgagcatgtacgaggcggccggcagttccgccgtcctcgaagacctgccgttcgcgcgccagctccgcgatgtctacgcggcctgccagcacatgcattatcaggaccggctgctcgtgccgaccggccgcatccttctgggcctcgaatccgacgcaccgttaatctag

SEQ ID NO: 6969 - DNA, 165 bp, Methylobacterium sp.
atgccaggcgggatcgggatcggacgcggggatcccctgcgtcccgcggtgacgcggaccgcgcgcttctcggggcccgagggcttccatccgggcgccctctggctcgccgcggcggcgccgctcctggcgaccctcctcctcctcgtccggctcgcggcctga

SEQ ID NO: 6970 - DNA, 99 bp, Methylobacterium sp.
atgatgctgaaggccttctcctacgcgatgatcggcgccttcctgggcggcctcatgatgaccgtcgtcggctcggccggcgtgctgatgggcctgtga

SEQ ID NO: 6971 - DNA, 219 bp, Methylobacterium sp.
atgcgcctgctctgggacagggttctcgaccgggcgtggctcggcctggcggccgccgcggcggtgacggtcgccgtccacgagggtgcggcggtcggccggcttgcctggacgctggggtccggcggcgccgcgctggccgcgccggcggggggcggccgggccgtcccgccggcccgcgccgcggcctgcggtcccgccccggcgccgtcaccgtga

SEQ ID NO: 6972 - DNA, 2331 bp, Methylobacterium sp.
ttgggactgtattccaagctgcgggccgcactcgctgaagatgccctcctcgcgcgcggcgtgaagcgctcgctcgtcgacggcctgtatcagcccttcgcgtcgctcgcggtcggcgccgcgtccgggacgatcgtcgccacggccgcggcgttctggtccgacgatcgcgcgatcacggtgaccgcgttcgcggtcggcctgatcggcctcacccgcatcgtactggctcggatctacctgacgaaggggccgcagaagcacgatcgttacgagctctgggagacgtacttctccctcggcgcgttcgcctacgccgcgtcgctcggcatcctgtcgttcctcatcacgacgcggtcgtccaacctcgcgctccaggtcatcacccccaccttcacgatcggttacgccgcgggcatctcgggccgcaatgcgggccgccccctgctggccatcgcgcaggtgctcctgtcggcgatgccgctgtcggcgggtctgctcgtgtcgggcgacggcgagcgggcctcgctcggcatcctctcgctcctgttcgcctacggcatgatcgatatcacgctcagcacgcgcgagatcatcgtgtcggccctggtgacgacgcgcgagaaggaggcgctcgccgagaaattccaggcccaggccaatctcttcgacatcgcgttgcgcaacatgtcgcacgggctgtgcatgttcgacgcgcgcggccgactccaggtctggaacgaccagttcctctcgatatcgggcattccctcgaaccgcatccacaccaattcgacggccaagtcgctgtacgcatcgagccgcgccatcatcgacgagcgagccgcggggcgcggcgcgacactctcgacattctctgcggcgtcgaacgcgctgaggtcgggaaacctggtcctgatcctccccgacgatcgcgtggtctccctgatgcagcggcggaccgccgagaagggctacgtgatcatcttcgaggacatcaccgagcggcgtcggagcgaagcccgcatccagcagatggcgcgttacgacgatctgaccggcctgctcaatcgcagcagcttcaaggccaaggtctcccaggcgctgaaagccagcgccagcagcaagggcgctttcgcggtccacctgctcgatctcgaccacttcaaggtcatcaacgacacgctggggcatccggccggagacagattgttgcagatggtggcggaccggctgcgcgggatcggggcgctgtccggatcggtcgcccgcctcggcggcgacgagttcgtcatcgtccagcaatccgtcacgtcgccggccgtcgcggaggatctcgcgcagcgcgtcctgcaagagctggagcgacctttcgatatcgacggcactcacgtcacggtcggcgcctcgatcggcatcgcgatcgccccgttccatgccaacgacgaggacaggctgctgaaatgcgccgatatcgccctctacgccatcaagggggccggcaggagcgggttcaagatcttccagcacgagatggaagcggccacgcgcgcgcggcacgccctcgagtcggatctccgggccgccctgaccaacggcgaactggagctgcactatcagccggtcgtcgacgcgagcaccggggcggtcgtgagctgcgaggccctgcttcggtggcagcaccccgtctcgggctacatcccgccgtcggacttcatcccggtggccgaggacacggggctcatcgtccagctgggcgactgggttctgaacgaagcgtgccgcgaggcccggaactggccgtcgaccgtgagcgtcgcggtcaacatgtcgccgcgtcagttcggtgatccgcagctggccttccacgtcatcggcgcgctgaaccgctccggcctcccggcgcatcgcctggagctcgagatcacggagagcgtgacgctgggcgcgacgcacaagatcgtcgacaccatccacacgctccgtcagctcgggatccgcctgtcgatcgacgatttcggaaccggttactcgtccctgagctccctgagaaacttcgccttcgacaagctgaagatcgaccggtcgttcgtgtgggacctggacaggaaggccgagtcgaccgcgatcatccgggcgatcgtcgggatgggcaggagcatcgggatggccatcgtcgtcgagggcgtcgagacggagacccagctctccatcctccgggcggagggctgcgatctgatccagggctacgtgttcagtcgtccggtcgccgcaccccagatccgggccatgctcgcgaccgcgcagcccgtgacgaagctagcgagttga

SEQ ID NO: 6973 - DNA, 261 bp, Methylobacterium sp.
atggagcagaccatgaccccgcgaaccgcacaccccgtcgccccctacctgctactcgccgagctcggggccgccctgttcggcggtaccgccgcctccgccgaggagcgcatcaccctggagatcatcggtgccgtccgcatgaccggcccggggatgatccgccccgcggacgcgacgcccgtcagggccgaggacacccaggcgcgcgaagcgggcgtcgagcgtccctccgagaggatcgcggctcggcacaactga

SEQ ID NO: 6974 - DNA, 642 bp, Methylobacterium sp.
atggtgaagtcggcaaaggcggaccgtgcccgcgaggacgctgccgcttcaggtgagatcctcgcggcgatccccgcgcatctcgatttcctgtttgacgagcgcccacttctccctgacgagaatgcggagcaatacgacgcgctcctgcgcagcttcattcagcaggtcagacccactgatgtgatcgaggcgatctgggtcaaggacgtcgttgatctcatctgggaagccagaaggttgcgccgctggcgcaggcaaatactggtgcaagctcgactgaaggctgttgaggacttcattgttccggcactcaagaatgaatcagcttttggtacgctagaatttggaaagccttcccccgatgcgcttgcggcaggttggctgacaggcggggagatcaagaaagagcgcgtcgatgaattgcttctccgtcgcggagttaccacagtcgatatcaccgcgcacggttttttactgagtttgcccagcatcgagagaatcgaccggctcgcatcattggcagatcaccgtcgagacacattactccgtgagatcgagcgcaagcgggcgagctttgcccagaaggtgcgatccgccgccatggaggttctcgacgtcgagcatactgagagccggtga

SEQ ID NO: 6975 - DNA, 90 bp, Methylobacterium sp.
ttgcgcggcatcgcccgccggcggccggacggagcggaagaggagagctggccgttcgtcgacaacgcggacccctacagcgtggtttaa

SEQ ID NO: 6976 - DNA, 132 bp, Methylobacterium sp.
atgatcgggatcttccagccgttcggcgtactccatgtgtggacgtcgatcggccgcccggacaccgctgccatgctctgcctgctcctggacccgatcgtcggcggcgcggtggtcctccgccgtttctga

SEQ ID NO: 6977 - DNA, 816 bp, Methylobacterium sp.
atgggtgtcgcgcgcacacgcgtcgaccgacggacttggtccgttcacggagcggccaaacgcaacacggccatcatccaggccggcctcgcccggatcgtcgaggacgagatcctgccgcgtctggcgctcgcgcatcaggcggatccgccgtcgcccgcgtcgaccacgcgatcaccgacacctgagcgcgtcgcctctctcgctcaagcgctgatggagggcgagccgcacgccgagtgggtgcgcgcgctcttggaagagggcttgtcgctggatgccctgctgctcgacctgttcgcacccgcggcgcggtatctgggcgagctctgggaagacgatgccgccgatttcctcgacgtggcgctcgcgctcggtcgcctccagaacctgacccgcgccctgtgtgcggatctggagggcgtggacgtgacggcgaacggtcgccgcgtcctgctgatgccctgtcccggtgagacccatctcttcagcctcgcgctcgtggcgagcttcttccgcgaggcggggtgggatgtggtcctgaccaacggagcggacgaggaccccgccagcttggtccgcgccgagcagttcgacctggtcggcatctcgctgtcctgcgacatcctcctgccggtgatggcggtgtccgtggcgaagctgcgcgccgcgtcgtgcaacccggacctgcgcgtcatcgtcggcgggccgctcttcgtgcgggagcctgccagcgcccgtgtcgtcggcgcggacgccgtcgccgcggacgcgcaatcggccgtcaggatcgcggaggccaccctggcgcgatga

SEQ ID NO: 6978 - DNA, 690 bp, Methylobacterium sp.
atgcccgaccgatccctccgcgccgtctggtccgacagcctcatggccgaggtcggcgcccgccttcccctcttcgacgacctgtccccggacacgatccagcgcctgtcggccgagggattcgggcgcggcctgctgacggcgtccctgcgcgcccgcctgcggaaggccggattcccggatctcggtcatctggcccagtcttcaccggtcgcgatcgccacgatcaggaagttcggtcccatccgcgtcgagcgcgtccggcacttcatcctcgacgtgctggcgcgctggctcccgggcgcgcgggagatgcacacacccgaggccacgcgggtgcggaggctcgaccggctgcgcgggctgccggccggatgcctgcccctcgcggcgggtcagatcgcggcgctccgcttcgcggacgcatcctgtgcggacgtcgccgcgtgttcgcgtctcgggctcctccggacaggcgccgtgacatccggtgacgtggaccacgtcgtcgccgcactcacccgcctcgctcgcgcgtccgatccggttcctccgcgtcccctggaggaggccggggcggcaccgtcgtgcgacgccgcgaccggggcggcccgtcgcgccgctctgctggcggagcaggatcgcgaatgggacgaggccgcaccgaccgcgcgccggcctcggcgctga

SEQ ID NO: 6979 - DNA, 210 bp, Methylobacterium sp.
atgcggaagctgaccaggttggtcgtccgcatggcgcagcgacccggcctcctcgagagcgggcgactgatcgatcagctcacggatctggaagccgagggcctggcccggaatatctcgtggcggtccatcgagacgatcagggccgctcgattgaagctgcgcgtcgagggcctgatgccgacgtcgtccctgccgctcgctccctga

SEQ ID NO: 6980 - DNA, 306 bp, Methylobacterium sp.
atgtccgacatgcccgagcggatccccgcgatgatccgggtccgggacgcggcgcgctccgcgcgtttctaccgggccaccttccgcctcgacaccgccgaccggcccggcttcgaaaccttcaccccgatcgatctcgcgcatgccgcgtccggtctcgcgtcggagctgacggtcaacacgggccacgacggcgcctgcggcctgggcgtgggggccgcccggggcacggcgcgctcctgcttcatcgacgacccggacgagcacaagatcgaggtgctcgcccgcggttggcgcttcgcctga

SEQ ID NO: 6981 - DNA, 786 bp, Methylobacterium sp.
atggatcttcagctcacgggacgaagcgccctggtcaccggctcgaccgccgggatcggtctcgccgtggccaaacggctggccgcggagggcgcggaggtcatcatcgcggggcgccagcaggccaagctcgacgcggccgcggccgcggtcgccgcggcgggccgcgcgcgcgcgatcctggccgatcccgccacggccgagggcgctgccgcgctcgtgcgcgcggcccccgcggtcgacatcctcgtcaacaatctcgggatctacgaggccaaggccttcccggacatcgccgacgacgactggcaccgcctgttcgcggtcaacgtcgtgtcgggggcccggctcgcgcaggcctatctcccggggatgcaggcgcgcggctgggggcgcgtcctgttcgtctcgagcgagtccgggatcgtgccgccgcccgacatgatccactacgccgtgaccaaatcggcccagctgacgatcgcccgcggactcgcccagctcaccaagggcagcggcgtcaccgtgaacacggtgctgcccgggcccacgcgctccgacgggatcggcgatttcctgaagagtgtcgcctccgatcccgacctgtcgcccgaggcgatggaggcggagttcttccggctccatcggccgctgtcgctgatccagcgcctgatcgagccggacgaggtcgccgccatgatcgcctacctggcgagtcccctcgccgccgcgaccaacggcgctgcgctccgggtcgagggcgggatcgtgccgaccgtcgcctga

SEQ ID NO: 6982 - DNA, 222 bp, Methylobacterium sp.
atgccccgctggcttcaattcgccctcggtctcgtcacgctgatcgcgctcgccgcgggcatcgtgcgtacgctcgtgcgtcacatgccagacgcggccgcatcgtggctcgggccgtgggcctacgaggcgttgatcctgctgctggccgtcagcttcgtggcgatcatcgtgcgggccgcccagggctatcgctctcctcgatccgataaggtgcggtaa

SEQ ID NO: 6983 - DNA, 387 bp, Methylobacterium sp.
atgctccgccggctcacgatcctcctccctttgctcgtctccacggtcgcgcacgctgcgggccccggagccagggcggtgggcaccttcgagcaccaggaggacggctacgagcagggcgtcgaggtgaaggcggcgggcgcagccggcttcacggcccagttctcaacggggaccaagggctgcggcggtgaggtgacgatgaaagggcggccgaccggacccgatacggtcgtcttcagcaaaaccgaaggtgggcaaacatgccggatcaccgcccgctacgcttcggatttccggtccgtcgtcctggaggagcagggctgcacgatgtggcacggcgcctcgtgtgagttccaagggacgttgaagcgaaagggacgctag

SEQ ID NO: 6984 - DNA, 231 bp, Methylobacterium sp.
gtgccctatagcgagcccatgtcggccagtaccggacacggtctccacgacgtcgcgcaaatgctccggcaggtggtggccatagacctgctccacgacctgctcgttggtgccgagcgctcgagcgaccttgccggacggcacgcccgccctcacgacccacgtcgcgaaggcgtgggtcagtgcgcgtggcagctcagcaagagcgcgttaacactcgacgatgactga

SEQ ID NO: 6985 - DNA, 963 bp, Methylobacterium sp.
atgccagtcacgattccggatcgcctggggctcggcgtcgccgatgccgggaacggcctctccgcccgcgcggccgaggcacggtcgcggctcgtccgctggatcgtgggtaaacgcgcggcggcgcgcgtcccgacgcggatcctgaccgacgacgagatcgccgccttccggcgcgacgggttcgtcaccgtcccggcgatcaccaccgccgaggagctcgacaccctgcgcggcgcctatgaccgcctgttcgaggaggcgcggggctggaaggacgggagcctgttcgacctcgtcgatgtcgaccgcggcgccagcgaggcgcgctcgccccagctcctcaacccgtcccgcttcgagccgctcctccgggacatcctgttccgggccaacgccctggccatgtcgcgccagctcctgggaaaccgcgcggccctcgtcttcgagcacgcgatccgcaagccgccgaagatcggcgccgccaccgcgtggcaccaggacgaggcgttctacgccgcctacacgaattaccgggcgatcacggtctggatgcccctgcaggacgtctcgcctgagaacggctgcatgctctacgtcccgggcagccaccgggagccgctccttacccatcgcagcatcggcggcgacccgcggatccacgggctcgaggccctcggggttccggtggagcgcgcggtcccgtgtccgctcccggcgggcggcgccacctttcacgactgccggaccctgcactgcgccgggccgaatctcagcgccggaccgcggcgcgcctacgccctcggcttcggggtccgcgcgccggagcacacgctccgccacgagcatccctggaacgccgagaagcgcacgctgcggcaggagcgcgagcggcaggcccgcggcgggctggcccggttgaaggcgggcgccaagcagcagatcaaggcgctcatccgctga

SEQ ID NO: 6986 - DNA, 267 bp, Methylobacterium sp.
gtgcacatgcagcacgtgtccgcagacaacgaccgggtcgcgcagtggtgcgcggcgcatcccgtccttctcgccttcggcctgtgcgcgttcggcctcgccgtcgtcgccgcggtctggggactcgggatcctcacgccggccacggccacggtcatcgccttcatctatgtggcctgcctcggcggcttcctcatggagtacttcgggatcaatgaactcatcagaggcgtgagatgcatctggtttgttctgacgagcgtctga

SEQ ID NO: 6987 - DNA, 231 bp, Methylobacterium sp.
gagtacgccctgcccaccgactcgttcctgaacttcttccgctcctcggccgtcaccctcaaggtcgaaggcctctacgtcagcctcgaccgccagaagaactccgccggcggcgtgttctacggcaacctcctgcccccgaacggcaccgcctacctcaacggcgccgccgccaagaccgagttcgccgtcgtccgcgccggcctcaactacaagttcggctcgtactga

SEQ ID NO: 6988 - DNA, 264 bp, Methylobacterium sp.
ttgatcgtgcggtggatcggtgccgcggcccgcaagcgcggccgggcggccaaccgggaagctccgcccgctccggcctcggacaacgtgacgaggctgtcctgggccgacaccttcggacgggcgatcagcgccgatcctcagcggtcgaagggacccgcgaccgtcctcgcgatgcgtccccgcgcgagcaggcgcgcgtgcggcccgatcgtccgcgcgagacaggcggtgagcgccgcgatcccgacctcgctgccgtag

SEQ ID NO: 6989 - DNA, 120 bp, Methylobacterium sp.
atgcggtatcggcacagcggcatcaacgagttgccgatcgcggagtcggaccgcaagtttcacgggcccctcgggcgccggccggacaaccagccgggcctgagccatttcggcttctga

SEQ ID NO: 6990 - DNA, 549 bp, Methylobacterium sp.
atgtcgcccgagtatgtccggccttacgtcaaggcacagaagaacgatgaccgggatgccgaggccatcgccgaggcggcgacccggccgaccatgcgattcgtcaccctcaagtcgcaggcccagctcgacatgcagaccttgcaccgggtgcgcgaccaactcgtcggcgagcgaacggcgctgatgaaccagatccgtgctgttctcctggagcgtggctacatcgtgccgcaaggtcgtgcgaagctcgcagcttgtcttgcctctctgatggatgaggccgccgtgcctgcgctttcagcacgcatgcgcgttctcgtcgccgaagtacgggagcgctggcaggatctcgacaagcgcatcgccgcgctggatgccgagtttgccgaaacggttcgatcggacgaacacgcgcgtcggctgactacgatcccgggatcggcgcgctcaacgccacggctctcgtggcggccatcggcgatgtcgctacctttgcacgggggcgtgaccttgcagcttggctcggcctcgtgccccggcagttga

SEQ ID NO: 6991 - DNA, 804 bp, Methylobacterium sp.
atgtaccttctaggcaccgccctcgggttcttagtgttcctcggcggagacggagttaagcttatccgcagttctgccgatctgctcgggttggctattttggtgatttcagccggcctgatgatgccgttcccgtttggcgactcagatcgcccggcttggccactgaataatccgtcttggtctttatcattcgagttgatagccaatgttgcctacggatactggctttggcgattaggcaagaccttcctttccgccttggcgattgtgggtttggcctgcttgggctggaccatattcactttcggcagcattgagacgggctacaccctcgcgaccttgcccggcggtcttgctcgcatcgcgttttcctttccgcttggcctcctgatcgctcgccttcacgacgagggactattagcggcgatcccaacggtccacccgttcatacctgtggcagctctcattggcatgttggcttgcccacttttcttggaccgatggatcatcgagatcttggccctgtcgatcatgttaccgctggttctaatcttggggatccggtcgcgagaccttctgtcgtggagagacgccagcagtgccttgggcggcatttcctatccgctctacatcttacacgcgccgatattcgtggcgttcaagacattcggccccacactgccggcccatggcgtcgaagctttcgcgacggcgggtgcagcatcgctattagcggtcgcggtagccgctctagccacgcgggtgaactcgcgcttccttcttctgaggagccgcacgtag

SEQ ID NO: 6992 - DNA, 318 bp, Methylobacterium sp.
atgttcaccaagaccgcacggacccgcttggccgccgccctggccttcggcggcctcgccttcgcggcgccggccatggccgcacccctcggccgcgacgccggcctgcaggcggaagccggcgacgtccagaccgtccagtacggctacggctacgggcaccgccacggcggctggggtcaccgcggctacggcccgcgccatcaccaccacggttggggccggggccaccatcacggctggggacaccgcggcttcggcccgcgtcaccatcaccacggcggctggggccatcgccacggctacggccgctggtaa

SEQ ID NO: 6993 - DNA, 207 bp, Methylobacterium sp.
atgtcgacctccgccaacccgcccgacccgtgcgccgagacggccgcgctccgcaaggacaagctgcgcgcgcacatcaggagcgtgctgtcgacgatccggtcccatcatacgggccgcggggcgccgtcgatccgggccacgggctacgtccttggagggtggttctgcggctcggccgcggcaacgatcccgctttttacgtag

SEQ ID NO: 6994 - DNA, 213 bp, Methylobacterium sp.
atgaaacacggcgcgcgcaacgacatccccgccacggtgacggcgatcaagcgcggggacgtgatggcccaggtcgaggtggaactggtcggtaccgcctaccgcatggcctcggtcatgacggtcgactcgctggaggagctgggcctcaaggaaggcgacaccgtccacgtgctcgctaaggcggtgaacgtgctgctggtgaagccgtag

SEQ ID NO: 6995 - DNA, 177 bp, Methylobacterium sp.
gtgaaggtgttccggatcatgcaggcggcgacgggcgcgattctctggagcggcgcggcgctcgatccgatggccgccctcgacgcgatggcgcgcgccgccggcttccgcgaccgcacgcggatcccgaaccacctgcgggccggcggcctccacgtcgaggagctgcaggcctga

SEQ ID NO: 6996 - DNA, 357 bp, Methylobacterium sp.
ttgcgctatcaagccctcgtagctctcgccctcgccgtcagtgcgcatgccacgcatgctcgcgcacagactcaggaggagcaggccctcgcattgctccgggcatccagcgctcagtcggccatcattacgttctgcggcaagcactacgcgatcgacggaacgaccgcgctgcggatctcccagaccgccagagatgtggctaccaaggtgcttggccaggagcgggcgaacgccgctttcaaggacgagctggcgcggcgctacgccgaggtgaaagaggtcggtgaacagcagtggtgcaccgaccagcgcgacgagctgtcggagggcgatgtgcgaatcttcaagaactga

SEQ ID NO: 6997 - DNA, 324 bp, Methylobacterium sp.
atggatgagaacggactcgaattcctgcggacgattgctgagcggaaggtggaatcctccgcggcgcgcgcgctgaacaggattgcgcagtccctcgatttgccgatcgaggcgttctacgggtccgatcactgcggatctgtggaccggctgaccctcgagggcgagacggagcgagtgctgatgctcgtcggggtccacctgcgccgactggatccggcggcgcggaggcgattcggtgaggcggtcctcgctctggtcggccccgtatcggccgaggcctgcgcgcgcatcgcggagaacgcggagcgcggcgacccgtga

SEQ ID NO: 6998 - DNA, 318 bp, Methylobacterium sp.
atgctttggtcctgcctgatcctcatcaccgaacaggcgttcgtccccgtgcagtgggagcgcgcctccgtgcgaagggaggcggttctcgaagggctcgtgctcggtgtcgtgggtgccgtcgttggcaccggagcgctcgtgttctcgatgggagcgatcgagatcagcggcataacccactgcatggactggcagcgaaggcacgacctggtgcggccggacgatggaccgctaccgccgcttgcctctgagcgcctcggctctcagatgctcaagcaccatgctgccgctcctggtcgaaccgacaggatgtag

SEQ ID NO: 6999 - DNA, 87 bp, Methylobacterium sp.
atgacggccaagcgagcgctgatcacgggtgtgacgggccaggacggcgcgtatctggcgcagctgctcctgcagaagggctacgcc

SEQ ID NO: 7000 - DNA, 342 bp, Methylobacterium sp.
atggcaccggacatgtcccgatatcgccggctgccgggcgaggagccgcgctacgccctggcggaggcgcggacgctgatcgcggagcgcgcctacctgttcagcctctacgcggtcgacgtggtcgcctccgacgggctgaccggccgacacgttctcgccgtgccggtcgcgatcagcgcggtctcgatcacggtgggcctcgtcctgaccgaggcggattcccgcagggccgaggcgggcgatctcgctggcgtcgtgtccctcgcccaggccgtgcagggcggataccggcgcttccgcaccttcccggcgaacgggctcgggcgtttcgtgctctga

SEQ ID NO: 7001 - DNA, 270 bp, Methylobacterium sp.
gtgctgaggaaattcctgctcgcggccctgctggcgctgggcttcgcggccgcggcgccggagggcgcgtccgccgcgcccatcggcccggggctggctctgcccgccgaagccgcgccggcggtggccgagaaggcccagtactactaccgccgccgtttctacggcccgcggccctactggcgccgcccgtactacggccgccggttctactacggcccgcggccgtactaccgtcgtccttactggcgccgtcggttctattactga

SEQ ID NO: 7002 - DNA, 153 bp, Methylobacterium sp.
ttgctcggattcggacagcgcctcgaagacggcgcgggcatcccgggcccggctcccgacgaggccatccggccagaccgtgacgagatgctcgaatcgtacggcgaccggatcgagctggccgccggcggctggtcttccgccggtccgtga

SEQ ID NO: 7003 - DNA, 1005 bp, Methylobacterium sp.
atgacgggccccgaccgtcccggcgggcgggctccgccccgacgcgatcaggcctccggtcgggtcacgccgccggggcacggggacgggacggccgccttcgaggcccaccgtccccagctcctgcgcatcgcctaccgcatgctcggctcgcgcagcgaggccgaggacgtcgtgcaggacgcgtggctgcgctgggtcgcggccgaccggagcggggtcgcggcgcccgaccgcttcctcgcgcaagtcgtgacgcggctctgcctcgaccagatcaagtcggcgcgcgcgcgccgggagagctatgtcggcccctggctgccggagccgctggtcgagccgctggtcgagccgggagcggacggcgtggacgaggacgacctcaccctgacgctgatgctcgcgctcgagcggctgtccccgctggaacgcgcggccttcctgctccacgacgtgttcggccttccgctcggcgacgtcgcggagaccctcgggcgggcggcgccggccgtgcgccagctcgcggcgcgcgcgcgccggaacgtccgggccgcgcgcccgcgctttcccgtgacccgcgacgagggcgagcgcgtcgcccgggcgttcttcgaggcctccgcgagcggcgatgtcgcggggctgcggacgctgctcgccgaccgcgtcacgctctcctcggacgggggcggcaaggtgctcgccttcgtaaacccgatccgggggctcgagcgcctgctccggctctacgcgggcgcgcggcgcaagtggggcgacggccgggcggcgctggtcgggttcgtgtggatcgacgggcttccgggctatgtcacccgcgagcgcggcggcctcctgcagacgacggccctcgcgatcgagaacggccggatcgacgccatctacatcacgcgcaatcccgacaagctccgccacgtcgcgcgcgccgtcgcggccggcccgggacccggcgacgcgggcgggcctgtggcgcgccggtcttga

SEQ ID NO: 7004 - DNA, 768 bp, Methylobacterium sp.
atgcatcctgccgtggccgccgccaacgccttcaaggcggttcatgacgccggtcaggtcccggactacgagcgcatcctgcgacagggctacagccgcttcctcgctccgggggatgtcgtcgtcgacgtcggcgcccataccgggctccatctcgtcgcgttcgtcgacatcgtcggcccgaccggcaaggtccacgccttcgagccgatcccgttcctgatgaaggatctggcggggcgtttcggccgacgacccgaggtcgagctgcacgacgtcgccctctccgacacggcggggcgcaccgatttcacggtcgcgagcgtgcccggcgagagcgggctcctcgcccgctacttcagcagtcccgccatcacgtccaagaccatcaaggtcaggacggagaggctcgataccgtcctcggtcacgtccccgcggtggcctacatcaagatggacatcgagggcggggagttgaacgccctgagcggcgcggctcagctcctccggcgatgccgcccgatcgtcagcgtggagtacggctgggccggctactccgcctacgggcacgcgcaagactccctctaccggttcgccgagagccacggctacatctgcgcggacatcaccgggaacctgatcgacgatgcgagcacgtggctcgcggtcagcgactacgtgacgtgggatttcttcctcgtcccgcaggagcgtcgagccgactgggccgccctgttcgcgcgccgcccggagcccggacccgcgtga

SEQ ID NO: 7005 - DNA, 105 bp, Methylobacterium sp.
gtggcgctcctcgccctctacgccctggcgctgcagggcgtcctcggcggcttggcctccgccgccgcggggccggaccatgtcctctgcctcgccgacggcggc

SEQ ID NO: 7006 - DNA, 255 bp, Methylobacterium sp.
atggaggttccgatggacaggaagcaggccctcgaactcgcgatcttcgtcatcgcgctcgtccccttcctccgctgcctcatgccctccgcgacacgctcccgggggccacgccgctccggctccctcagctacgattcgggctccggcggcgacggcggcgcgatcttcggcgatggcggctgccacggcagcgacggcggcagctgcggcgacggcggcggcggcggtgatggcggtggcggcggcgattga

SEQ ID NO: 7007 - DNA, 1338 bp, Methylobacterium sp.
gtggagttccgcttcgaccgcaaggaaccgggtgtctggatctccgccggcacccacgtcgcgctcctcgcgctggcgctggtcagcgtcgcggccccggccctcccggaggctcaggagggcgtgcccgtcgaggtgatcaccgagaaccagttctccgagatcaccaagggcgagcgtcaggccgacaagccgatgccgaacgccacctcgcgggccgaccgcaaggccgagaagttcgaggaccgcgagcctgagaattccaagcaggacgcgccgaccgcgccgacccgcacggccgagatgaagctcgccaacgcggacgagatgccgctgcgcgccgagcccgacccgcaggaggcggcccaggccgccaaggcggcggagaaggccgcgcaggagaagcgcgacgccgagaaggccgccgccaaggcggccgagaaagcggccgagaaggccgccgcggagaaggctgccgccgccaaggccgaggcgaaggccaaggccgaggcggtcgcgaaggccgaggccgagaagcgcgagcagctcgagaagctgatcgagaagcaggaagccgaggccgctgcggccgcccagaaggccgccgcgaagaaggccgaagccgccaaggaggcggccaaggaagcggccaagaaggccgccgacgcgaaggccaaggccgaggccgaagccgagcgtcagaaggagatcgcggaggccaaggccgaagccgagcgcgagaaggcggaggccgccgccaaggcgaaagccgaggccgcgaaggccgaggcggccgccaaagccgaggccgccgccaaggcgaaggccaaggccatggcggacgcgaaggccaaggccgatgccgaggccaaggcgcgcaaacaggccgaactcgccgacaagttcaacgccggcgacatccgctcggtgctcgcctcgaaggcgccgtcgcagtcgaccggcgccaccggccacgcggtgcagaaggtggcggcgctcggcgcggcgaccggcaacgcgcagcgcctgtcgccgtcgctgcgcgacgccctggtcggcctgctccagcagcagatcgagcggtgctactcggcgccccccggcgcggcccagggcgtggtcctgccggtgctcgacatccgcctgaacccgaacggctcgctcagcaccgagccgcggatcatgcgcggtggggcgagcgcggtcgaccagtcgatcgcgcaggccgcgctccgggcggtccgccgttgcgcgccgtacaacattccggccacctacgcgccgtactacaacgactggaaggccatcaacgcggagttcgagttcacggcgacctga

SEQ ID NO: 7008 - DNA, 183 bp, Methylobacterium sp.
atgacaattctgatggccgtcgctctggcgattgcgttgctcggcatcgcgctgacgtctgcagcctaccggtttgcaccggtgtcgaagcacatagcgagtggggatatcgtcctcgtctgtgggatcagcactgcggccttggggagcctcggagccctcctgcagatcttcaccgcctga

SEQ ID NO: 7009 - DNA, 87 bp, Methylobacterium sp.
atggtcggtgccgaccacaacggcacccgtatccttggccacacggtcggggagcctgcggcgtatgtccaggcgttccggcgctaa

SEQ ID NO: 7010 - DNA, 300 bp, Methylobacterium sp.
atgaggacagggatgcgcgtgcgcggcgtcgataaccgggagcgtaggcactggttctacgacagccgactgttggtcttcggcttctgcttgacggcgttcgtcgcgatcttctggcaggtcagccggttcgagggctttcagccgatcttctcctgcgcccgcacgacagacgtggaccgtcaattgctgcgcctgggaatggatgcctgcatgggcaacgcgcgcacccagtcagatcgcgagggctgcatgcggaccgtccatctgctcgcttgcatgaaggagcgctggcgctga

SEQ ID NO: 7011 - DNA, 153 bp, Methylobacterium sp.
gtgctgctcgacgagaccgagatgacggtggccgaatccgaccggtcgtttccatcccggacgcaggcctcggcggcggctctggccttcgcgaagctggtcgcgcgcgccagccgctcgctgaacgggggcgcgtcgagcggcctcctgtag

SEQ ID NO: 7012 - DNA, 225 bp, Methylobacterium sp.
atgttggacgtcgtcgcgagacatcagttctcaatcaaaagatttcccattccaacgaacgtagcctccacctccgccatgggcatccatatggaccttcgggatgcgctcgcggcctaccttgacgttggcacccagcatatcgtgggccttctggagcaacgatccgcgacgcagatagaacagtacggagcaaacctgcatgccgcaatgactgctccgtga

SEQ ID NO: 7013 - DNA, 303 bp, Methylobacterium sp.
atgggatcgaaatcacctgtccggagcagatcctccagggctgcggcgcccgaggacgacctgttcgagcgctccgcgccgccgcacgggccgggtgccgggcggcggctgcagcggatcgccgacgcgctgcaggttccggccacctccctgtacggcccgccgggtgcggagcggggcgccggcgtcgcgggcgggcgtgccgacgaggccgacgccctgctgcacgcctaccgtcgcatcgacgatcccgagatccgccgccgcgtcctgaccctcgtgcaggatctggcggcacgctga

SEQ ID NO: 7014 - DNA, 609 bp, Methylobacterium sp.
atgcccaagaccaacgcgtccgtcggtcagacctgtctcgaagccttccagatcgcgctcgattccgccgacatgatcgggcactgggcgtgggatcccgcgacggaccgcgtgcgcgtcgacgccctggtggccctcctgttcaaggtcgatccgaccgcggcggaatccggcatcccgctggccgtctacgagaaggccatccacgtcgacgaccgcggccgggtcgacgccctgatccgccgcagcgtcgcggcggggagttcctacgtcgccgagtaccgggtgatctccgtcgacggtcggatgcgctgggtcctggcgcgcggccgcttcaccagcgaccgtggcggccggccgacgggcgggcgcgggatcctcgtggacatcacggcgctgcgcgcgcgcgaggcgatcggcggcgcgaccgcgcccgacctcggcgacacgcccctagaccgggcggtcgagcacgccctcgccgcgcaggacgccatcgcggcgctgggcgatgcggccctgaaggccgaggcggacgcgctgctgatggcgctgggtcgacggctggcccggcggcaggtcgcggagcggcggcggcggctgaactga

SEQ ID NO: 7015 - DNA, 240 bp, Methylobacterium sp.
gtgccggacctgcgccgccgcgcgctgacgctgacccgcgacgccatcgcgggcgatgtccagggggacgacctcgtccggctcaccctgctgaaggcctgggagcgccgggcggcgttccggcccggaaccgggatgcccgcatggctcgacacgttcctgcgcagccgccccgccggcggtcgcgccgggccgaccggcctgtcgcggaacggcgtgtctgccgagatggcccgctga

SEQ ID NO: 7016 - DNA, 168 bp, Methylobacterium sp.
atgctcatccccgccccgaccatccgccgcctcctcatgctggggctcgtgctcgtcgccctcgtcgcgctcgcggacggcgtggcccgacacgagttgcgcacggccgcgcgcgcgatgaccctcgccgacgcggccccgcagacggagcgcgcgtcggatgagtag

SEQ ID NO: 7017 - DNA, 84 bp, Methylobacterium sp.
atgctgcgcggtggattgctgtggctgctgggaatcccgctgccgatcatcctgttgctgtatttcctcggcgtgttccactag

SEQ ID NO: 7018 - DNA, 231 bp, Methylobacterium sp.
ttgcaaagcgataccggctgcccgcggccccatcacgccggcgacgcgacggccgacatgatggagcacgcggccgaggagcaggcgggtctgagggtcaggatcgtcgtccgcggcctcgtaggcctcgatgagagacgtcaccaaatgtttcgatggaccagggtcgtcgccggctgccgacggcccggtgacggcttgctcgcgggagcgccgcaccaaatcgcgtga

SEQ ID NO: 7019 - DNA, 81 bp, Methylobacterium sp.
atgacgatcctggatccgatcaccggcgagctggtcaccatcgccgttccacggccgcggccgcaggccggcccgcgctga

SEQ ID NO: 7020 - DNA, 114 bp, Methylobacterium sp.
atgacctcggggacgatgatgcggggcgaagccccggccaatgtgggcgtgatggtccaggggcacgacgccctggggcgcgaccggcccgacccgttccgccccctgccgtga

SEQ ID NO: 7021 - DNA, 300 bp, Methylobacterium sp.
gtgctggcgctgcgtcacgatcggcgccaccgcgggcagctcgatctgctcggcgacgctgatgacctctgccggacgagcggcgtgcaggctggcgccgcagcacgcacacgcctgggaacgacgcgggacgattgtatcgggatcatcgctcagcacccggctgtgaccctcgtgagggggcttgccccgctgggcttggagtgcgcgcgctgctccttgcgatccgtcacgggcggcttggatgaggtgcgcgaggtcttgtccggttgctgcagccacagcaccaccttatcctga

SEQ ID NO: 7022 - DNA, 975 bp, Methylobacterium sp.
atgcgccgggtcttctcgacggccgggacacatccccggacgcgcttcaagctctggcaggaggtcgtcgccgaacggatcgggccgatcgagcagcgccggcgcgccgacgggccgttcgcgggcgagatcgagatcggcgccgtcggcccgctgacattcagccggatcacccagagcgccctcacgaccacgatcaccgccgatacggtccggcgccggcctgacgggctgatccgcgtgaacttccgtctcgccggctcgtccaccttccagcagcacggccgcgaggcggtgcaggggacgggagacctcaccgtcatcgaccatcacccgggcgtgctggacgcgcgcacggatggccagaccctggtcatggccctgccgcgggagcgcctcgagggcatgctcggaccggcccggctgttcgcggccctgacgatgcccgccggatcggccacgacccgcctggtgacgaccttcttcggggatctgctccgggtgaaccggcagctctcccccgaggcggcggagcgcatggcgacgatcggcgtggatctgatcgcggccgcgctcgcggatcggatggcccgggaggtgccgcattccctgcacggcagcgtcgtggtccagcgcgccaaggcccatgtcgaggcgaatctcggcgaccagaccctcgatccgccccggctcgccgccgcgatgggcgtgtccctgcgccggctccaggagctgttccacgggcgcggccagcacatctccgactggatctgggagcgccgcctcgcggcggcggccaggcgcctctccgatccgatcagcctgcaccgttcgatcggcctcgtggcctacgagtgcggcttcgcgaaccaggcccatttcgcgcggcgcttcaaggaccgccacggcctgtcgccccgcgcctacagggaggcggccgccctgcggctgtccggcagccagccggatccgtga

SEQ ID NO: 7023 - DNA, 414 bp, Methylobacterium sp.
atggcgcaggagatgcgctggcagaagcgggaaggggacggtcgcgtccatcttgcctacgagattccggacagcggcgcgcagggcctcgcgctcacctgcgacacgcggggcggacagctgagtgtcgactactacgacgacagagaccgcgctcgggacggcacccgggccgaggtcgagttcgcctcagagggcggcacgctctcgctgccgatgcgggcgaaacagctggaactcgacgaccagatcgtgctccagaccacgacaacgttgacgcaagactgggtgcggatcctgtccggcaagacccttcgcgtgacgctctctggcgacacgcagcggatccctctggccggcgcccggagcggtctcgccgccctggtcgcgggctgcagccgtccttcgcgatga

SEQ ID NO: 7024 - DNA, 627 bp, Methylobacterium sp.
atggcacgacgcgttgcgacgacgggaggggccggcggcaccgggatcctcgtcggcctcctggggctctgcctcgcaggaccggcgctcgcgggatccacgagcgtgaccgcgcggcccggggagcgggtccgcctcgacggctacgccacccacgagacccggccgggttgcccgtccgttccggcggccgcgatcgagctggtcacgcccccgcgcggcggccgcatcgagcagcggcgcgagttcctggtcctcggccagaacatcgacggcaccccgtcgcgggacggctgccaggacgtcgagcgggacgcgcggacgctctactacacggcccggcccgacttcgccggccacgacacggtgtcggtgatcgtcaccttcgtcaccggcgaggaggccacctacacctacaggatcacggtgcccgagggcgagggccggcgggcgccggcggtgtcccaggcacccgcccccagcgacgcgggcctcgcgcggccggccccggcggcgcgcgccgctccggccgagcgggcgaccctggctgcgagtccggctgcgactccggctccggcgccccgggaggccagcaccggcgacttcctgcgcgacgcggcccggggc

SEQ ID NO: 7025 - DNA, 603 bp, Methylobacterium sp.
gtgtcggcggtgatccagctcggagaactcgtcatgatcctggacctgcaccgccagggcctgtccgtcacggccatcgctcgccagctcagcctcgaccgcaagacgatacgtcggtacatcgcccgcggcctcgaacccccggcctacacgccacgcccgccccgcgaacgtcgcctcgaccccttcaccgcctacctgcgcgagcgcgtcgccgcctatcccgcactgaccggctcgcgtctctggcgcgagctcaaggagcgcggctacgcgggctcaacccggacggccaatcatttgaaccccagcagcttgccacatcgaactatcaatgctctatacacgttggagttgcatatcgaagcgggggttgtaatgcaagcatcggaatgctgcatcatccgggtgtccatcgccgcgagcctcggttggctcattgcgctcaccctgatgtggaaacacagcgtgctggctgcgctgctcgtcagccctttgttcgggactgcggcggcgatcgcagccatgaccctgttctggttcgtgagcctgtttgtttcctgcgaacccatcgggcctcgagtgtctgacactaaccggtag

SEQ ID NO: 7026 - DNA, 120 bp, Methylobacterium sp.
atgaagcgacagcgggagaccggggccggcacggcgcgattcagggcggacgccgcgggggccgccccggcggagcgggtccccggtctcggtctcggcgtcgctgccgggcgggcctga

SEQ ID NO: 7027 - DNA, 549 bp, Methylobacterium sp.
atgacggcgatagcgatcatcaccgcccccgacaggatgtggatcgcctctgacggggcagcctacaccgaaccggacggcatccttcgccacatcgcgcccaaggtggtgctatgcccggactgggactgcgtgatcagcagccgtgggatgggtctcgctgccgaggccatgcggatgcgcgggttgcgccacaacgcccgggatttcgatgagctggtggagaacgcctcagagctcgcagaggtggctgaggcggatctgagcctgtcggcgcggggtgtaacgcatcatttcaccctgatcctcagtggctacagccggtcccgccggaccttcgagacccacaccgttcgtacccgtcccgggcccggctgggatgcggatgccggccgaatcgtggaactgccgcccttcggtgtctcccggcaaccggccctgctactcctgcccgagcctgcggaagagatcgccgcacacttcgggctggagctgccccgcggccaggcgaatttccaacttgatcctccctcggtgtcgcggacatag

SEQ ID NO: 7028 - DNA, 597 bp, Methylobacterium sp.
atggcccaggctgcgttgtccctcgccgcgttccagaccgcgtatccgagcgcggaaccccggcgaccggcgcccccgcgccccagctacgtcgagaccgcctacgatccggtcgtccgcacccgggcgccctacccgagcgccatgcggcgcgcccgtcgccgcgcccggctgacggcgctcatcgccctcaccggcgtcagcctcgccggctgggccgtgttcagccacccgcaggggccggtccgccccgaggcggagtccgtcgcggcggccggcccggtcccgcaggccgcggcggcgccgcggccgagcctcgcctggatgctcgaccggagcccggcgctgggcgccggcaccgccacggccttcgggggcgaggccccgccggtcgccggcttccaggtcgccgccgccgccccgtccccggcggtccgggagatcgcccggcaggtcgcgcaggcggagcgggcgcgggccgcccaggtccggatggcccaggccaaagctgcagagaaagtcgcggacaagatcggcgagaaggccggtgagaagggagcgggggcgccggtccggatggccgcggccgagcccacc

SEQ ID NO: 7029 - DNA, 135 bp, Methylobacterium sp.
atgaagaagcttctcctcgcatccaccgtcctcgccggcatgaccgccgcggcgtccgctgccgaccttccgcgccgcgctgcgccgccgccggtgttcacgccggtgccggtgttcacctggaccggcttctac

SEQ ID NO: 7030 - DNA, 2646 bp, Methylobacterium sp.
atgcagaccggcgctgtcgcctccgagaagatggctacggcggaagcgaaggttcaggaagccgtcgacaaggccgcgcgcaccttcactggcggcgtggtgctgatcgcggagcgaaacagggccttcgaccggctcagggccgccgcggatccggtcgtgaaggcgcaacaggcggtggaacgggcagcaacggctgcggatgccgccatccggcggggcaccaccaccaccgatgaggcggcccggatcgtcgggatctaccagcagcggctggcgagcgcgaaggtcgccgccgatcagcacgtgctggccaacgacaacatggccaaatcgaccggcatcgcctcgcaccagctccagaacctcggctaccagatcaatgacgttgtgacgtcgctggcgagcggcgcgccggccatgcaggttctggctcagcagggcgggcaggttgtccagatccttggcgagacgggcgtttcgggcgcggtgcgcggcgttgcgggtgcgatcgggcgcttcctgacgccggcgacggttggcgtgagcgccctctctggggctgtggtgctcggatacatggcctggagccggtacgacgacgacagccggaaggtcggggtcacgttgcaggggctcggccgagagaccggcctgacccgggacgccttcgagaagcttgccacctccgcggcagccgccggcaacatgaccgtgcgccaagcgaccgacatcggcaccgccctcgccgcgaccggccggatcgggccggataacatctcgaagctgatcggggtctcgaaggacctggcggcgacgttctcagtcagcctggacgacgtgaaggagaagctcgtcgccttcgggaccgccgagggcatcacgcggctgaacgatcagctccaattccttgacgcccgcacgctccgcgtcgtccagagcctgttccgcgccgggcaggagcaggacgccatccggatcgccgtcgagcgcctcccggtcgccttggcgaaatccgagaccgctcagggcgccgtcgcgaaggcgtgggacgccatcaaatcggcggccagcgacgccgacaacgcgatggggcggttcctcgaccggatcacgaagggcccgtcgccggcggaccggctgaaggagctccaggaccgcgtcgaggcgctgaaggcggccgaggctgagaacatcgtgcagccgggcggcacgcggcgcgcctacgtcccttcgacctcgcccacggtggccagcaccacgccgaccccgctcccgccctcgcggccctccgagcttgagtcggccaagtccgacctccagtcctacatggaaaagctggccgccacgaagcgcgcagagcttgaggtagccgagcgcaaggagctcgaggccagcctcaaccgcaagtccggggagctcaagaagctcaccgaggaagccggcctcgggtccgactcttggcggaaatacaaggacttacagatcgcggcggacgaagcgctgaagtcgggcaaccccgagctgatgaagcgcgtcgacaacgtgaaggacctgtccgaggcctcgtccatccttgagcacgtggtgacgaccaccaccaacgccgagggcgagaggatgacagccggcgagaaggccgcggaacagcgccggatcgatatcgcgagcactcgggccgtcaccgtcgaggaacgggcccgcgccgcgcagatgcagacagaggcccgccagcgcggccagctcatcaccgtggcacaggcccaggccgacgccgagcacgccgcgacgatggtgcgggagcaggctgcacagcagctccggatgatgctccgggatcaggacctcgaggcggacagcctcaagcttcgcatttcgctgatcggccagggcgccgaggcgcaggccgttgcgatggcgcgccagcggatggagcaggacctcacccgccagggcgtcgttgacctgaactccgaccttgcccggagcgtcatcgccggggccgaggcgaacgcccggcttggggtgtcctacgacaaggccgccgaggcgcagcagcggctgcgggacggtcagaaggagctggcctcggaattcgggtccttcgtcgagggcgtgacgatcggtgggcagcggatgtccgaggcgttcgcctcgctgtccaagagcctcggcagcaacgcgctgaaggcgatcatctccggcgacggtccgcttgctgggattctcggcacggccccgggggagaagggccagctcggcggcctgctcggtgggagcggcggcctgtccaagctcttcgacgtcgacaagatcaccgagtccctcggcattggggcggagagcggcatcgcgaaggcgctcggcgacgcgctgaggccgtccaagcccggcgggggcatcctatcgtctcccctcggtcggggccttgcagtcgccggcgctggcgcctcgatcggctacagcagccagagccccttgatgggcgcgctgggcggcgggctagccgggttggcgagcggaaacccctacctcgccgtcgcaggcggcatcgccggcatcgcgggcggcgtctgcggccataaaccctctcggaagaaggatcgcgaccatgagcgccgtcaacgtcatctgcggttcgcgtag

SEQ ID NO: 7031 - DNA, 2721 bp, Methylobacterium sp.
atgagcaccgtcgtcacacaactggtggtcgacgctcgtggcgccgaagacggcgtcaggcgttacacaaccgcgatgcaatctggagcctccgcttcggaggtgatggctgcggccgaggccaaagttcaggctgcgatcgagaagtcggagcgcgccttcacgggtggcgtggtgttgatcgcggagcgcagtagggccttcgacaggttcagggctgccgccgatccggtcgtgaaggcgcagcagacggtcgagagagccgccaacgccgcggatgccgcgatccggcggggtgctacgacaacagacgaggcggctcgcgttgttgggatctaccagcagcggctggagagcgcgaaggtcgccgcggagcggcacacggtggccaacgataacgtggccaagtcgaccggcatcgccagccaccagcttcagaacctcgggtatcagatcaacgatgtcgtgacctcgctcgcgagcggcgcgccggcgatgcaggttctggcgcagcaaggcggccaggtggtccagatccttggtgagaccggtgtcggggccgctgtccgtggcgtcggatcggtgatcgcccggttcatcaccccggcgacagtgacagtcggcgcgctcacgggcgcggccgtgctcggctacatggcttggtctcggtacgatgacgagtcacagcgcgtcagcaccaccctgcaagggctcggccgggagacgggtctcacccgggacgccttcgagaagctcgccaccgctgcggcggccgccggcaacatctccgtccggcaggcctccgacctcggcacggcgctggccgccacggggcaaatcggcccgcagaacatcggcaagctgatcgccgtttcgaaggatctggccgccacgttcggcacggacctggacgggatcaaggacaagctcgccagcttcggcacggtcgaaggcatcacgcggctgaacagccagcttcagttcctcgatcagcggacgctcagcctcgtccagagcctgttccggcagggcaaggaacaggaggccatcgcgcttgcggtcgaccgcctgccaccctccctggccaaggccgagaccgcacagggggccgtcgcgcgggcctgggaggcgatcaagaacgcggtgagcgatgcggacaccgctacgggccgtttccttgaccggctcacgaaggggccttctccgacgggccgcctgaaacagctccaggaccgcgttgaggcgctgaaggcgtcggccgccgagaaccttgtccagcccggcgggacgtcgcgcgcctacacggtgccgacctctccgaccgtgagcagcaccacggcagtaccggtcccaccctcgcgcccgaaggagcttgaggacgcgcaggccgagctgcggcggtacatggagtccctggccgaggcgaagcgtcaggaggaagccgttgcggcccagaaggagcttgaggcaagcctcaaccgcaaatcgcagcagcttcacaacatctctgaggaggtcgggctcggatccgacaactatcgcaagtacaaggatatggagattgccgtaaacgaggcgatcaattcgggcgatcccgcgctgatgaagcgcgtggatagcgtcaaagacctatcagagatgtcgtccatccttgagcacgtcgtgaagtccacggccaacgccgagggtgagcggatgacggccgcggaacgcgctgcccgccagaacgcggtggacctcgatggcgtgaaggcccggaccgtggcggagcgcgagagcgtcgcggcccgggcgcaggtggagcgagcccggggccagaccattactgcggcgcaggcagaggcgcaggcggagcacgccgccctcatggtgcgcgaggaagccaaccagcgcctgcgcgacatgctgcgggatcagtcccttgaggcggacgacatccgcgagcggatccgccttctaggccaggacaccgaggcgcgtgccgtgtccaccgcccggcgccgggccgaatacgatctgatccgcgacgggtacagcctgaacagcgacctcgctcagagcgtcattgcgggggcagaggccaacacccggctcggggtctcctacgatcgcgccgccgaggctcagcagcgcatgcgcgatggccagcgggagttggcgagcgagttcagcaccttcgtcacggacatcctggccggcgggcagaagatgtctcaggccttcgatacgctggccaagaccttcagcggcaacaccatcaaggcgctgatcagcggcgaagggcctctggcgggcatcttcgggacggccgcgggcgagaaggggcagctcggcggcctgctcggcggtcggctcaacctcggcggcttgttcgacgtcgacaagattaccgagtcccttggggtcggagcggagaccggcatcgggaaggcgatcagcgaggcgctgcggccgtccaagcccggcggaggcatcatgtcgtctccactcgcgggcgccgtggcgtcgatcggggccggggcggccatcggctacagcagccaatccccgctcatgggtgcgctcggcggcgggctggcaggcctcgccagcggcaacccttacctcgccgtcgcgggccctcgctgcggccgcggagccgttttcggcaagcccgccaagtccaaacctcagcaggagccatcgagcgatgaccgccatcaacgtgatcgtgcggcctga

SEQ ID NO: 7032 - DNA, 1425 bp, Methylobacterium sp.
atgccagaggcacaggccgccagctccatcacccgcatcggcatgtgtgacgaggccgacgcccgtctggacatcgcagccgtcgagcgcttcctgaaggaggggtacccggcggcgagcccggccagcgtgaccacgtcgcgatctgccgtgcgcatggcctcggaggcccgcggcatcgcgcggcagacgatggacaaccgcatcggctcgccgaaccgcgccggatcgcacaagcgccgcttcggcctggagccggactggagcctcgccgagacccacgccgcgcaggcggcccgggcccgccgcggcgaactcgggacggatcccgtgctgaccggcttcgagctgagccaggtcaagacgcgcttcgacagcgagggcgcattcgccggcgaaaccatcacccagatcccggcgagcggtccgaagttcgagctgccggccggacaggccatctccaaggtgacggccaccgtcaaggccaacggccagctcggaacgcagtggatccggtacaagcccgaagggacggacccggtcgccttcgccgagtcgctgcgcgaggcgatgcaggactgccgcgggctcgcgcgggtcccggtggcggtccccgcccaggacgacgagctgctgaccgtctacgtgatccccgacttgcatctcggcatgttggcgtgggcctgggagtcgggagagagctacgacctgaagatcgccgccgacatggcgcgcacccagctcgcgcgcctcctggcgatggcgccgccggcccggaacgccgtgctcctcttcctcggcgactacttccacatgaacgaccgccggaacgtcacgccgcggtccgggcacacgctcgacaccgacggccggtggcgcaaggtctacgacgtcggcgcccgcctggcggtcggcctcgccgaggcggtcgccgagcggcacgaccaggtcgagatcgccttcctgccgggcaaccacgacgaggacgccgcgcagacgctggcggtcgcgctggacctgttcttcgagcggcacgcgcggatcaaggtcgcaggctcgcccggcgatcactggttccggcgcttcggcaagtgcctgctgggggcgagtcatgggcacaccatgaaggcggaccgcatggcctggatgctcgcgaccgaccgggcccgggactggggcgagaccgagcaccggcacttcttcttcggccacatccaccacgagaccgccaaagagatcggccccgtgcgggtcgagtccttcacgtcgccggccgcgaaggactcgcacgcctcgcagggcggctaccgctccaaccgcgcgctcaacgcggtgacgttccacatcgaggacggcgagcactgccggcaccgggtgagcatccggacgccgcagcccgccgtcgagctgcaggtggcggcatga

SEQ ID NO: 7033 - DNA, 798 bp, Methylobacterium sp.
gtgagcgcgggcgccgtcgccgtcgtctgcggcagccgcggcaacccgcactggcactgggtggccgagcaactcgacgacctgcacgcccgccggccgatccggcgcctggtcgagggcgggcagcgcacgcgcgagcaacaggggagcgtctggcacgtcgtcggcggcgtcgactttcacgctctgtgctgggcccaggaccgccggatcgagcgccgcacggtcgaggccgactgggccggccaagggaagcgggccggcccgctgcgcaacggccggatgctcgaggaggagcgtcccgatttcgtggttggcttcccgggcggggccggcaccgccgactgcctcgcccaggcgcgcaccgccggcatcgaggtgatcgagatcgcgcgcgactgttgccggttcagctacgtgccgaccctgagcgtcgagctgtgccgggaatggccggacgcgctgttcgtcttcggggacaacctccagggctggggccggaagggacaggccgcgatccgcgacgagcccaacgccgtcggcatcccgaccaagcgcgcgccgagcgaggcgccgacggcctacctggtcgacgccgattatgcccgggttgccgagcgggtcgcgccgatcctggcgcacctgcgcgagcacatcgagcgcggcgggcgcgtgttctggccggagaacgggatcgggaccggcctcgccgagctgccgcaccgggcgccgcgcatccaccgcgccttcgagaacgcgcggatcaagctgcagcgcctcggccgcagcatgccctga

SEQ ID NO: 7034 - DNA, 726 bp, Methylobacterium sp.
atgccagtagccgccaccgagaccgccgaccccttcgacgtccccgcgctgatccgcgaggtggacgagctgtgggaccccgaaaccactctcatgacgcacaacgagcgggtcctgatcgaattctgccggcggctcgccgcgccgctgcgcgcgatcgtcgacacccgcgccggcatggcgctgtccaggaagctcctcgaacagtccggcggctccgggccggcttggaagcccttcatcaacgtggcgctgcaggggccggagtacctgatggtgttggccggtctgcgctcgctgtcggcgaccgcacgcggccctgcgccgttccaagaccgggtcctggagcagatgtgcgagatctgcgcggacgacccgaccgacctcgaggagcggcgcgatcggcacgccgaggaggatgccgagctgctccaatccctcgggctgtcgcgcgaggctcatcaccgcatcgtcgattacgtccacgaccggcccgtcggcgacccgggccaggagctgggcggcaccatgcacaccctggcgggcctcgccgctctcgcctgcctcgacatggtcgcgtgcggtgaggccgagttcgaccgcgtcggtcggccggagatcaccgccaagatccggcgcaagcgcgcgaaccgccacggtcgcggcccgctccccggcgacgacgcgggcctggtcacgtcgacggccagtcgccccggcgcgtaa

SEQ ID NO: 7035 - DNA, 285 bp, Methylobacterium sp.
atgccgaacaacaccaagcccaagcgggccgaccacgcccaggacctgcgccacttcgccgacctggtcgagcgccttcccttcgcctcgcgccgtgacccggagcagccgcacatcgagcgcaagctgctcgtcaacgagatgcgcaagcgcgcccggcagatcgtgcgcctggacgagccgacgccggagagcgtgttccgcgccaacgacatcgtccgcggcgagcgcgtggtgaaggtccagatccggcgcacgcccggcacgctgaagctggcggcctga

SEQ ID NO: 7036 - DNA, 156 bp, Methylobacterium sp.
atggtcgatggcccccgtcggccggcgcgcagcgacgcgatcccgcccggcgcgggatcgggggacgggccgcgcaggacgcgcttccgacgccgggcggactcggcccgcgccgcggcgaacatcgaggccgtgaccggcgttcccgacccgtga

SEQ ID NO: 7037 - DNA, 84 bp, Methylobacterium sp.
atgctcgacatcgtcttcctcgcagcggggctcgccttcttcgccgcggcggccggctacgcggccgcctgcgaccggctctga

SEQ ID NO: 7038 - DNA, 1038 bp, Methylobacterium sp.
atgccgaacgtcgtcgctaaccgccaagtcgctcacatctgggcccatcaggcacaggacagcgcccgctcgcacaacggcaatttctggttcgagggccgcaagctctacagctattccacgccgatcgcgaaccttgtcccgggtgttgacggcgaactgatcgcgctcgttactgcgcgaagctacagcatcaccacgaacggcaagcacatcggcccggctcactccgcgctcggctatggccgcgtgcgcaaaaccttcacggttcccttcatcggcgccttcggcggtcaaaaccgcggcgacctgaacctgtccgagaccaacgcggccgagatccacgcggcgaaccttgaagcctacctcgcggactacaccgcgaccgtcgagcggctcccccgcaagcgcgattacgaccgcgccgacgctctcgcctcgctgaaccgcatcgccaaccccgcgtgcgactacgccgaagcgttcggcctgtcgcgtccggcctatgacaccgacgcggacgaagcggccgcgttccgcctctggagcgcccgcaacacgcccgagcgcatcgccgcgcgcctcgctcgcgccgaagccgcggcggctgccaaggccgcacgcgacgctcgcgacgccgcggcccgcgtcgagcgggagcgcgccttgcgcgaggcctggctgtcgggtgagccgaccgcctactttcacggccgcgacgagcgtggcggcgcctacctgcgggtgcgcggcgacgtgctggagacctcgctaggtgccgaagtcccgctgtcccacgcgatcaaggctttccgcttcgtcaagctgtgccgcgagcgcggcgaggcttggcaccgcaacgggcgcaccgtccgcgtcggtcacttccaggtcgacagcatcgaggcatcgggcgacttcgtggccggctgccaccgcatcaactggagcgaggtggagcgcatcgccgcgagcctcgacctgctcgacgccgagccgtccgcggacgctgtcgagccgtcgcacgccgcggcgtag

SEQ ID NO: 7039 - DNA, 102 bp, Methylobacterium sp.
gtgaccgcccgcgccgtcctgctccccctcgccgaagcgtccgccgtgatgttcggcgccgtcgccttcctcgccgtcgctgtcgccttgggtgcgctctga

SEQ ID NO: 7040 - DNA, 114 bp, Methylobacterium sp.
atgttctacgtcctcgccctcgccgtcgtcggcgcgtcggtcgccctccccttcctcgggctcgccaagctcacggagtggacgcatcgccgctgtcacccatacgacctctag

SEQ ID NO: 7041 - DNA, 1155 bp, Methylobacterium sp.
atgtcggtcgtaagcccgttaatctacaatatcgtcgactacggcgccgtctcgaatggcggcgactgctccggagcattccaggcggccttcaacgccctcaacaacacgccggagggcggccagatctacatcccgcccggccggttcctcatccagaacccgatcggcggcaccaccgacaagagctgcgtcatcaagggtgcgggcgctgacgcttcggtgctcgtcttcaacggcccgaacctcaacaacggcctcgtcctccagcaggtcacgccgaacaacgcctgcgcattcaaggacttcggcgtcgtcgccaccggctgtccgaacctcggcaacgggtcggtcctgtcgatcatcggcgtcctccagggctgcaacggcatcaccgtggatggcctgcatgtccgtctgacggacgacgcgccgtgctcgaacgtgctgtacgtgcgcaacccgtcctcgggtgtcatccgcgacttcaacgtggacggctactcgggctggggcgagggcaacaccgcgaccggcatctacatcatctgcgacacgcagggcgccaacgcgatccagctctacaactgcaacatcttccgcgtctacaagggcatctggtgcgtcggcggccagatccagcagtacgtcatggaaggtttcgaggccaacgagtgtacgctcgtcggcgtccagtacggcctgcacatgcagggcggctggtacaggcctccgggcaacgcgtggaagggcgggcacatcaacgctcgccagatctgcatccttctggagacttggtacgagttcaagatctcggacactctgctgtatctcgacggctcggccgccgcgaacagccagggccacatccgggtcatcaactgcgacgagatccagatccacaacaactcgacccgctacgtggacgagatcacgggtggcccgacgcagcggggcatctggggcatcgcgatctcggacagcagcaacgtgctggtccagggcaacttcttcgacatcggacgggccgacagcgcggcgctctacagcgtctcgggcaacagcaacgtccggtcggccttcaacacgaagcgcggcgggggcgcctacggcgccggggcctacaccgagatcggccaggacatcgtcgtctga

SEQ ID NO: 7042 - DNA, 117 bp, Methylobacterium sp.
atgaccgcgcctactcgcaaggtccggggcggctgcggcttctgcgccgtggtgttcgccgccggcctgatgatcgccggctacgccctggccttcttcgtcaccctccacggctga

SEQ ID NO: 7043 - DNA, 324 bp, Methylobacterium sp.
gtgagcttacagtcggaatgcgctttctattggcgtttcgcgcccatccttgagatggcgaagacttcctggatagctggaccgatcctagaggaagctagggacgagatccagagcattgcgctgcacacccgtaatgctttgctccgcgaaatgtgcatcagcctcttggacgcgaccgccgaggatcggattgtcaacttttcgacggaacaagtggtgaacgaaatcctaagggccgtcgttcggggcagccgtgcccaatttccaggcgtctctgagggaaataaggtcgcacatctagacgtgcaggccttcgggtaa

SEQ ID NO: 7044 - DNA, 195 bp, Methylobacterium sp.
atgagcaagatcaccgaccaggatttgcttagtgccaccagtaacggcgatgggacgcacgacggcgtgaagctggcacagtggctttacgaggcctatactggcaagccgctgcctcgcgacaaggccgaggagctggtgcaggaaggcgtgcggcgggctcgcatccgcaaggaccaggaggcccgaggctga

SEQ ID NO: 7045 - DNA, 846 bp, Methylobacterium sp.
atgaccaaacagccgctcgccgtcgtcaccatggccttcaacgaggcgatgctgctgccgatctgggcgaggcactacggccggcaggtcggggctgagcactgctacgtcctggaccacggttcgaccgatgggtcgacgcgggacctgcccgtcaacgtcctccggctcccgcgctcgccccatgacgagcaccgccgggccgtggcggcgggcgatttctgcacgtcgctgctctacttctacgaccgggtcctgttcaccgacacggacgagatggtcgtcgcggatccggcccgggacgcgaatcttgtcgagttcgtccggcggctgcccggcgccccgtcgatcgtctcggccttcggcgtcgacctgctgcacgaccacacgcgggaaggccccctggattgggcacgcccgctgaccgaccagcgcagcgtgatccgaccgttcaactcgctgtgcaagcccacgctgatccgcgagcgcccggattgggccgccggcttccatttcagccaccgggtgccggcgacgacgatcgtgccgttcctctacctgttccacatcgccttcgtggacaacgacctgctcgtgcagcgccagatgcagcggaacaaggtggagaaggcccaggtcgatcaccaccagatcccgccccagccgctgctcgatcacgtcaagcgggacatggagacggtccggcgcgtcgggacgaagctggagcccggcgaccgggagttcgagcgggtgcgggcccggtggacgaaccttctcgacctgcgccagttcgtccagctcgacgagttctgggagctgccgcgccgattccgcggtttgatctga

SEQ ID NO: 7046 - DNA, 213 bp, Methylobacterium sp.
atgcccgcagatcgcgactttggtgctccggcccagccggcggcgcccccgatcactatcagcgtccagatcttccgcgagatcatgggcgcggccggagccgtgctggcgggttacggcgcctggctgcactacccgccggcaggcttcatggtcggcggcggcgtgctggtcgggctcgcgatcgtcgggaccctgcgcggtaacggctga

SEQ ID NO: 7047 - DNA, 126 bp, Methylobacterium sp.
gtggtctactggcctcggatcgttgatgccgcccaagcgcgcggcatcgagatcaacaacgacatcctcgtccgggcgcatctgcctcgcgaacgtctcgcacccgccgagaccgaggccgcctga

SEQ ID NO: 7048 - DNA, 189 bp, Methylobacterium sp.
atgagcgagggcgatgatccgattcgcgaagccgtctcggcactcagagcgaacggctacgaggtcgaatcaatggccggcgatcacatgctgtggctggtcaacggacaggcgctgaccgagggcgagctgatggccctggccgtgcgcctcggcctcatggactccacgacggacaagctgcaatag

SEQ ID NO: 7049 - DNA, 1155 bp, Methylobacterium sp.
atgaccattacctgcaagggcgccgtgctgcgccggatcggctgctcgcaaccctatgcggagtcgaagccgctctcgatcgagacgatcaccctcgcgccgcccacggcgagcgacgtcgtcgtgaaggtcgctggcgcggggctctgccactcggatctttcggtcatcaacggcgaccggggccgggacgtccccatggtgatggggcacgagggcgcgggcgagatcgtcgaactcggttcagccgtcacggacctccgggtcggcgatcacgtcgccttccagttctcggtctcctgcggccggtgccgggcctgtctcggggggcggccgaacatctgcgaggcggcgccggccgcccgcagccgcggcgaactcctgtcgggcggctcgcgcatcaccgatgccgggggcgccaccctgcgtcatcaggccggcgtctcgtgttttgccgagtacgccgtcgtcaatcgcggctccgtcgtggtcatcgatccggaactgccgctcacggaagccgcggtgttcggttgcgcggtgatgacgggggtcggtgcggtggtgaacaccgccaatctgcgggcgggcgaggccgtggccgtctacgggctcggcggcgtcgggttgagcgggatcatgggcgcgcgggtcgccggcgccgggacaatcgtcgccgtcgatatcgaggaggccaagctcgacaaggcccgcagccttggcgcgacccattgtttcaacgcccgggacccggacctcgacgccaaggttcgggaggctaccgccggcggggtcgactgcgccctcgacttcgcgggcgccatcccagcgctccgatcggcctacgcggtgacggtgcgcggcggccgtgtcgtcacggccggacttgcgcccttcggcgcgcagttcgccttcgagcagggcgacctcgtctcgaacgagaagcagatctgcggttgctacatgggctcctgcgtccccgtccgcgacttgccccgcttcgtgaagctctaccggagcggcgcactccccgtcgatgcgctgatcgattcgatcatcgggttcgacgagctgaacgccgggttcgatcgactcgcccagggctcggcgctgcgtcagatcctggcgccccacggtggcccccgccccacctga

SEQ ID NO: 7050 - DNA, 612 bp, Methylobacterium sp.
atgcagacctttgctcacatcgtcgacggcgccgtgcgcgaggtggtgaagctcgcggacgacaaggtcctcggaaaggacctctactccgccgccttcgccgcggagtgtgtgtcgtgtgccgcgaccgtcgtcgccggcatgctctacgacccggccaccaagaccttcgcgccggcgcccgtgccggtcgtcgacctcggcgcgctcaagggccggctgaaggcgcaggtcgacgcggatgccgaagccctgcggctcaccctgatcacgccgggctcgggtcaggcgatggagtaccaggaggcctacgccgaggcggtccaggtcgacgcggccgtgaaggcgaacgccagcgccaccttcgatccggccgccttcccgatgctgtcggcctcgctcggctacgacctcgatcctgagaccggcaaggccacgaccgacatccccggcgaggcccgggcggtgctcgccgcctacgacgcctaccagaaggcgggcgcggcgatccggggcgtgcgcctgcgcgccaaggccgcgatcgacgcagcggcggacgcggcgtcggcttcggccgcctatgcggcgatcgtctggccgacgctggcctga

SEQ ID NO: 7051 - DNA, 600 bp, Methylobacterium sp.
gtgaacgcgctgggcttcgacaccgcgctcgcgcgggtgcgggtcgagggtgtcgccgagctgttccagccccgcgcgctcgtcgcgtccgccgccggtccgatgatcacggtcgcccgcgccaccaccggcgaggcgctggtgtgcgcgccctacacggcgatcgccggcctcgacggcgcgaccttcacggatgccgacgcctgcctcgcctacctcgtgcggacgctggcgcagcggccggccggcgatccgatcgaggcagcggtagccgcaaccgacctcggcggccagcggctggtgcgcgcgctcggcgacggccgcgtcgcctacgcctcctgcgacgacgccgatgcagcggccgcgacgctcggcctgaccctcggggccgccgccgccggcgcgccggtcgacgtcgtcacccgcggcccggtcgaggagccgtcctggtcgttcgatccgggcccggcctacctcggcatcgccggcgccatagcccaggccccgccggcgcgcgggctgcgtctcccgatcggccgcttcgtcacgcccacgcgcctcgtgatcgcgctcgggcccgccgtcctcctcgcatcctga

SEQ ID NO: 7052 - DNA, 522 bp, Methylobacterium sp.
atggccgctctcaccgccgtccagcgccttctggtgcagggcgcgaagtcgctcgccgagtacgtgcccgtgcttgtgggcgggctcagtaacgccttccaggtcccggcgctgaacgcggccggccagctcgacgtgaccatgatgccgaccggcgtcggtccggacaccgagcagatggtcgcttcggaggcgctctcggccggcgcgctggtcaacgtctacgcgaacggcggcgcgccgacagcgcggaacgccgatggctcgaccacgggcaagcaggccgacggcttcgtgctcgccgcggtcgccgctggcggacaggccaccgtctacctgtcaggcctcaacaccgcggtccagggcctgacgccgggcctcgccttcctgtccgacacggcagtgggcggcatcgccgcggcgggcgcgaccgcggccgggcgcacctaccagcaggtcggcgtcgtcacccaggccgggcacctgcagttcgccccgcaggtgccggtcacgcgcgcctaa

SEQ ID NO: 7053 - DNA, 468 bp, Methylobacterium sp.
ttgctggatcagatctccagcctcgcccgtgacagcagctacaatgcccagaatttgctgatgggccaatcgatgaaggttcggctcaatgagaatgacacgacgggctacgacgttccgggcgcccgagtcgatgccgctggcttaggtctgttgacggcgcgcgacggcgatttcctcgacgcgcagtcactagcgtctgctggccgacagatctccgaagcgtcgatccagctgcagacagtagcacaggagttggcgaccagctattctgttgccaagatccgcgatagtttcacccgtgagatgacaaacgtcctgcaaacgggtgccgacaatttgacgcttgcggacatgaacgaagaagctgcgaaagctacggcgcttgacatccgacgacagcttggaacttccgccttgtcttcgtcaaatcaagcgcagcagagtatcctgcagcttctgcgttaa

SEQ ID NO: 7054 - DNA, 147 bp, Methylobacterium sp.
ttgcgccgaccgccccgatccgggcgcgatcggcgggcgttctacgggcaggtccaccggagacgtgctgacatgctgatcctcaacccgatgaccggccagatggtcgaggtgcgcgtgccccggccgaagccgaaggccgcctga

SEQ ID NO: 7055 - DNA, 255 bp, Methylobacterium sp.
ttgaagcagatccgtggcctgtaccatcaatgggcgcgctccgggctggtccgcgcgagcggcaacccgctgatccggctggcggcccgccgcggcctgccggcggcgaacgatgtcgtcaccgcggacgcgcagatcgccgccctggccccgcactttgacacggcgttctacgcgagctggtacgggatcgcggccgacccggtgcgcgactacctcgtccacggctggcgcgcgggccgcgacccgcgcccc

SEQ ID NO: 7056 - DNA, 405 bp, Methylobacterium sp.
atgactcagccacacctgatcgagtttcgccacatcctcgatcataggggtgcactgacccctatcgaggccgagaaggacgtgccgtttgcgatccggcgcgtctatttcatctacgacgtctcgcacggcgcggtgcgcgcgggacatagccacaaagaactgcagcaggtcctgatcgcgatctctggcagcttcaaagtccacttggatgacggccgcacgcgcaagacgtttctgctcaatcggcccaacatcggcctctatgtcccgcgcatggtgtggcgcgatattgacgatttctccggcggggcagtgtgtctctccctggcctcgcagcactacgaagagagcgattattacagggactacgacacgttcctgcgcgccgtggaaagccggtag

SEQ ID NO: 7057 - DNA, 102 bp, Methylobacterium sp.
atgccgaccatgatcagcgtggtcgccaccgggaaccggatgaacggcgccgagatgccgcccttcatggccgggccccgcgcggatgtgcgcccgccgtga

SEQ ID NO: 7058 - DNA, 333 bp, Methylobacterium sp.
atgtctcacaccgctttctcatccaagagcgccaccggccggaccactgcgtcacgactggtctccgccgccttagccggtctcgtgctcgtcggcacttcggtgatgcccgccgcagcagggcacttcatgtcggaagcccccgctgccgcgaagccagttcggctgccggcgctccacacaacgacgggcttccggcgcgtgagcgcggtcggccagaccaagccgcccggggcggccctggattggcgcgccggcacaacccccgggctcgacgctcagagccatcgcctggaccagctcatcaccaccacgatttgcagtcgctgctga

SEQ ID NO: 7059 - DNA, 429 bp, Methylobacterium sp.
atgccgaactgcgcgcgcctgatccgttccgcatggctccgcctcgccgtcgcgctcctgccggcgctggcggtgatgccggctgccgcgcagaacggcgagaagccggccgtcgccatcggggccgacgtcgcgagccaggccggcaccacccgcctcaccctgacactgtcccgggccgtcgaggcccgcggcttcgtgatggagcggcccgaccgggcggtgatcgacctgcccgaggtcaacttccagctcgattccgggaccggcagccgccgcgacggcctcgtgcaatccttccgctacggcctgttcgcgcccggacggtcccgcatcgtgatcgacctcaccgcgcccgctaccgtcgggaagatcgagaccgcgacgcggccgcgcgacggcgcggtgctgctcacgatcgcgctgcag

SEQ ID NO: 7060 - DNA, 279 bp, Methylobacterium sp.
atggagggaaagggggcgagggcgcaggtcatcggctcgtcgcgcggcgaccagacgaccgagatccacgctctcagcgaggtcctcggccggcccggcgtcctcccgctgacggcgggcaacgccagcgacgtcacaaccgccccagcatcgctggccgaggcgcaaggccggatccgccgcccgagcgccgacatgggctacgacgccgattggctgtccaccgacctgcgcaggaacggcatcatgcttgtccctcgccaccttggagcagagtga

SEQ ID NO: 7061 - DNA, 426 bp, Methylobacterium sp.
atgcgccatacgggcggcgggcgcaccaccgagggcgagaccgagatggcgctggagcacgcgcagccgctcggatcggcgggcgtgagcgacagcgacgtcaccgacactctcggcgaaggtccgccgtggacaagctgggttcgcacagcggaagcgtcgcaaccggaggcgcaggcggacggaccggccctgccacggcaaatcggcaagggtgcgctcgcagtgaccgtgcttgcggcctgcggacgatcgacaggtgggacagcatgtcggacccggacggggtacgacgcgcacgatgagcgggtcggtcgccagctcgacgccgacgacggtcaggccatcgggcacgaggggcaggatacggcggggcatggcgtcctccggaaagccgatctccggagatggggcacatcacgctaa

SEQ ID NO: 7062 - DNA, 570 bp, Methylobacterium sp.
atgaagaagcccgccctcaccggctacacgttcaaccccaccgcgcggacgctggatttcagcgccacgtcggggttcacgatccagagcctgctcgtggtcattcacgagccgaccggcaagacgctctacgccaagggcaaggcgcaattcgcgccgaagaccctggccggcgcggtcatcaccctgaacgatttcgtggacaccaccggcatggcggccggggatgcgctgtacgtgctccgcgaggacgggcaggacgtcgcgaccgacggcaggctggaatcgctgcggcgcggctcgacggcgacctcggacgcctccggctcgctggccgcggccacgaacgtcgcaccggcggcgctggcggcgaacgcgaaccgctcgttcatcgagatcacgaacacgggcccgaatccgctggcctaccgatggggtgccgccgcgtccgccacgaacggccacatcctcgggccggggctgaccgcccgctatcacgccaaggtgccggtcggggcgctgaatatgttctcgaccgccggcaccacgtacttcgtctccgtcggctga

SEQ ID NO: 7063 - DNA, 306 bp, Methylobacterium sp.
ccctgcctgggcttcgccatccggtcggggccgcggcggatcgccgaggggcgccccggggtcgggcgggaggtgccccgctcggtcgagcagatgaccgagctggtcggccgggtctcgatgaagaccctggtgcgcgagacgaccgacctgatcgagaagctctgcatcgaggcggccctgcggatcacccgggacaaccgggcctcggcggccgagatgctcggcctgagccggcagggcctctacgccaagatgcgccgctacggcgtcggcgacctggacggcccggtcgaggacatctga

SEQ ID NO: 7064 - DNA, 408 bp, Methylobacterium sp.
atgcgcacagccctcgccgccctctgtctcatcgccgctgccgacgcggcgcaggcggccggcaaggcagcggtgagcgtcgatcagctgctcgccgaccccaaagcgcattggggcgagatggtcttggtccgcgggatccgttgcgtcgatcccggtcctggcgggttcatctgcgagaccacggtcaacggccggctaatacggctggacgcctccgggctcggcggccacgcctcggaggcgatagccgagaagctgattggcccgtgcaatgggctcgcggcgctcaccaagccggcctgcaccttcgacgtgaaattcgttccgactggctcgggctttgaggacggcgttacgatcgtccacacgcccgagatcgacatgagcgccacgcggcgccgatag

SEQ ID NO: 7065 - DNA, 165 bp, Methylobacterium sp.
ggtgcctacggcggcgggggcggctaccggaatgatggctacgacgaccggcgcgacgcctaccgcgaccgccgcgactacgaccgcccgccgccgcgccgcccctacgacgacgattacggaccggggccgcgccgctaccggggtgatccggacgagtactga

SEQ ID NO: 7066 - DNA, 198 bp, Methylobacterium sp.
atggccgaggcgttcgtgcgaaccttgaaacgcgattacgtgcctgtctcggtgctaccggacgccgacagcgtgctgcgccagcttcccgtttggctggcgcactacaacgatcttcacactcatcgcgtgctgggttaccgctcgccgcgcgagttcatcgaccgctcaactcaggagatcttgtccggtctttag

SEQ ID NO: 7067 - DNA, 1110 bp, Methylobacterium sp.
gtgttcgtcacgctggaactcagcaagccggcatggctcctggccgcccaggccgtcccgagcgggaagacctccgcacaccgggtgagcggcggcgacgtggagggcctgctcgccttgctgcgccgcctgcaggctcgcgagcagcgcagctccggccgagaggtcgcgatcatcctcggctacgaggccgggtacgacggcttctggctgcagcgccgcctcgcggccgaggcgatcacctgcttcgtcatggatcccggcagcctccaggtcgaccgccgcgcgcgacgggccaagaccgaccggctcgacgcggccatgctgctccgggctctgatggcgtggtgccgcggcgatcacgccgcctgccgcatggtgcaggtgccctcggtcgagcgcgaggatgcgcggcgcacgcatcgcgagcgccagcgcctgatcgcggagcgggtgcagcacgtcaaccggatcaagggcctgctcgccacccagggcgtctacacgttccagccgctgcgacgcgaccgttgggagcggttgaaggaggtgcgcaccggcgacgggcgcgacctgcctcagcgcctgcgcggcgagatcgagcgcgagttccggcggctggaactcgtgctcgaacaggtcgcggccgccgaggccgagcgcgatgccgccgtggcggatccggccgtcacggacgccgacgccgagaaggtggcgcgtctggcccggctcggtggcatcggcaccgagctggccacggtgctggtgcgcgaggcgctgtatcggcccttcgccaaccgcaagcaggtggccgcctatgccggtctcacgccgagcccgtacgccagcggcgaccggcagcgcgaccagggcatctccaaggctgggaacccactcctgcggaagtcgatggtcgaactggcgtggctgtggctgcgctatcagccgggcagcgggctcgcccgctggttcgtcgagcgggtcggcaccggacgcgggcgcatccgcaagatcaccgcggtggcgctggcgcgcaagctgctggtcgccctgtggcggtatctcgccaccggtctggttccggagggtgcgcgcctgaaggcggcctga

SEQ ID NO: 7068 - DNA, 204 bp, Methylobacterium sp.
gaggggggacgggcccgggcgggcgcggaggccctgcaggcggcccgcgccctgcgtgcggccgggctgccggccctcgtggtcgataccggcacgcggggcgacgaggcccgttcggtggcggacgcgatgggcgcccgctacctgaagctgccccgggccgaggccggccagctcagcgcggcggtgcgggcggcgctctga

SEQ ID NO: 7069 - DNA, 270 bp, Methylobacterium sp.
ttgcgtactctctcggccgctgcgccgctggcggccgtcctcgccgggacggcctacgcgcaggcgccggccaccgcgccgggcgcgccgccgacctcctcgggcgtcgtcacgcctcaatcgggcgcgaccggcgcgccgggcgcggtgacggggtcgccgaccgggcaagccgccgacacgcgttccaacagctcctcagccgcgggcaacgccaaccagccggagcgcccgtcgccgcagggcggcagcggtggcagcagccgatag

SEQ ID NO: 7070 - DNA, 162 bp, Methylobacterium sp.
atgtccgccaaagacgtccgcttttcggtcgatgcccgcgataagatgctgcgcggcgtcgagcttctcgccaacgcggtgaaggtgacgctcggccccaagggccggaacgtcgtgatcgagaagagcttcggcgccccgcgcatcaccaaggacggtgtg

SEQ ID NO: 7071 - DNA, 327 bp, Methylobacterium sp.
ttgagcgtcctgggcaagtggcggatcgtcgagctgcccggctacgcggacgactatgccgacatggtcgagccagcctacatcctctttgaggccaccggcggcgagttcgccttcggatgcgtcaccggggccttcgccggtggtggtgaccacgctgccgtcaagttcgactggaacgggaacgacgagatggacgaggcctgcggctccggatgggccgcgcttcaggccgacaactcgcttcggggcgaaattggcttccacgccgacgacgacatccccttcatcgctcgccgctggccgagttcttcaacagcctgctag

SEQ ID NO: 7072 - DNA, 204 bp, Methylobacterium sp.
atgacgtcgcccatgacgcccgccgacagggaccggttcgagaagtgcctcgcgctcgccgaccagggggccacggcgggcgagcgcgcggccgcccgggcggccgccgagcgcatcgcccggggtgccggcctgaccctcgcggcggcggccgaggcgctccggcggagcgggcaggcctccgccgatcgggcgacccgcccg

SEQ ID NO: 7073 - DNA, 87 bp, Methylobacterium sp.
gtggagcgcgatcggtacctgccgaacgtgagccccggccgcatggtcgacgaggaggccgacctggagagtgacacgatcggatga

SEQ ID NO: 7074 - DNA, 825 bp, Methylobacterium sp.
atgatcgtctctgccatccgtgattccaaggatccgacgcccgtatacgcgcaagccccggcgcagatcgacaggaaggattgctatttctaccatacgctcgaattgagcaccggagaggtggtcgagggcggctgggatctgcgcgggcgctacgcagactatatcggtcatgtcgacctgcgtggacagcgcgttctcgatgtagggactgctggcggctttctaagcttttctgccgaggaggcgggagcgagcgaagtggtctccttcgatcaggacaccggcgctcggcagcacctgctgcccttcgctggctccccctatgtggtcgatcatgccggatgggtgcgcgcgcatgaccgcgcgatgcaggcttggaagaacgcctattggttcacccacgctgaccggggttcgaaggccaaggtcgcgtacggcgacgtatacgacctgccggccggcatcggattgttcgacgtggtgatcttgggcgccattctcgagcacctgggcgatcctgtccgggcgatcggatcgatcgccaaggtcgcctcgaatctgattgtgatcaataccgactacatccctggcgatgagccgatggctcgtttcaacggcaggcctgagaggccggaatatagctttgttttctggacctacacgattgagacgtatcgccggatcctcgcgatctgcggcttcgagatcgagaaggtctacaaggactcgtttctcggtacgcccgctgtacccggcggcgtgcggccgaacatgccccgcgccgcgatcgttgcccgtcggatcgcacgatcctcgaagtag

SEQ ID NO: 7075 - DNA, 2067 bp, Methylobacterium sp.
atgagcgctgagaagatcggcccgcagcaccgagcccgcaaagccgtgctctacgtccgccagtcctcggcccatcaggtccagcacaaccgcgagagccaggccctgcaatacgccatgcgcgagcgcctcgccgggctcggctttgcagaggtcgagatcatcgacgaggatctcggctgctcggccgccggcggcacgctgcgcgccggctttgaacgcatggtcgccgaggtctgcctgggcaaggtcggcgcggtcgccgcccgcgaggtctcccgcttcgcccgcaacagccgtgactggcagcagctcgtggagatgtgccgcgtcgtcgacaccctgctcgtcgaccaggaggcgatctacgcgccgcgcctgggcaacgaccgcctgctcctcgggctcaagggcagcctcaacgagtacgagctcgacctgctgcgccagcgctcgctgtccgcgcgctacgagaaggcgcgccgcggcgagctcgtggtcgcggcgcctgtcggcttcatcaaggtcggcgaccggcttgagatagatcccgatcggcgtgtgcaggccgcgatccggctggccatcgacaaggtggccgagctgggcagcgtgcgccaggccctgctctggttcctggagcacgggctcgatctgccgacacgcgtcaacgccggcccggtggtctggcgccgcccccgctactcgacgctgcgcgagttcatcgccaatcctgcctatggcggcgcctacgcctacggccgcagccgcgtcacggccagctacgacgcggccggcgccaaggcgcgggcccggcgcacgccgcgctcggagtggctggcgttgaagcccggcgcgcatgagggttacgtcacgtgggagcgggcggaggcgatccgggcgatggtgagcgagaacgtcccgacgagttcccgtggcgcgcccaagctcggctcggccctgctctccggtctgctgcgctgccggcgctgcggacgcaagctgagcgtccagtacaccggggccaaggggcagatcccgcgctacgcctgcgtccgcgggcggatcgactacggggagccgaactgcatcgccttcggcggcctgcgtgtcgatgacgtcgtcgaggcggccctcctgtcggtggtgcagcccggcgccatcgaggcggcacgggcagccgagtcgcaggcgagcatgcgccgcgacgaggcacgtgaggcgatggtgcgcgatctggaggcggcgcgctacgcggccgaccgcgcgttccgccagtacgacgccgccgaccccgagaaccgcctggtgaccggcgaactcgaagcgcgctggaaccgcgctctgtcccgggtcggcgcctgtgaagcgcgcattgccgagcacgacgcggtcgccccccgacccgcccttcctccaatcgcgttggagacgctcgccgcggacctgcaggacgtctggtcagcgcccacgacggatgcgcggctcaagaagcggatcgtgcgcaccctcatccacgaggcgatcgccgacctcgacgaggtacgggccgagatcgtgctcaccctgcattgggccggcggcgcccacaccgagcatcgcctgccgcgtcggcgacgcggtcagcgcaccagcacgcccgccgacgtgatcgaagcggtgcgcacactggcgctcatcacgcgcgacgacgtgatcgcgggcgtactcaaccgcaacggcgtgaggacggggcacggcaatcgcttcacgcgcgagcgcgtcaccgcattgcgctcgcagtaccgcattccggtgttccgtgaggccgcggcgggagaggagccttggctcaacctgacccaagctgccgcccgcgtcggcgttgccgcgcgaacccttcgtctggctgcggaacggggcgagatcgatgcagcgcatccgctcgtggacggaccttgggtcttcagccgcgcggctctcgacggcccggctgcccgcgtcctcgcacaggaggcactcaaccgcggcaaacaccctgcggtaccgcatccagcacagcaatccctcttcgcatcaacgacatag

SEQ ID NO: 7076 - DNA, 219 bp, Methylobacterium sp.
atggaacgctacgagctggtcgagggcagcgcggccaagttctgggaggtcggcgtctccggcccgacgctcaccgtccgcttcgggcgcctcggcacccagggccagagcaaggacaagacctgcgccgacgcggccgcggccgcgaaggagaaggacaagctcgtccgcgagaagaccgccaagggctacgtccgcgccgacggcgcggctcccgcc

SEQ ID NO: 7077 - DNA, 828 bp, Methylobacterium sp.
gtgagggaggctgtcatgtcgaaccagacaaccaaggccacctcggcgacgtcgctccgtgagcgcgccgcccaggcccgggacgcagctggccggttcatcaagcggagcccgccagttgcgccagctccgacccacgccgagcaggtcgcggaggccgcgctcacgggggacgtgctggccgcctgcggcatcgaccaccgcgacggtaccgtctcctacgccgatgctaccgggaaggtcgtgcggcatcccatggcgcgttggatcgccttcaacgctgtgcagatgtacagccacgtgcagagcgagatgggccgcaggcgggtcatcgaggccaacccgctgccgggtgccgagcatgcagcctgggaggcacggatccgacgcgagctgcgcgtcgacgcgatcgccgctctcacctttaccccggggcacgcttttcaggtcgagcaggaccggcggaccggtgcagagccgatggcggacggatcaatcctggcgctgatcgaggagcacagggccgcctacgccgagtgggaccgattgtcggaagtctggagcgagatgctgacgaccgacccaggctatgccgaggccgtggcggcatccgaggagccgggccggcgcgagatcgccgcctacgaggcattgttctcggcgcgtccgacgaccctgcccggagcgatcgccctgaccgaatacctgcgagaggccacggagcgcgtcagcaccaacatacagccctcggatgccgagcgcgccttatcgatcatcgccagcgcgctgcgcgggatcgtggcggcggctgagcccagaggacactga

SEQ ID NO: 7078 - DNA, 411 bp, Methylobacterium sp.
atggtgctcgaggcctgtcccgacgtcgtgctctacgcccgcgacggcatccggagctggtccgatctggccggcgcggcggaggtcgttcgtccggcgctgggaatcggcccggacgtctgggaggcggccctggccgcgatggggcgggaccacgcgctggcggcgctgtcggcgatcctccagcgcgccgagtcgatcggcgcgcccggcgcctatctccgcgacctgacgcggaaggcccgctccggccggttctcggcctggccgatgctcttcgccctgtggcgccagcgccgtcgagcgtcatccgacggctcaagcggtcccctccgcgtcgcggaagttgaccgcggtcaacacgctcgcccgctcggaggcggggcggcgcgagcgtcaacattctgttaa

SEQ ID NO: 7079 - DNA, 207 bp, Methylobacterium sp.
atgagcgacgagaccgagcttcgacatcatcaggccgccattcagcacatgatgcggcgccttgacggatttgcgcgcaggctcggcctggacgaggcggccacgcgccaggtcgttgagaggatcgcctccgacatgccggagtggacggacgaggagcggctggagacagcccgcaggtccctgttggctgtggcttcggcatag

SEQ ID NO: 7080 - DNA, 420 bp, Methylobacterium sp.
atgatcgccgcccgtcagcatgcgctgccgcccgacgtcgaggcccggcaacaggtcggtttccggctgcgcgctgcccgcgacgccgcgcgcctccagggccgcgcccagtcgcccgccctgcgccgcgagatcggcgccgccctccgggccgcgcgggacgccgccggcatgtcgcagagcacggtagcgcgccgcctcggcatatcgacaccaatggtctgcttcttcgaaacgggccagaagcgcgtgccgctgaatcggcgggacgacgtcgccgccgtctatggcgtgccgcccgagcatctggatcggccgccggtcgtcacacgcagcgaggacgaggccgcgctcgtcaccggctaccgccacctgtccgaggacgagcgcgccgcgctgctcgcgctggtgcagtcttga

SEQ ID NO: 7081 - DNA, 231 bp, Methylobacterium sp.
atggccaaggatagggacgtccccaaccggcaagtgcgcccattacccgaaagcctcaaccggctgctgcttagcgaccccacccagccgattgggtggatcgaggatccgctcatcggctaccatagaccctccgtgtacgaccgcgtgctttggtggttcagcgtcgcggctttcgcggcggccgcgttcatgaccagtgcaagcatgacggtcaggcttctgcggtga

SEQ ID NO: 7082 - DNA, 183 bp, Methylobacterium sp.
ttgcgcagcgccttcgagatcatctcggggccattgtcgcagcggatgtgctcgaggatgccgcgcaggctcgatctggcgcagcttcagcacgacctgctccgcgctcgtcttctgacctcgccgcatgtccgactcccttggtcccagttgatcctctcaatcagcccggtccaaagctag

SEQ ID NO: 7083 - DNA, 402 bp, Methylobacterium sp.
atgacgaaggtcgagaaccccaagcgcgcgcacggcctcaagaagctgccgctggagctgatcccgcgcgtggcgctggtgcaggaggccgcggtctacggcctcggcgccgactctcccgcgaaggcgtacggccggttcaactggcggaaatcgccgatcgacgacgcgatctacgtcggcgcgatcgagcgacacctgacgctatgggcggccggcgaggacgtggacccggagagcggcgtcagccacctcgcccacattcgcgcctgctgcggcatcctgctcgacgcgatggatgccgggagcttcgtcgacaaccggcaccgctcgccggagacgatccgggtgctgcgcggctacgacgcggcggcgctcccggtcgtggcgccggccggctga

SEQ ID NO: 7084 - DNA, 846 bp, Methylobacterium sp.
gtgttcctgcgcaagaactacctcgcgaagggctcgacctggtgcgccggagagctcaaccgaaccgtcggcgccgtgcgcgctatggcgaagaagctcaagctcggccggccggccgaggaggtccggttccggtggacccagcagcacgacgatcgccttcgccgcgtctacgagaacggcaagatcggcggcgtgaaggaactggcccactctctcgggatcacgccgggccaggcccggtaccgggcgggggagctggggctgtcgacgcgctggcaaaccggcccctggaccgagccggagatcgagttcgtcgaggcgcacacccacctgcggcgctcgacgatctcgctcctgatgaagaagaagggctggacgcggacgccggtggcggtgcagcagctcattcgcagccggggactcgccggcgcgaacgatcgcttcctcccggcctcgactgtcgcggcgtatctgggggtgaccccggtggtggtgttcaaatggctcaaggacggcctgctctcgtccgagtcgccaacgggcggcgagcaggatggacgcccagtctacttgatcgaaaaccgcgagcttgcccggttcatcgtgcagaacccgttgaagctcgacccgcgcaagttcgactggccgtgggtctcggatctgctcgcgcgatacggctcgttcgggctgatcgaggggcggaccatgatagagcgcgtcgccgccctcgatcgcgagaagcgcacgccccgcgagatcgccgaaattctggagtcgacgcccaacagcgtgtcggtgatgctctcgcgcatccgcgcccaagagcgacggcaggccgcatag

SEQ ID NO: 7085 - DNA, 4977 bp, Methylobacterium sp.
atgatgtctctattcgacgtgccgcaactgccgagcgcgccgccaccaccggcccagtccctgccggtcgacttctatctcgacggggtccgcgccctgtcccgcggatgggccgcccgagctcgcgacaacgtcgaggccatctcactctccgccgccatcctcgccgagggacgccctgcgacccccgaggagcaagcgcgtctcatgcgcttcgtgggcttcggcgcgaccgatctggcgcagggctgcttccccaccacgggctcgttccggtcgggctgggaggacatcgcccggttgctccaggcggccacccggcccgaggagctcaaggcgctggcccgcgccacccagttcgcccactacaccccggagccgatcgcccgcgccatgtgggccgcgctgctgcgcatcggcttccgcggcggcctcgccctggagcccggcgtcggcgccgcgctgttccccgccacgatgcccgccgagctgcgcgggcagacccggttcatcggcgtcgaggtcgagccggtgagcgcccgcatcgcggcgctgctgcgcccctccgacgagatccgctgcgaggacttcaccaaggcccggctgccgcgggacttcgatctcgccatcggcaacccgccgttctccgacctgaccgtccggatcgacccttaccgcggcttgcggctgcacgacttcttcctggtgaaggccgccgaccacctccagcccggcggcctcgccgccttcgccacctcccgcggcaccctcgacaaggccgacggcggcgcccgcgtggcgctccacgccgcgtgcgagttcgtcggcgcgatccggctacccgacggcgccttccgcgcgagcgcggggacggacgtcggggtcgacctggtgtttctgcgccgccgggcctcgggcgcggtcatcgacctgccggcatggctggagaccgcgtcggccggcttcccggatttccccgggatccggatcaaccgctacttcctcaacaaccccgacatggtgctgggccggcccgacctcgcccggtcgccgcggggcgagaccgtctatgcctgccgcgccccggagggcttcgacctcgaggccgcgctggcccgcgccgtcgcccgcctgccggaaggccgcgcgcagcccgtggcggcccccaggacgcccgtgatcgagacggagcgcccttcggccccgtcggcgatcgagcgccttcacgagggctcctatctcatcggagcggacgacgagctgcagcagatcgtcgacggccggcccgtcccggtgcgcatccgcgcgggcggcagcgggcccgggatcttccgcacgcacgcggccatgatccgcaagcttatcccgctccgcgacgcggtgcgcgagatcctgcggctgcagatggcccgggccgactccatggacgcccaggcccggctcggcgcgctctacgacgcgttcaccgccaagcacggcccgatcaaccggaccgaggtgagcgagagcaccgacgctcagggcggcaagagcgaggtgcaccggcaggtcaacctcatccccttccgggacgaccccgacacccacctgctcgcctcgatcgagaattacagcctggaggcggacaccgccacgaagggcccgatcttctcggaggtggtggtcgcccgtgagatcgcgccgacgatcgagaccgccggcgacgccctcgcccgctgcctgcatgagaccggccgcgtcgacgtcgaccgcatcgccgcgctgatcggccggccggtcgccgacgtgctgaccgacctcggcccggccgtctaccgcgacccggacaccgccgaatggcagacggccgacgcctacctgtccggcccggtccgcgcgaagctcgctgcggcgcaggaggccgcgaaggcggaccacagctaccggcgcaacgtcgaggccctggagacggtgcaacccgtcgacgtgccgccctcggacatcaccgcccgcctcggcgcgccgtggatcccggccgacgtggtgcaggacttcgtcaaggaggtcctgggcggcgacgtcgtggtgcgccacaccgccgacgtcgccacgtggtggatcgacctgcgctggttccgctgccggcccgaggccagccacgcctacgggacgccgcgctactcggccggccaggcgctgctcgacgcgctcaacgcccgcaccccccgcatcgtcgaccggatccggaccggggtgaaccagtggaccgaggtggtcaacgcggccgacaccgaggcggccaagaccaagcaggacgcgctcaagcgcgcgttcgagagctgggtctgggccggcgggccgctcgcccatttccgcgccgaccggctcgcgcgcctctacaacgaccggtacaacgacacggtcccgcgcagcttcgacggctcgcatctcacgctgccgggcgcgagtgccggcttccggttccggccgcaccagctccgcgccatctggcggatcctggcgtcggggacgtcgtacatcgcccacgccgtcggcgccggtaagtcggccgtgctcgccgccgccgtcatggagcagcgccggctcggcctcgcctccaagcccatgatggtcgtccccggccactgcctggcccaggtcgcccgcgagttcctgtcggtctacccgctcgcccggatcctggtggccgacgagaccgccttcgccaaggaccgccgccagcgcttcctcgcccgggccgcgacggcggactgggattgcatcctcatcacgcactccgcgttcaagctgatcgcgacgcccaaggcgttcgagcagcagatgatcgccgacgccatcgcggatttcgaggcggtgctggagcgcgtcgccgagagcgaccggctcacccggaagaagctggagcgcgccaagcagggcttcgaggccaagctggaggccctgagcgtccggcacgacacgttcctgaccctggaggagatcggcgtcgaccagatcctggtcgatgaggcgcacgagttccgcaagctcaccttcacgtcgaacatgaccgtgaagggcatcgacgccaacggctcgcagatggcctgggacctgtgggtcaaggcggccttcgtgcgggaccggcgcatcgcgcgcggcgatcgccgcgtagaccgcgcgctggtgatggcctcgggcacgccgatcacgaacacgctgggcgagctctacacggtcctgcgcttcatggacatggaggcgctgcgcgagcgcgggctgcacgagttcgacgcctgggcggcgagcttcggcgagagccggaccgagctagagctgcagccgtcgggcacctacaagccgatcacccggttctccgagttcgtgaacgtccccgagttgatcgcgctgttccgcgcccgcgcggacgtggtcaccgaggaggagctgcgcgacctggtcccgcggccgcgcatccgcagcggcaagcgccagatcatgacctcgccgccgagcgaggcgttccgggagttccagcgcgaactcggcgcccgcatcaaggcgatcgccgcgcgcagcgggccggccaagaagggcgacgacatcctgttgaccgtgatcggcgacggccggcacggcgcgatcgacctgcgcatggtcgaccccttcaacgacaacgagccggccaacaagctcaacaagctgatcgccaacgtcctgcggatccaccacgagaacgccggctgcgtctacctccaggaggacggcacaccctacgagcgcaccggctgcgcgcagatgatcttctccgacctcggcacggagaagtcgatcgccacgcgcgggttctcggcctacgtctggatccggcaggagctgatccggctcggcgtcccggtcggcgagatcgccttcgtccaggactacaagaacagccgcgctaaggcccggctcttcgccgcgatgcgcgccggcatcgtcaagatcgtcctcggctcgacccagaagatggggaccggggtcaacgcccagctccggctcaaggcactccaccacctggacgtgccgtggctgccgtcctcgatcatgcaacgcgagggccggatcgaccgccagggcaaccagaacgacgagatcgagctgtgggcctacgcgacggagggctcgaccgacgcgaccatgtggcagacgaacgagcgcaaggcccggttcatcgccgcagccatggccggcgaccggtcggtgcggcgcatcgacgacgtcggcgaggatgcggtcaacctgttcgccctcgccaaggcgctggcctccggtgacccgcgcctgatgcagaaggccggactggagagcgaggttgcccgcctccagcgcctgcgcagcgcccactacgacggccagcacgcctaccgcgcccggatccgcgcggccgagcggaccatcgtcgaggcgacggagtcggcccaggcgttcgaggccgtcgccgcccgggtctccggcccgttcgtcctgaccgtcggcaagaaggacttcaccgacccggccgagggcggcaaggcgctcaccgacgccatgaaggcggtcgaccgcatgctcgagggcggctggttcaagggctcgaaggccaaggtcgaggacgagctggtcgcgaccgtgcatggcctgcgcatcctctacacctccggcgtcgacgggggcggctcatggtcggccgcgaagctccaggtcggcagccagtgggtcgccctgcgctgcaagtcgatcacgccgggcgcggtcgccttccaccaggtcgccgaagaggtggcgtcgatcgccggcgccgccgaggccgcgcggttcgaggccgagcgggcgcggtccctgatcgccgacaccgagccgctggtagggcgcccgttcgacctcgaaggcgagctcaacttgaagctcgaagaactcgaccgtctgaacgcggagcttgacggggcgtcgatcgaagacctggcaccagccgcgtaa

SEQ ID NO: 7086 - DNA, 288 bp, Methylobacterium sp.
atgaaccagaccgaggctcgatacgacgcccacctgagagcgcgccacgcgaccggcgaagtcgaatggcacaagtttgaggggctcaagttccgcctcgcggacaatacgttctacacgcccgactttgccgtgatgatcgccggtggagcgctggaggcccacgaggtcaagggcttctggactgacgatgcacgggtgaagatcaaagtcgcggccgcgctcttccccgtgcagttcgtcgccgtgcagtggaagcgcggcgcttgggtcgaggagcggttctga

SEQ ID NO: 7087 - DNA, 1062 bp, Methylobacterium sp.
atgagccccaacgacaccgccgatcccctcccgccgaaacccgccagcctgcccgggcgcggctcagtctggcagcactacaagggcacgttctaccgcgtggcagaggtctcgcgtcacagcgaggatccccgccagtggctcgtcacctatgcccccgtcgagggcggcgacgcctggacccgcgcggtgcgggcgccgctggtcaacacctggccgggcttcctggacttccggcccaacgcgccgggccaccgcttccgacacgtctccggtccgcgcacctggcgcgacgaggcgccggagtcccagacggctgcggagcgcctgtccgcggctgcgcccctgatgctcgccgcgctcaaggcataccgcgcgcagtacgcggatcggccgagctggccggacgacgaggtcgcctgccttgagctggccgatgccgcgatcgcggcggccatgccggcgctcgaagagcgcgagacgatcgcggtgacctggcgagacgagaactacggcgacgtctcggacgtgctggccttccgcacgtacggcctgaccagccttccggagcaggtccggcggcaggtcgaccgcgtcatccgtgccgcgggcttcagcttcaacccgcgccgcgcctcctggatggcgctggccgaccccactcacgaccggaaagccggcctgaccgccgcactggaagccgcagggttccaggtcgaacacaggggcgcgatcccggacgtcacgccgcccggccccgccgtcccggccccgcccgggccaaggcctcggcttacgctcacctggcgcgacgagaactacggcgctgtctccgggaagatcgcattccgctgctacgacaagggcgacctgacggagggcatgtgggccccgatccggaaggcggtcgaggaggcgggcttcacccaacacctcggccgctcctgctggatggcggacgacactcccggccgcatggacagcctcgccgaagcgctggaggcgctcggatacttcgtcgtgcatgccggcgccgtcccggccgaccgggtgagggcatga

SEQ ID NO: 7088 - DNA, 543 bp, Methylobacterium sp.
atgcactactacgcgcacctccacgtggacggtacgaccgtccacgagatcctcgaactcgccgacgaccaggtcctggggctcgacctctactcgaaggagatcgccgaggcgtcggtaccgtgcgacgcgtcggtgcgggccgggttcacctacgacccggtccaccagaccttcacgccgccgccggccccgcccgtcgacctggaggcctacgccggagcggcccacgccgccctgcgcgacggcggcgtcacgatccagggcatgcgggtgaagaccgacgccgagagccgagggctcatcgacggcgcgttcgcgctgagcaagtcgcggccgggcggccagatcgacttcaaggcggcgtccggctgggtctcggtcgacgcctcgaccatggaggcgatcgccgtctccgtcgggctgtgggtgcaggcatgctactcggcctaccgccaggtcgacgagaaggtgaccagcggcgccttcaccaccaccgagcaggtcgacgccgccttcgcggccgtcgccctgccgagctga

SEQ ID NO: 7089 - DNA, 1713 bp, Methylobacterium sp.
gtggcaacgatcaagctcaagcgacgcaccagtggcgtcgttggctcaccttccgcgcttgccagcggcgaggtcgctttcaacgaagcgtccggcgatctgaacctgtattacggcgctggcgacgacgggaacggcaacgccaccagtatcatcgcgatcggcggcttcggctcgtactggacgaccaaggcgacggcgctgcggctcgaccagttctcggacgcgatcgcgccgctggtcggcgtcgacccgacgctgccccagcatctcgcgacgaagaactacgtcgacagcgcgatccagggtctcgaccccaaggcgtcggtccagcgcgcgacgaccggcccgctcccggcctacacgaccagcggcaacatcctcaccgcctcggcgaacggcgcgctctcgctcgacggcggcgccctgagcgccggccagcgcgtcctcgtcaaggacgagaccgcgtcggcctggaacggcatctacaccgtcaccgccgccggctcggccgcggcgccctggcagctcacccgcgccaacgacttcaacctctgggtcgaggtccccggcgcgttcgtcttcgtcgagcagggcacggcgctcgccgataccgggtggctgtcctcggccgaccagggcggcacgctcaactccacggcgatcacctgggtccagttctcgtccgcgggcgtgctcctcccgggtgttggcctgaccaagtcgggcaacacgctctcggtcgtcgccgatttcggcatcagcgtctcgggctcgggcgtccggatctcggcgacctacgccggccagacctcgatcacgaccctcggcacgatcacgaacggcacgtggcagggctccaccatcgggaccggcttcggcggtaccggcctcacggccgtcccgaccggcctcctgaagggcaacggcagcgtctactccgcggccgtcgccgggacggactacgcggccgcaaccggtgggacgcagatcaccaccgtcggcacgatcggcgccggcacgtggcagggcacggcggtcgcggtcggcttcggcggtaccggcctgaccgcagccgtcaacggcctgctgaagggcaacggcacctcctactcggtcgcggtcgccggcacggactacctcgcgccgaactgggccgggtcgagcaacatcaccacggtcggcacgatcacggccggcacctggagcggcacggcgatcgcccccacgaagggcggcacgggtctcacgacggtcccgaccggcctgctcctgggtaacggcacgacctactcgaccgccgtcgccaacacggactacctggcgccgagctggaccgggtcggccaacatcgtcacggtcggcaacatcacggccggcacctggaacggcacggcgatcgcccccgcgaagggcggcaccggcctcacggccgtcccgaacggcctcctgaagggcaacggcagcgcctattccgcggccgtcgccgggacggactacgccgcggcggcgggtggcacccagatcgtcaccgtcggcacgatcacggccggcacctggaacggcacgacgatcgcccccgcgaagggcggcaccggcctcacggccgtcgtctccggcctgctcaagggcaacggcagcgcctacgcggccgcggtggccggcaccgattacctcgatcccggctcggtcatcgacggagggaccttctga

SEQ ID NO: 7090 - DNA, 564 bp, Methylobacterium sp.
atgttcggaccgcgccggttcggggcgatccgaggggcgctcagcggcatcagcgcgaaggtgctgaccgagcggctgcagggtctgaagcaggcgggcatcgtcgcacagcggactctgccaccgccggcctcgacgccggtctacgagttgaccccatggggctacgaggccgagccgatcttctcggtgctcgggcgctgggcggcccgttcgccctcccacgaccccgctctgccgctctcggcggcctcgctcatgctgtcgtttcgcacgatgttcgaccccgcacaggcctccggcttcgaggcgacgatcggcttccggttcgacgaggacgccttccgcgtcacggtgagcgagggcgaactccacgccgcccgcgccgacctggtcggggcgcacgccgtcgtcggcgccgcaccgccggtcgttgcggccatcgtctatggcggcctgccgctcgccgacgcggaggcgtcggggcaggtgtcgctggagggggaccgggacgtcgtgcagcggttcgccggactgtttcccctgccggggaaggcgttctga

SEQ ID NO: 7091 - DNA, 261 bp, Methylobacterium sp.
atgcgcctgctccgcctgatcctcctcaccggcacggtgctgccgggcctcacgctcgtgcagctcgccgacgccgcgccgggccggatccaagtggcgcagggcgggccggacgagcgcggcccccgcggcggcgagcccccgcacggcggcccacgccccgaacggccgccccaggagcgtcccggcccgccgccgggcccaccggccgcgcgcgagcggcccgaaccccggccggagcgggcgccgccgcccccgcgc

SEQ ID NO: 7092 - DNA, 246 bp, Methylobacterium sp.
atgccgctgcacgtccccctcgcgaacggctggaccctaagcatctcggaggacacgcccccggccttctgcgcggtggccgcgtggccgtcgcactacagcgatgcacctcgcgatcagagcctgtggttcgttttcgaggggcgccaagtcgaatgccgctgctggcttctcgaagacctcttgcaagcgctggagctcatccttcgcgcaccgcgtccgagtgacctcggagagcagatctga

SEQ ID NO: 7093 - DNA, 717 bp, Methylobacterium sp.
atgtggatcaagcagctaatcggccgccttgctggccaagtcgtggaccttcccttcagcgcggccgagaacgtgctggcgaacggcacaggtgagctcgccaccgacgccgaggtgctcgccgccgggttcgagccgctcccggccgtcgcgccggtccggaccgacgtgttgccgctcggctaccgtgtcgagccgaccgaggtgggcggcttcgacctctacgacgccggcggcctgctcctgaacgtcgagccgctcgccaacatgatcgtggcggtcgaggcggcgcacgaccatcgcgaggcggtctatctgccggtccaggtcgttccggtcggccagctgccgccgcagctgccgatcccgccgcgcgtcctgaccgccgactatctcctcgaaccgatcgaaggcggcggcttcgacgtgctcgacccggccgggctcaagatcaacgacgcgccggtggcggacgaggaggccgcgcgcgccatggtgctgctgcacgttgccgaggcgaccgggcgcaccgtcgagcaggtcgaggccgatgagatggagcagccgccggtcaccgagatcgatgtgcccgaggactggaagagcctgcactggtcgcagcgcaaggccctcgcccatcggatcaacgggggcgcgccggtcgcgaacgcggccgaggccgatcacgtcatcgaggagtacctcacccggccctga

SEQ ID NO: 7094 - DNA, 486 bp, Methylobacterium sp.
atgccgaaggaaaatttcgccacccgcaccaagctcgtcgccgtcctcgcggtggcggcggacggcgcaggccgcagcggccgcgcagtcaatctgaagaacgccgccttcgcgaccgtcctggccaagatcacccagggcaacgcggcgccggtcaccctgaccttcctgcaggcgcaggacgtgtccggcaccggcgcgaagccgatcaccaaccccgcgccgatctgggccaacctcgacaccgacgcctcggacacgctcgtccgccaggccgacggcgtcagcttcaccaccgatgcggcggtgaagaacaagcacatcgtggcgcacatcgacccggcctatttcgacatcgcgaacggcttcaagacgctcatcgtggccaccagcgcctcgaacgcggccaacctcacctcggtggacgtgctcctcgaggccggtcgctatcagagcgagccgcttcccaccgccctgacgaactga

SEQ ID NO: 7095 - DNA, 372 bp, Methylobacterium sp.
atggcgcggctggaggccgacggctacgacctcgaggccgagatcctgccggctctgctcgacgccgccgcagcggcccgaacgccggtccggacgtggcggatctgggctgatcgcgtcgccgaacggatcaacgcccagcggctgacccgagcatcccagggcctgcccgccacgccggccgcgccggtggccgaggaggacaagatcgacctcggcgccccattcggccgctgggccgagccggtgctgcggacggccgtcgccaagcaccgcgagatgggcggatgggtcgaccacctctggggcccgccgcccggtcagcccgggtgcaagatcccgccccggctgctgatcgtggaggccgcgtga

SEQ ID NO: 7096 - DNA, 246 bp, Methylobacterium sp.
atgaggccggtccgcttccactatctgcgtctgcaggagtggctcgcccatctcgatgaggcccgggccaacgcgcgcatccgctcgattctggccttccgcaaccgccgagcggccgacgccaagcgctacggcgcggaggccgatgcgatctgcccgcctgaggcgcccgcccgcgagtggtctcctcgcctctgggatcgcgatcacgacgcccgcagcgacacgcgcgagcgccagccatga

SEQ ID NO: 7097 - DNA, 285 bp, Methylobacterium sp.
atggccggcgcgcccgctcacagcggcacgctcgaggatcgcgtccgcaccatcctcttcgacgtcctcgccaccgagccggagcggcaggtggatgcggcatacctcgtccaagacctcggggcggacagcctcgacgtcgtggagtttgggttcgagcttgaggaggctttcaagctcggcatggacgagctcgacctcacatctgcgatcactgtcggcgacgtcattgccgccgtgcgtcgtgtcgttgatgcgcgggcggtgcccgcggggggcgcctaa

SEQ ID NO: 7098 - DNA, 339 bp, Methylobacterium sp.
atggccgccggcgcgagggagaccctcgacctctcgacgatcgatccggcgcaactcgcccatgcggccgagaccgcggcccgggccaacctcgcggccgccgggatcctcggcgcctgctccgagcgctcgaccatgcgggccgccgtccggaagatcgagcacggccaggcgctggcgagcctcgcgctgctgatgagcttcgtcgccgagcactacgcgagcctgctgccggtgttcctggcgctccaggagggctcggtcgtcgccgtcgaagaggtgaccatctcccgcagccggaaggacgagcggtccaagctcgcgctggtggcgcgatga

SEQ ID NO: 7099 - DNA, 633 bp, Methylobacterium sp.
atggacaacgagggcacatcgccggccgacaagttcttcagctacggcatcgaatgcggcccgcacacgatcctcgacacgctgaacagcagcggcggcgtgctggagcaggagaaccacgaagacggctgcacggtctgggacgagcaggcgcggcgcgatctcacgtacatcgccgccctggtcaacgatcaccgcgccggccggctcgtcgaggtgtcggacgcgccgcccggtccgtggcgccctatgctcgccggcgccaacagcctcggccgcaaccggaagggcgacgtcacgatcaatgtcccgaccgcgctgtgctggctccagttcagcccggactcgttcaccggcaccgaggacgagacgcggccgggcgtcgggttcacgctggtggcctacccgggcagcgccggcgaatggccgaacggcgtcatcccgcgggacgaggcgttccggctctaccagatgctggcccggttcttcgccgcgcatccaccgcccggagaaccggccgcgcgggagctcgaggcagcagctgccgacgctgagccggtccgaggcgaccgcctccgccgcatcgccgccgcgctccgcggggccgccgtcggagggccgcgccatgggtga

SEQ ID NO: 7100 - DNA, 291 bp, Methylobacterium sp.
atgggtgagcagaagcgcaaggccgcggccgggcacgtcccgccggagggcatggcgaacgtctcgggtcggcacgtcaccgagttggcccgcgggatcatggacctgctggagaagcccttcgacgagggtatgcaggccgacgtcgccgcacacgtcatggtcgccaccgccgtggatctctggcgggcgaactacggcgacgcgcaggtggcggacgctctcaagcgcgcgatcgaccggcggctcgagaagccggccgaatactggggcgggaagcggggagcctga

SEQ ID NO: 7101 - DNA, 138 bp, Methylobacterium sp.
atgccgatcctggaagagctcggctacgtcgaggagcgcgcgacccgcggcagcactcgccggcgcgcgtggcacctgaccccgcgcggacgcgaactgctgatcgcgctcgggatccgcgagagcgctgagccgtga

SEQ ID NO: 7102 - DNA, 288 bp, Methylobacterium sp.
gtgctgctgaacgcgctgatcctggtcacgaccctggtgccgcacgccgagtccggcgcggacgccctcgcgcgcgcccttacgcccccggcgaccgtttccgctccggccgacagcccacccccgcacttcgaccccgcgacccgctccgtgtccaactggcacgcccagaccggcgcgcagctgaccccgcgggcgctggcggtcacggcgtcattggccgacgacccgccctacgtcgcccgctgcgtgcggctcaacaacggctggtgcatcaagtccccccgc

SEQ ID NO: 7103 - DNA, 114 bp, Methylobacterium sp.
gtgcaagcatggctgctctccgccgccgcggcctcgcccagcgcggtctgcatgatcgcgcggatcgtgcgggcgcagcgcccgcatttcgggctgcagccgaggcaggcgtag

SEQ ID NO: 7104 - DNA, 273 bp, Methylobacterium sp.
atgacgacacgacctcccagaagcggcgggccgacggggcgcaagcctcaggccggcaagttcagcaccagcaagttcaggggcggcaaggcccaggccgacggccgcgcccgcacgggcccgcgcaccagcgcccgcgacgccgccgagcgcgcagcccgcaaccgcggcgaggatgccggcacccgcgatccctggggcgcgcaggccgctgcggccccggcgccggcccggccgccgaagccgcgccgcgacgccgccacaccgcgcgat

SEQ ID NO: 7105 - DNA, 867 bp, Methylobacterium sp.
atgagcgccccccggttcgagccggtcaccggccgctatcttcacctcgaccttctcgggaagccgcatcggctctacgtcgaggaggcgggcgagggcatcccgctcctgtgcctgcacacggccggcagtgacggccgccagttccgggcgatcctcaacgatcccgagatcgcggcccgcttccgcgtcatcgccttcgacctaccctggcatggcaagtcctcgccgcccgctggctggcacgaggtgctggaataccgcctgacctcacgcgactacacggacatcgtcctcggcgtcgtgcaggcgcttggcctcgaccagcccgtggcgatgggttgctcgatcggcggccgcatcgtcctccaccttgcccttgagcaccccgacgcctttcgcgccgtgatcggcctgcaggcgggcgcccatgtcgatccctattacgacactcagtggctccaccgaccggacgtgcacggcgaggtcgcagccgccatcgtctccggactgatcggcccctcggcctccgatgctgatcgctgggagaccctctggcactacatgcagggcgggcccggcatcttcaaaggcgacctccacttctacaagatcgacggcgacatccgcgaccgcctgagcggcatcgacaccgcccgctgcccggtccacctgctgaccggcgagtacgattacagctgcaccccgcaggacacgctggacgccgccgcgcgcattcccggtgcccgcgcgacgatcatgccgggcatgggccatttcccgatgagcgaggatccggaaggcttcctcgtccacctccggccggtcctgtcccagatcctcgccgcagagagagatccccgatga

SEQ ID NO: 7106 - DNA, 933 bp, Methylobacterium sp.
gtgggcggccggcctgcgcagttcgggcgaggcgcccgcggcatgacggctcccctccgggtcggtggtcttaccatcgacgttctcaccgagatcgcccatcgctacatgcccgtaagcttcctgttcaacgatctgccggagccggacatcgcccgcaacatgtcctggctcggaccgcgcttcatcgagccgcgggagcggacgctgggcctcgccttccaagcctacgtccttcgggccggcggcctcaccattctcgtcgattcctgcaacggcgaggccaagcaccgtccgaccgcaccctggcagcacgatctgcgggcgaccgagttcctcggtaatctcgcgcgcctcgggctttgctgcgaggacatcgacatcgtggtgtgcacgcacctccactgcgatcacgtcggctggcacacccgcctgcggggcggtcgctgggtgccgacctttccccgggcgcgccacctgttcggccggcgggagttcgaccattttcgcgcgcgctacgaccgggaaggcgcggccgccgtcaatcacggcgccttcgcggacagcgtgctcccggtggtggaggcgggcctcgctgagttcgtcgatgaggaccaccggcttctcgccgacgagacgggcgagatcgccctcgtacccgcccctggccattccctcggccattgctgtgtccggctgcgggcgggtggcacagaggcgatcgtggcgggtgacgcgctccaccacccgatccagctcgacctccccgaccttcccatgcgggccgaccatgatcctggcctcgctgtcgcgacgcgccgttccctcctcgcgcactgcgccgacaccggggcgtggctctgcgccggccacatccccgactggtccatcgcgcagatccgccgcttcgaggaccgattccggatgggatag

SEQ ID NO: 7107 - DNA, 621 bp, Methylobacterium sp.
atgaccgcacagctccagcagcagcagatgcagctccagccgcccagcgacgccgcgcggctgttcgcggtcgagaaggacgtggcgagcctgaaggaaggtctctccgtcctcggcaccagcatggacaagggcttccgcgacctcgcgaccgagatgaaggcgcgctccacgatcaactggcagccgatcgcgatcctgctcggcgtcctgggctcgctcggcaccatgggcttcacctggatcaacaccggccagggccggctggagatggcgatcgccaaggtggagacggcctccatgcgctacgtcccgcgcgaggacctcgacgcgcgcttcaccgtcctgtcgcagcgccgtgacgatctccagcgcctgaccgatgcccgggtcgagcggatcgagcgcgacctcgacgcggcgtccaagcagatcgtcccgcgcggggagcacgagcagatgtgggccgcccagcgcgcccgcgatgcggatttgcagcgccaggccgatcagaaccggcagggcctctacgacctgaacaccccgcgcgacaccatccagggcatgcagcgccggatcgacgagctggagcgggatgcccgggcgccagcgcggcgctga

SEQ ID NO: 7108 - DNA, 153 bp, Methylobacterium sp.
atggcggaagtctgcatcgccaaccacgaacaaatcgttcggtacggctcccccgagatgcaggcagcctcgcgagcgctgctctatgtcctcgccgcagagatccagcgtcgcgagcaggccatgtccgccgcgaacaacgatgaggcttag

SEQ ID NO: 7109 - DNA, 369 bp, Methylobacterium sp.
atgaccctacgcggcgagaacctgatcggcgccgaggcgcggcgcggcaccgaggcggccttccgggccgtcgaggcggccaccggacaggccctggagccggatttccccggcgcgagccggagcgacctcgaccgggcctgcgcgctcgccgaggccgccttcgacaccttccgcgagaccgacccggaggcgcgggccggcttccttgaggcgatcgccgcgaacatcctggagatcggcgacgacctcgtcacccgctgcatggccgagacggggctgccccggccgcggatcgagggcgagcgcgcccggacggtcggccagctgcgcctgttcgccggcgtcgtccgcgagggcagctacgtc

SEQ ID NO: 7110 - DNA, 399 bp, Methylobacterium sp.
gtgaagctcaatcacatcaatctgaccagcctcaacgtgcccgccgatcgggcgatgttcgagacatacttcggccttcgctgctccatcatgcgcgggacggcgctcgccgtcctccatgacgatcaggacatggtcttggttctcaacgacttcgcccggaaacgcggcgcgttcgcctacccagaggattccgacgtgcatcacatcggcttcatccaggacagccgggagcaggtcgacgcgctgaacgcacgtctgagagccgatggctgggcagcgcccgagccgcgcgcgtaccacggggcctggacgttccacttcaaggccaagggcggctacttcatcgagattgcgacggcaacccagattcggcgcgcagagcccacaatcgcctag

SEQ ID NO: 7111 - DNA, 486 bp, Methylobacterium sp.
atgggccagcacaacccggcctcggtcgccgagctcctggccaagcgcggcagcctcgttgagatcgccacccgcgaccggatggcggccgaggaggtcggcaccaccaaccagccgatccacctgcgcgaactctaccggctcggcgtggtgatgacgccgaacatggagctgatcgacatctatcccgagggcaaccgtttcgtgggggtcctgcgcaacaccatgaccgacgccgaggaggagcgcctcgtcgaccgcatcgtggtggatcacgggacgctcccggtggacgggctctgtcacggcctcaaggccggctcggtaaatcgcggccagaatgaccagggagccctgctccgcggcgagccgcagcccttcgacctgtccggcggctacgccctccaccggatcggcgacgccctggccggccgcaacatccacgcggcgctctacgacgccctgcgtctgtgcaaggacatctga

SEQ ID NO: 7112 - DNA, 663 bp, Methylobacterium sp.
atgaacgtttcgaggatcagagacgcgatgcggtactgtgatctgccggatgtcctcgattattccatcgctgagcttcggctcggactggccttcatcgctctggacttgctggagctcaaggccggctttcggcaggaccagccgcgcggccgcgacggctgctggtgcggtgggagcggttcgctcgtcgtcgcgcggaaggacaagacgggggatccccggatcgacgggaaaaccgacgcgatcgtcgatgtcttgggcgaagtcgtccagacctgcgatcccggccagggccccctgtacggcatcgaggtacacacgaagttcgccgcacggatgcgggaactcgacctgcccggcatcgggcgacacggtatcgagcagagcttcagcgccggtgatctggtgcgctacggattggacggcagcatacgcacggacgtgatcctccgcgacggcaggaccagcgctgccccggttcgagcgatctgggatatcaagaccggcaaggcgcagttgacgccggctcgcgcgcgcgaactgcgcagaggtgtgggcgtggatgacagtgttcccgtcatagaggttcacttgagacgaggaaattcggtcaaaggcctttcaatatctgctattctattcggtgagaggttgccatga

SEQ ID NO: 7113 - DNA, 426 bp, Methylobacterium sp.
gtggccgggacgcccttcgacttccgcgagcccgcggtgatcggcgcgcggatccgcgacgggcgggacgcgcagatcgtgcgcgggcgcggctacgaccacaactgggtcgtgaccgacgcgcccacggccgagccgcaccccgtggcgcgggtcgaggatccggactcgggccgcgtcctcgatgtggcgagcaaccagcccggcctccagttctacgccggcaacttcctcaacgcgaccgcggtcggtaaatccggcctcgcctaccgccagtcggacgccctggcgctggagccggagctcttccccgacacgccgaaccagccggccttcggctcggcccggctcgatcccggcaagacctaccggaacgtgatcacctaccgcttctcgaccagccccgcccaccggacccagaaatga

SEQ ID NO: 7114 - DNA, 885 bp, Methylobacterium sp.
atgcagatcggattcatcggtctaggcagtatgggttcagccatggccatgaacttggtgaaggcaggccatgaggtgcgggcctggaaccgtagcaggatcgtccaggatcgcgttcacggaataacgttggtcccgctcgtggcggatgcattccaggccgacgcagtcttcacgatgctgtccgacgatcctgccattcgggaggtcatcctcgatgccggcgtgctcgcaagggcgcgaccggggctgactcatgtcatcacatcgacgatttccgtcgctttcgcgcgggaactggagttgctgcatgcaaaggcggccctcggctatgtgtcagcgccggtgctcgggcgaccgaacgtagcggcgcgcggccagctcaacatcctggcagctgggaaggccgatgcgattgacgcggttgagccgttgctcgcttcgatcagcaagaaggtttggaagttgggggaggatcctgcgcgcgcgaacgccgccaagatcgcctgcaacgcgatgattgccatggctatcgaggcgatggctgagggtgtcgtgttgaccgagagcgtcggcttggatcgcgcggtcttctttgaactcatcctgggcactcttttctcgggccgcgcctatgagagctacagcgcgcagatcacgaaccgatcattcgagcccggtttcaaatccaagctcgcgctcaaggacatgcgcttggcgatcgaggccggcaaccagatcgggcgcacgctcccgatgcttgaggctgtccacgagggactcaccagagctgtctcggcgggcctcggagagaaggactggtcgatcatggccgatatgacggttcgtaacatggcgatcgccgccgcttatagcgagcgctga

SEQ ID NO: 7115 - DNA, 1836 bp, Methylobacterium sp.
atgccctacgcggacatcgaggcgcacggcgtcatcggcaacctgcgcaccgccgcgctggtctgcagcgacggcaccatcgacttcttctgctttccccaattcgactcggcgagcgtgttcgcggccctgctcgacgacgccaagggcggccacttctccatcacgccggagccggacggagtgcgcacccggcagatgtacctgccggagaccaacgtgctcgtgacccgcttcatgagtgaggcgggcatggccgaggtcgtcgactacatgccgatctgcgcggacggaccgaagagtgccctcgtgcgccgcgtaaagggcatccggggcagcatgacgctgcgcgtggcctgcgagccccggttcgactatgcccgcgccgcctcgcgggctcgcctgcgcgacggcggcctgatcgagttcgcgccggaaggcgaagcggctccactgcgtctgcgcgcgaccgtgccgatgacggtgacgaagtcgggcgccgcgacgactgtgacgctcgcgcccagcgaggaggccggcttcgttttcgaatgcacccaggaacgcccgagcgatggcagcctcgacgccttcctggagagcaccttctcggagacgatggcgtactggcggtcctggagcgggcgctcacgctaccgcggccgctggcgcgagaccgtgcagcggtcagccctcgcgctcaaggtgctgacctccgccgaccacggcgcggtcctgggcgccgcgaccttcggcctacccgagtgggtcggcggcggccgcaactgggactaccgctactgctggatccgcgacgccgccttcacggtctacgcgctcatgcgcctgggctacaccgacgaagcgacggccttcattggttgggtcgagcagcgggcgcgcgagcagggcgagggcgaccggctccagatcctgtacgccctcgacggtggcagcgaggcgtcggaggaagagctcgaccacctcgcggggtatcgtggctctcggcccgtgcggatcggcaacgccgccgccgagcaactgcagctcgacatctacggcgagttggcggacgccatctacctcgcggacaaatacggcgtgccggccagcatcgacacctggcatggcgtggcgcgggccctcgactgggtctgcgagaactggaaccagccggacgagggcatctgggaggtgcgcggcggccgccaggcctttctgtccggacgcctaatgtgctgggttgcgctgaaccgggggctgcgcatggcgggacaactcgcccgcccggcgcccctccagcgctggcacgagacgcaggacgccatcgcccagagcatctacacggatttctggaaccccgagaagcgtgccttcgtgcagcatccgggcaccgacgccctcgacgcggcggcgctgctcatgccgttggtcaagttcatcagtcccgtcgacccccgatggctctcgacactcgacgccatcggccgggagttggtcagcgacgccctggtccttcgctatcagaccaaggagggcgccaatagcgacggcctggaaggacgggagggcgctttcacgccgtgctcgttttggtacgtcgaatgcctcgcccgggccgggcgtctggaggaggcacagctcaccttcgagaagatgctgggctacgccaaccacctcggcctctatgcagaggagcttggtcctcaaggcgagcatctcggcaacttcccgcaggccttcacccacttggcgctcatcagcgcggcctacgctctggaccgcgccctgtccgagaaggggcggccatcaatgggccaggacctccgcggctga

SEQ ID NO: 7116 - DNA, 621 bp, Methylobacterium sp.
atgatctcgttcgcgggatccgcgctcgggcgtgaccttcggaatttctacccagaagttgcattcgtcgatgaggcgtcgccgctgggccgcaccctccgccgcctttccgacgtcttggacgccgccgaaacgcgcgacgagcgccgcttcacgtcagacctggtcggggtggtgccggacctgcgccggtacgcgctgtccctgtcccgggatgcgaccgagagcgaggatctcgtgcagtacaccctgctcaaggcttgggagcatcgtaccagctaccggctcggcacgagcctgaaggcttggctcttcacgatccttcgcaacggccatctcaacggccggatgaagtaccgccgggaggtgcccgatcccgaaggctcctacgccgcgggactggcgagcctggccgatcaggaacaccggctcgacgtacaggacatgcaggaggcgctcgcccggctggaaccggcccagcgcgaggcgttgctcctcgtcgcggtcgaggatctgagctacgaggccgcggctgcgcggatcggctgcccgcccggcacggtgaagagccgtgtcagccgggcccgggacaggctcgctgccgagctcggggaagcctga

SEQ ID NO: 7117 - DNA, 1011 bp, Methylobacterium sp.
atgagagcgctgatctacaccggtccgaacgcgctcattgtcgacgacgtgccggttcccgtgccgggccccggcgaggtgctggtgcgggtcgaggcggtcggcatctgcggttcggacatgcacgcctttcacggtcacgatgcccggcgccccgccccgctgatcctcggccacgaggccgccggacgggtcgcggaggggccgcgggccggcgcccgcgtggcggtgaatccgctggtcacctgcggacgttgcccggcgtgcgaatccgggcgcacgcacttgtgcccgagccggcagatcctctcgatgcccccgcgccctggggccttcgcggactacgtctgcgtgcccgagaagagcctcgtaccgatcccggacgcgctgtcgaccacgcacgcggccctcgccgagccgctggccgtcgcctaccacgccgtcaaccagggggcgcggcttctcgggcgccctctcgcgggcgcgcggtgcgtggtgctgggcggcggcgcgatcggtttcgggtcgggtctggtcctggccatgcagggggcgggcgaggtcgtcatcatcgagccgaatcccgagcggcgctccgaagccgcgcgtggcctccccacggcccgctgccgggcgcccgacgatgccgagggtccaggtcccgacagcgctgacctgatcctcgatgccgtcggcagcgacgcgacacgggccaaagcgagccagctcgcccggccgggggcggtcatcgtgcacatcggactcctgcccggcgatcgggggctggacgttcgcaagatcacgctccaggaaatcgtggtctcgggcagctactgctacacgatgcaggagttccgcgacgtggtcggggccctcgcggatggccggctgggtcccctcgactgggtcgaggagcgctcgctcgccgcgggcgcggctgccttcgccgacatggatgcgagccgcgtcgctgcgccgaagctcatccttcgtccggacgctccggcttga

SEQ ID NO: 7118 - DNA, 1314 bp, Methylobacterium sp.
atgacgatcgactacgcgaagcgggcgacaaagacgcccgagaccgagaccgacgcggcgcggcaggtcgtgacggagatgctcgccgccatcgaggcgcggggcgaggaggcggtgcgggactatgcccgctcgctcgaccgctggaccggcgagatcgtcgtgacccccgaggagatcgcccggcgcacgaaggacatccccgagcgcgtcaaagaggacatcgccttcgcggcggggcaggtgcggcgcttcgccgaggcccagcgcgacagcgtccaagacttctcggtggagctggtgccgggcctcgtcaccggccagaagctcgtcccctgcaacgtcgcggggtgctacgtgcccaccgggcgctacgcccacattgcctcggcctacatgtcggtggccaccgccaaggcggcgggcgtcccgacggtcgtggcctgctcgacgcccttccgtggcgagggcattcacccctacgtgctctacgcgatgcaggtggccggcgccgacgtgatcatgacgctgggcggcgtccaggcgatcgccgcgatggccttcgggctgttcaccggcaagcccgccgacatcatcgtcgggccgggcaacaagttcgtggccgaggccaagcggatgctgttcggccgcgtcgggatcgacgtcttcgcgggtccctccgaggtcgggatcatcgccgacgagaccgccgacccggccctcgtggcctcggacctcgtcggccaggccgagcacgggcacgagagcccggcctggctgttcaccacctcgcgtgccctcgcggacgacgtgatcgcgcggatgccggcgctgatcgacgccctgccgcccacggcacgggacgccgccgccgccgcgtggcgcgactacggcgaggtggtggtgtgcgggagccgggaggagatcgtcgccgtctctgaccgctatgcgagcgagcatctggaggtccacgccgccgacctcgactggtggctcgcgcagctcagcaattacggctcgctgttcctcggcgaggagactacggtcgccttcggcgacaagacctccggtccgaaccacatcctcccgaccaagtacgccgcccggtattccgccgggctgtccgtgcacaagttcctgcggccgctgacgtggcagcgcatggaccgggaggcctgcaagaccatcgcccaggccacggcccggatctcgcgcctggagggcatggaggcccatgcccgcacggccgaccaccggctggcgaagtatttccccggccatggcctggatctcggcgaggcggtgaccgcatga

SEQ ID NO: 7119 - DNA, 1107 bp, Methylobacterium sp.
atgaccgagattcgaggcaacgggtgccggggcggccggcggcgggcatggctcctagccggcgccctggcgctggcgccggtggtcgcgccggccctcccggcgaaggccgcggagcccgagcggatcggcgtgtcctatcagccgtcgctctactgggcgctgcccttctacatcgccacgcagaagggctggtggaaggaggtcggcctggagccgaccttcgcggtcttcccggccggcgcgccccaggtcgccgccgcgcaggcggggtcctgggatgtcggcgggaccggttccgtgccggcgatcctcggcgcggcgcgcttcggcctgctgacgatcggcctcaccaacgacgagtcgaagaccaacgcactgatggtgcgcgccgcacggcacgacgcgatcctcaaggatcccaagcagctggccggacagaagctcctcgtcaccaccaactccaccgccgattacgccgcccgcgcctgcctccggaagtggggcctcggcccgcgcgagatgcgcttcgtcaacctcggacaggcgcagatcatctcggcgatgatcgccgacgcgggcgaggtggtcggcgtctgggccccgaacacctacacgctggaggagaaggccagcgcgcaggtcctgtgcagcggggccgacgccgacgccatggtgcccggctccctgatcacccgcgccgacttcgccaaggcgcatccggacgcggtcgccaagttcctcgccgtctatctccggggctggggctgggccaaggcgaatcccaaggacgcgcacgacatggccaagcgcttctacgccgagggcggcgtcgaggcgtccgaccacgccatcgaccaggaattcgcgctgcgcccgacctacgccctcgatgcgcagctcaaggcgatggcgcgcgcggacggcccctcgcaggtcgacggctggttctcgcggatcggcgcgttcatggccgaggtcggcacgatcgcgcaggcgcccgatgccaagggatacatcgacgacgccttcatgaagcgcgtcgcggccgatccgaagctccgggccttcgccacggagttcgacgcggccgccgccccgcgctga

SEQ ID NO: 7120 - DNA, 786 bp, Methylobacterium sp.
atgagcgcaatccggttcgagcgggtcgagaagagcttcggcagcaacgtcaaggcgctcgacggcgtcgacctcacggtggccgaccgcgagttcgtggccatcgtcggcgcctcgggttgcggcaagacgacctgcctgcgcctcgtggccgggttcgaggctccgaccggcggccggatcaccgtcggcggacagccggtcaccgagccggggcccgaccgcgctgtggtgttccagcagttcgcgctgttcccgtggaagaccgtcacgcagaacatcgcgttcgggctccgcaacaagggcatgcccgccgccgagcgccaggagcgggtcgccgcggcgatcgacatgatcggcctctcaagccacgccgacgcctacccgcaccagctctccggcggcatgcagcagcgcgtcgccatcgcccgcgcctacgtccttgagcccgaggtgctcctgatggacgagcccttcggcgccctcgacgcgcagacccgcgtggtgatgcaggaggagctggtccgcctcgcgcgcaggaacccgcgcaccgtcctgttcatcacccacggagtcgaggaggcggtctacctcgccgaccgggtcgcggtcatgaccaggcgcccggggcgcatcaaggagatgatcgacgtcaaggcggtccgcgaggccgaacgctgggaggagcacgcccgcatcgaggacgtgatggacctcgaatcgttcgtccacctgcggacgcacatctggaaatcgctgcgcgacgagaaggcggccggccggtga

SEQ ID NO: 7121 - DNA, 792 bp, Methylobacterium sp.
atgatcgcctcccgccagccgctcccgctgcgccgcagcctcgccctcggcgcgatcggcaccctggcctttctcggcttctgggccgccctgtcccgctccggcctcgtctcgccgctgttcctgccgggaccggtcgccgtggcggagcgcttcgcgaccctgaccgagcggcccttcgcggggggcacgctccccgcccatgtcgcctccagcctgcagcgattcctgatcggctacctgctcgccgccgcggtcggcgtgccgctcggcctgatgatggggtggtcgcgcctcctcgacgacatcgtcacgccgatcttcgacgggctgcgcttcatcgcgccgatcgcctgggtgcccttcgcggcgctctggttcggcaccgggatcggcggcccgatcctgatcatcttcgcgggcgcctttccgccctgcctgatcaacgcctatcgcggcgcccgctacgtcgacgcgcgcctgctggaggccgccgagatgctcggaacgccgggctatcggatgatcgccgaggtgctcctgcccgccgcgctgccctcgatcgtcgccggcctgcgcatcagcgcgggcctggggtggcaatccctggtcggtgccgagctgatcgtggcctcgacgggggtcggctacatgatggtgcaggcccagggcgccgtctcgaccgcgaccgtgatggtcggaatggtcgcgatcggcctcgtcggcgtggtcatcgacgtcgcgctgcgcgcgctcgagacccgcctccgccggcatcacggacaggcttga

SEQ ID NO: 7122 - DNA, 783 bp, Methylobacterium sp.
gtgaagttcagccgccgcatgtgcgtcggcatggcgacgctcgtcgtcatcgccgtcctctggtacgtcgcgaccaccggcctcggcctgatctcggcagggcggtttcccgcgcccggcgacgtggagacggcggctgtccaggccttcgtccggggctatcccgacacgacgctcctcacccacgtcctgcactcgctccggctcgtcgcgctgggcttcctcgtctcggtgacgctgggcgtcccgctcggcctgctgatgggctggaaccgtacggccgaggccctgatcaacccggtcttcctgctgctgcgcccgattccgcccctcgcctggatcccgctcgccatcctgtggctcggcctgggcgacggggccaaggtgatggtcatcgtcatcgcggcgctgcctccggcggtcatcagcacccaggccggcgtgcggggcgtgccgccgcagatcatcgaggcggcgcagatgcttggcaccccgcgactgcgcttcgtcacggacgtgctggcgccggcggcggcgccgatgatcttcacggggctgcggctggcgctccaggcgagctggaccaccctggtcgccgccgagctcgtcggctcgctcgcggggctcggctacgtcctgaacgtcgcccagcaggacctctacccgggcatgatcctcgtcggcatggcggctgtgggcatcctgggtgcgggaagcaccgcgcttctgggaatggccgagcgccgggcgatcggctgggcacagctgcggggagcggcatga

SEQ ID NO: 7123 - DNA, 405 bp, Methylobacterium sp.
atggatgtgactgtgaaccgccccgaggtcgtggccgagattaccgccctgttcgagcgctacgagcgggcgctcgtcgagaaggacgtcgccgtgctcgacgcgaccttctgggacagtcctcatacgatccgctacgccctccatgagaactgctacggctttgccgaagtccacgccgcacgcgttgcagccgatccgccgccgggcggggccaaggagacgcgaatccggctagagattctcacgcttgggaacgacttcgcaacggtcaatctggaattcaagccgcgcggcaaggccggcatcgggcgtcaaagtcagacttggatgcgcctacccgacagcggttggaaggtggtgtcagctcacgtgtcaatcatgccgcctgcggattgcatttag

SEQ ID NO: 7124 - DNA, 1617 bp, Methylobacterium sp.
atgagcgacgccgtcctcgagatcgagaagctcacgatcacgctgccgcccggcgcggatcggcccaatgccgtcgccgatctggatctcgtcctgcggcccggcgcggtcacatgcctgatcggcgagagcggatcgggcaagtcgatggtggcgcgcgcgatcctcgggctgctcccgggaccgcgcgtgcgcgtcgcgggcggacgcatccagttcgagggcgcggatctcgcggcgatcaccccgcgtcagatgcgcaaggtccggggtgcgcggatcgcgatgatcttccaggagccgatgacggccttgaacccgctccacacgatcgggcggcagatcgacgaggtcctgcgcatccacaccccgctcgggcgcgccgaccgccgggcgcgcatcctcgcgctcctcgcgagcgtccacctcccggatccgggccggctgctgcgctcctacccgcaccagctctcgggcggccagcgccagcgggcgatgatcgccatggcgctggcgctgaatccgcggctgctcatcgccgacgagccgaccacggcgctcgacgtcaccacgcaggcgcaaatcctccacctgatccgcgagctgcagcgcgagcacggcacgagcgtcctgttcatcacgcacgatttcggcgtcgtggccgatatcgccgacacggtcgcggtcttgcagaagggcgtcctggtcgagcaggggcccgcagcttcggtccttggggcgccgaagcacccctacacgcgcgccctcatcgccgccgtgccgaagctcgtgccgccgccgcggcgtgccgccagcaccgcccccctggtggtggaggcgagacaggtcgagaagacctacggtgcccgcggcctgttcggcggccgcatcacccgagccctcgacggcgtggacgttttgctgaggcggggcgagaccctgggcctcgtcggcgagagtggctcgggcaagagcacgctcgcacgggcgatcactcggttgatgcccgtcgatggcggcgagatcctgctggccggacacagcgtcgccgaactgacgcgccgtcagatgcgcccgcaccgccggcgcgtgcagatggtgttccaggatccctacggctccctcgatccgcgccagcgcgtggtcgacatcgtcgccgaggggccgatcatccacggcaccgaacccgggatcgcgcgggtccaggcctgcgagatgctggcgctggtcggcctcgatcccgcggcggcgcagcgctacccgcacgaattcagcggcggccagcgccagcggatcggcatcgcccgggctctcgccatgaagcccgagatcctggtggccgacgagccggtctcggccctggacgtctccgtgcaggcgcaggtcctggcgctgctcgccgacatcaaggcgcggctgcacctcagcatgctgttcgtgacccacgatctccgggtcgcgctgcaggtctgcgaccgcatcgccgtgatgcggtccgggcaggtggttgaggtcgcgccgacctccgagatcttcttcgcgccgaagcatccctacacgaaggcgctattcgccgccgtgcccggcgcccaatggcaggaaccgatccccgcatga

SEQ ID NO: 7125 - DNA, 411 bp, Methylobacterium sp.
atgcaggcaggatggagtgcgatcccgaacattatcatcgaaaagcaggcgactctcggcctcgatgcgctcgacatgaacattattttgcacctgacgcattactggtggcaccccgataacttgccacatccgtctgtcgagacgatcgccacggcgctcaacgtcaagccgcgcaccattcagaagcgtattaaggcccttgtcgagctcggactaatgacacgcgaggagcggcgccacaccaagaacggcagcacaaccaacctctatggcttccaagggctgatagaggcatgccgaccctacgcagaggagaagattgccgagatcgcgaaggcgaaggaggccaaacaggcgcgcctggtccgtaagaagccgcgcctcgtggtcgacaatgccgatgactga

SEQ ID NO: 7126 - DNA, 720 bp, Methylobacterium sp.
gcggccatcggcgtcgacctgacgagcggcgaggcgatcgcggccgacgtcgtggtgtccaacgccgattcggccgtgacgcacgcgcgcctgctgccggaggcgcagcgctggagcccgggacggttccagcgggcccgctcgtcgatgggactgttcgtctggtatttcggcaccaagcggcgctacccggcggtggatcaccacacgatcctgctcggcccccgataccgcggtctgctcaccgacatcttcgaccgcaaggtgctggccgaggacgcgagcctgtacctgcaccgtccgacagccaccgatccgagcctcgccccaccgggctgcgacgccttctacgtgctggccccggtgccgaacctcgccggcggccaggattggcagaccctcgccgaaccgtatcggcgccggatcgccgccctgctcgaggcgagcgtgatgcccggcctgtcggaggccatcgtgacctcgaaggtgacgacgccgctggatttccaggacgatttcctgagctaccggggctccgggttcggcctggagccggtgctgacgcaatcggcctggttccgtccgcacaaccggtcgagcgcagtccgcaacctctacctcgtgggggccggcacgcatccgggtgccggcctccccggggtgctgtcctccgcccgcatcctcgacagcgtggtccccgatgcccgcgttaccgcctga

SEQ ID NO: 7127 - DNA, 741 bp, Methylobacterium sp.
ttcttcaccaccaaggagatcggcaagggcaccggcctcgggctctcgacggtgttcggcatcgtcaagcagtccggcggcaccatcgacgtccagtcgaaggtcggggagggcaccgccttccgcatctacctgccgcgccacgtgccggtggcggagcccgaggaggtgccggccccggccgccgagccggcactgccgcgcgtggagccgctcgcgccggcttccaccgccgcccatcccgattccgggccggacgccaagccggtcaccgcgccggccgcgggcggcgacgccgttgtgccgaagggggagacgccgcccgccaaggtcgacaagccggcgccgcgcaagcccgccgccgaccatacggggcaggggaccatcctgctcgtcgaggacgaggacccggtgcgtgcagtcaacagccgggcgctctcggcccgcggctacacggtgctggaggcggcctcgggcctcgaggccctggcgatcgtccgcgagggcgcgcagaccatcgacctcgtcgtctccgacgtggtcatgcccgagatggacggcccgacgctcctgcgggaagtgcgcaagcatcagcccgacctgaaggtgatcttcgtgtccggctacgccgaggacgcgttccgcaagaacctgcccgagggcgagacgttcaacttcctgcccaagcccttcagcctgaagcagctcgtcgagaccgtgaagaagacgatggcggactga

SEQ ID NO: 7128 - DNA, 789 bp, Methylobacterium sp.
ttgacaaacggctcggtcgagggtccgcacgggcacctcaagcgggccatcgccgacgcgctcctgctgcgcaccagcaccgacttccccgacctgaccgcctaccgcaccttcgtcgacgagatcgtcggacgccgcaacgctcgccaggccaagcgcatcgacagcgagcgtgccgtcctggcgcgactgcccgagcggcgctcgtgcgactacgagcaggtcagcgtgcgcgtctcctcggccggcgggttccgcctgcgcaaggtgttctacaccgtaccctcgcgcctgatcggccacaccctgcgcgtgcgcctctacgatgaccgcctcgacgtcttcgtcggcggttctcacctcctcactttaccgcggggccgggctcatccggacggacggcacgatcaggtcgtcgactaccaccacgtcatccacgccctccggcgcaagccgatggcgctgctcaacctcgtctaccgcgaccggctcttcccgcgcgccccctaccggcacgccttcgaggccctgcgcgccgcgcttccggaacggcaggcctgccgcatcgccgtcgacttgctcgcgctggcccatgaccgcggctgcgaggccgagctcgccgaatgtctggccgtcgaactcgccgccaagctcctgcccgatctcgccaccctgcgcgcccgcttcgcacccgatccggctaccatccctcacgtcaccgtcgccctgggctcgctagcgagctacgagagccttctcgacagcgtcacgacgggaggggcggcatga

SEQ ID NO: 7129 - DNA, 309 bp, Methylobacterium sp.
ttgctcggcgcgatccaggcgctcatcgccgatctgccgacctacggctatcggcgcgtccatgcccttctgcgccggcaggccgagcgggacggtcggcctgcaccgaacgccaagcgggtctaccgggtcatgaaggtgcacggtctcctgctgcagcgacatgtgggcggagccgagacgcgccgtcacgagggcaaggtggcggtggccacgcgcaacacgcgctggtgctcggacgggctagagatcgcagcagagaacggtgagcgtgtgcgggtcgccttcgcgctcgattgctgcgatcgg

SEQ ID NO: 7130 - DNA, 312 bp, Methylobacterium sp.
atgacgggtacaattgtttcgctgcgctccggccgcagcacgacatcggctctcactcacttcgacatcacggcgatggaactgctgcgggagggtcgtgcaacgaccctgtcggaggcgcggctcgatgcgatccgggccgagcttctagccaagcgtgcggaactcgcagcggtgctcgccgatctacaggcgcggccgtcaagcggcgacgctcagatcgatgccgtcaacgcgaccttgcgcatcgaggcaggtatcggactttcccacatcgagctgttcatcaagcaggtcgaggtgtgcccataa

SEQ ID NO: 7131 - DNA, 174 bp, Methylobacterium sp.
atgcggttcgcggtttccatgatgcagggcctggtcaagggacccgcctcgcgtcggctctcccggagccgccgggcggccctggctgccctcgccgtcgcggggctcgccgctccggcccaggcgcagacgctggcgagcctgcccaccgaggccggcgcccgggtgcagggc

SEQ ID NO: 7132 - DNA, 174 bp, Methylobacterium sp.; identical to SEQ ID NO: 7131

SEQ ID NO: 7133 - DNA, 234 bp, Methylobacterium sp.
atgggcgacgacgatctccacgctccgtcgcgcgagaccggctacctctctgccttgcgcgacctcatgattgtccatcagcaatggattgaggatggctgcggcttcgagaatgtgcaggcccaccgacatgccatccgcttcctcggcggcctgatcgcaatgaagcaagcgcgcatggcaagccgggccaaggacccgaagtcggagcgaccgcggggctggtcatcctga

SEQ ID NO: 7134 - DNA, 1704 bp, Methylobacterium sp.
atggagatgttcgaggcattcggcttcagcgagcgcgtcctcaaggaggcgtactgggtcaacgaaacctgcttttggaaccccgatcccagccagtcgaacatgattacccgcactggccgcatcgtggatacggaggagggattgtccgagttcccgcacgtcatcatgaaccaggcgcgggtccacgacttcttcctcgcaacgatgcagaacgcgcccactcgcctggagccgagctacggacgcaacttcctcgatctggctctcaaggacgccgaaacgggcgacggcatcgagccatccagcgacttcgactatccggtcaacgtcaggcttgagcggatcgacgattcgcagacgtctgccgtcgagaccgtacgcgcgcgctacatcgtcgggtgcgatggggcccacagcgccgtgcgtggcgctgtgggccttacggtgcacggtgactccgccaatcaggcgtggggcgtcatggatgtacttgccgtgactgacttcccggacatccgtctgaagtccgccatccactccgccaaagagggcagcctcctaatcatcccgcgcgaaggtggttacctcgtgcgcatgtacatcgaactcgacaagctcgacgcgaatcggcgcctggcaagggacgcggtgactgtcgatcacctgatcgcggcggcgcggcgtatcctgcacccctacacgctggaggtgaaggaagtcccatggtggtcggtctacgagattgggcagaggctctgcgaagccttcgatgatggcggccttgcgcaccgtgaacatcgttcgccccggatcttcatcgctggcgatgcctgccacacgcacagcccgaaagcgggccagggcatgaatgtctcgatgcaggacgccttcaacctcggctggaaactcgccgccgtggtccgcgggcagtgtacaccgcagattctccagacctactcgatggagcgtcgcgccgtcgcccaggaactcatcgacttcgaccgtgcgttcgcccgcatgttcagcgccccgcccaggccatccgacgtgacgggcggcgacggcgtcgatccggccgagttcgagcggtacttcgtcaagcatggccgcttcaccgccggtaccgagacctgctatccgccgtccctcatcaccggccagtccacgcatcagaacctcgccgagggcttcaggatcgggacacgctttcattcggcgccggtgatccggctggccgatgctaagccacttcagctcggccacaccgtcaaggcagatggccgctggcgcttgttcctgttcgcggatccggagtcgcccgacgcgcgatcctcgcgattgcgcgccgtgtgcacgtacctggccgaagcggacgacgcgcccatccggcggttcacacccgcgggcgccgacatcgactccgtcatcgacgtgcgggcgatcctgcagcagggccaccggcagttcgttctaggagcgatgccaccgctgctgcgaccgccgaaggggcgttataacctcgtcgactgcgagaaggtcttctgcccggacccgaaggccggcgatatcttcgcactgcgcggcatttggcgggcggacggttgcatcgtcgtcgtgcggccggaccagcacgtcgcgcatgtgctgcccctggacgcccatgccgaactcgcggccttcttcgatcgattcatgctgtag

SEQ ID NO: 7135 - DNA, 486 bp, Methylobacterium sp.
gtggcggccttcgtcagccgccaagcggtggccgcggccgatctgcccggcctgatgcgcaccgtccgcgacggcctgctcgcgctgggcgatgcggccccgccgatcgtcgccgagccggagcccgaccgccccgccccgacgcccgcccagatccgcaagtccgtccacccggacaggctgatcagcttcatcaacggctgcgaatacaggacgctgaagcggcacctcacggcctacggtctgacaccggacagctaccgcgcacgcttcagcctgccccacgactatcccatggtcgtcgccggctatgctgcagagcactcggcgctcgcgaaggcgatcgggctaggcgtgcacggcgcccaggcggcgtggcaggcgagcagcagcatcgtcaacgacgccgagcacttataccggtcgagaaatgccgttttgggacgcgcaaagcttccggatcgacaaacgaggatgactccctaa

SEQ ID NO: 7136 - DNA, 288 bp, Methylobacterium sp.
atgaaattccgtccgctgcacgaccgcgtggtgctccgccgcatcgaaggcgaggagaagaccaagggcgggatcatcatccccgatacggtcaaggagaagccgcaggagggcgaggtcgtcgccgcgggaccgggcgtgcgcgatgaggccggcaagatcatcgcgcttgaggtgaaagccggcgatcgcgtcctgttcggcaagtggtccggcaccgaagtcaagatcgacggtctggacctcctgatcatgaaggaatccgacatcctgggcatcgtcgcctag

SEQ ID NO: 7137 - DNA, 942 bp, Methylobacterium sp.
atgagcgccgtcaacgtcatctgcggttcgcgtagggcctgcgtcctcaccgacgccagcctctacgactcggccgggacgatcgttgggttcgagctgaaggcctacgcggtcgagagttggaccggcgtcatcaccggccggggtaactggtggggcccgacctttgtccgagatctcgccgagagcttcggctcgttcgatgagttcatgtcgcggagcgcggctaccatcgagcgcgagcaccgcgaggcgatggagggcggccaactcgcaggccagacgcttatcgaggtgcacgccgtcggctggagcgagcgccgcgacgagcccgaggcctacgtgttgcggtcgccctcggccttcctcgacgcggacgagccgtcctacgtctggcgcagcctggaggacgaggacggcatcttccatcacgcgcacctcagcgcaggcgagctatggcagctgcaccggcagagcgccgaggagggcgtcgactggacggccgagaccttcgaccccgtgcgccacggtattccccttatggaggcgcagcgccggcaggccgccgacgcgatggcgggccccgatgttgccggcaagcacgtgatcggcggtgcgctgtggctcaccgtggtcgaccgcgagggcgtacggcaaggcatcatccggcaatggccggactcggcgggcgaagcgattctgcccgcatcgctcgatgagtcgagcttgccgaaggtgcccccgtccggcttcagcgcagcatggacgttcgaacggttcgaccgcgccgtgcgcgccggcgtgatcgatttcgccacgttcgacttcgatcccgccgccctggcgcgcctcgaggctgcagcgccaaccggggtcggcctgtcccgtcaacagcgccgcgccgcgaaggctcaagtccgtaagctggcaggtgcacgctga

SEQ ID NO: 7138 - DNA, 204 bp, Methylobacterium sp.
gtgcagggcatcatgcccgacgttgcggtgcacggccacccgatcgcgggccacgcatgtcgggacagcttgatcggcgaccgacgtcggtcgtcggtcgtcggatcgtcccggatcctggctgtcggtgccgagaacctcggccggggagcgatccgatcgaacgccgcctccaagcgcatctcgccgatcgtccggctgtag

SEQ ID NO: 7139 - DNA, 189 bp, Methylobacterium sp.
cgctcctcggccgtgacgctcaaggtcgaaggcctgtacgtcaacctcgaccgcaacacccgcaaccagggcgcgttcgtcatcaacgccgccaacaacttcccggtcgtctacagcggcatcggtcgccgttccgacgagttcgccgtcgtccgcgccggcctgaactacaagttcggctcctactga

SEQ ID NO: 7140 - DNA, 129 bp, Methylobacterium sp.
gtgacgagcggcgacgccttcataatgctgaccagcgtccggtactgcctgggccgccacagctacgcgccgagcgtaattacccaggcctgtgatggctgggttcaggcaccgatggttttgaggacg

SEQ ID NO: 7141 - DNA, 561 bp, Methylobacterium sp.
gtgtcctctgcgcacgacggcgatccgggtgtcggggctgttcagtcctgcgaccgtctcgcgagcgctccgtgggatccggatgcccccgacgcgcagcggaccgtcaacttccgggatctacgcgctggcgcggccgtagcggcgtgccgggcggcggttgccgaggccccgcggctgcggcggctccatttccagctcggccgcgcctacgaccggcagggcgcgaaccacgatgccttcgaggcctaccggcgcgcggccgaactgggcagcggtgcggccaaggtcaatatcggcatcctctaccagcagggtcgcaggttcgagaagagcgatgccaaggcgcgcgcttggttccgcaacgcggccgcgacgggcattccggaagggatgtactgctacgcggtcgccctcgacaacgggatcggcggttcccccgacgctgcggcggcccgggcctggtacgtgaaggccgccgagcgcggcaccgcgaaggcgcgggacgcgctcgtgcgtctcgaactcgacggcaccggcacgggtgtgcgctgtgattag

SEQ ID NO: 7142 - DNA, 189 bp, Methylobacterium sp.
gtgagcgcgccctctccccacgggtccggcggcccggccccgcggcgcatcctcgtcaccggggcggccggtttcgtgggcggccacgtcctgccgctcctggcgggggcgacggcggggtcgacggcggagtcggcggcgcgggcgggttggggtcggtcgggtcgaaggcggcgggctctcccgtga

SEQ ID NO: 7143 - DNA, 1074 bp, Methylobacterium sp.
atgccgttcgccctgccggacctgccgacggtccgccggaccaaccgggacaccttggcggccttcctggagggcgccgacgcgagcgtcccgaatagcgccctgcgcgtgctctcggacatgaacgccggcggcgcgttcctgaacctgaagtacctccagtggctcgccaagaacttcctgccggacctggcggagaagggctggctcgaccgctgggccagcatcctgttcggcggccggaaggccgcgaccttcgcctccggcaccgtcacggtcaccggcacgccgggggtgacgctcccggccggctcgatcctggcgacttcggacggcgtccagtaccagaccgccgtcgacgtcatcctatcggcggcgatcacacccgtcgcggtcacctgtctgaccgccggggcgatcggcaaccgggacaagggcgcgctgctctcgctcacggtcgcggtctccagcgtcaacgcgcaggcgaccgtcgtcctgatcgacggcggcgccgacaccgagagcgacgacgatctgcgcgtccggatcctgctgcggatccgcaacccgccgatgggcgggtgcgccaccgattacgagcagtggaccctgtccctgcccggcgtctcccgggtctgggtcgcgcctatggagatgggcatcggcaccgtcacggtgcgcttcgcctgcgacgtgctgcgggccggaaacgacggcctgccgacccccgacgactgcgcgctggcgaaagcctacctcgacacggtccggcccgtgacggtggcggacctgttcgtgctcgccgcgatcccgcaggggatcgtgccgcgcatcctcaacctgtcgaacgacacgccctcgacccggctcgcgatcgccgcggcgctccaggcgatgctcctggagaaggccgcgcccgggcagacgatcttcgcctgctggatctcggacgcgatcacggacgcggtcggtgatgccaccttcgacctcgtgaccggggacttcgtgatggccaacgccggctcgatcgcctcgctccggcagccgttcggcggcgggatcgccttcacatga

SEQ ID NO: 7144 - DNA, 711 bp, Methylobacterium sp.
atgagcgacgccttcatccggcgcgacggcgaggactacgcgcaagccttcgcgcgcctgctgccgaccggcgaggcgtggtcgcgcgatcccgccgcgacgctgatgcagctcgtgcgcggacaggccgagatctggggcgcggtcgtcgatccgcgcgcggccgacctcctggagatcgagaccgacccgcgcttcaccctggagctgctcacggattgggagcgggcctacggcctgccggatccgtgcgtgccggtggtgcagacgctgcccgagcgccgccagaggctcgcgcagaagatcgccatgcagggcggccagtcgagggcgttcttcaccggggtcgcggcctcgctcggctacgcgatcaccatcaccgagtacgtgcccttccagttcgggctgtcgtcgttcggcggcagccacgggcggctcaacccgccgggcttccggtactgctggtcggtcacggtcacgggcgcgcgcctcacgcgcttccagttcggcgtctcctcgttcgggcgcgatccgctcctgtcgatccgcagggccgaggacctggagtgcatcctcgggcggctcaagcctgcgcacacgctcctgcggttcaactacggcccgcccgccccgacggtgcgccagcagcgcttctccttcggcacctcgaccttcggcggcgatccgctcctgcgcctgatcgcgagctga

SEQ ID NO: 7145 - DNA, 297 bp, Methylobacterium sp.
atggcagaccggaagcagacctttacccctgagtttggtgctgaggcggtgcgattggcgcagacgagtgggcggtcgcgccgtgaggtcgccgccgatctcggcgtcgggctctcggcgctgcgcaactggattgacggtcgacgtgagcgggagatggacaacccaccgaccgaccggcaggaggacatggccgccgagctcaagcgtctgcgccgcgagaacgaggtgctgcgccaggagcgggaaatcctgaagcgggccacggcttttttcgccaaggagggaagtcgatga

SEQ ID NO: 7146 - DNA, 120 bp, Methylobacterium sp.
atgaggatcgcgatcatcacgccgtcgaggctcaaaccctcgaccctggccggaaaggccggccagtacttcctggagcacgcgatcgcgagcgccaacgcccaggagctcgaccggccg

SEQ ID NO: 7147 - DNA, 1932 bp, Methylobacterium sp.
atggcaaatacgatccggctcaagcggtcgaacaccgcgggcaacgcaccggcgtcgctcgccgacggcgaagtcgcaatccagcaggcggacggcgcgctcttctggcgcaatgcttcggccgccgtccagaagctcctgctcccgcgccgggctccggtcgcggatgccgcctaccccatcaagtccaccgatacttacatcggtatttcgtcgctgacggcggcgcgtgcgttcactctcccgctggcctcctcttaccccgccgggcatgtcctgaccgtcgtggacgagagccggctgtgcagctcgtccctgacgatcaccttcggcgtgaccggctcggacaagatcaacggcgcgacgaccttcgtcgtgagcgagccgggcttcttcctccggctcgtctcggacggcgcatcgaagtggtcgtccagcttcgtcggggccgcgtccaagaccgatctcgtcacgaagttggaccagaatttcggcaacgtcagcttccccggagcccgcaacacgctgggtctgcgcgagatcaacgcggccgatccgcagtacggcggcggcgtcgtcgcggactgcacgggcgtcggtgtcggcaccgacaacggcccgcgcctgcagctcgccatcaacgcctgggtcgcgtccggcgccggctccgtcctcaagatcccgcgcggacgctaccgcatcacgacgcccgtcatcgccaacctcggcggcctggccggtctggtgttcgatgccggcgatgcactcctgacgcccgaccccgtcgccatggtggcgatcagcatccgcaacgggttcgggctcaccatccgcgcccgcatcctcgagggcggccccttcggcggttggggggcgagcaatccctacggggtcgactattcctcgatcgccgatgccgtcgccggtggcggccaggaggcgatccgggtctcgggggtgagcggctacaccgtcgacctctgggcccagaactacgccggccggctcctgcgcatcacgaccgcggcgtccggcgacccgatgaccagtgccatcaagggccgcatcgtgacgacccgtggcaccgacctgagcaagccgcgcgtcgggcagtcgatcttcaccgacaatggcacgggcgaccccacgggagcttggggtcagctcgaggggctgcacaacgacttcgacgcgtacgggccggtctggcgggacgtgaacgatgtggcggtcacctatctcgacggtgcctacgcctacaccgggatcgccctgcacggggtcgggatcgtccacggggcgagctggtacatcggcgacatcgactcgaacgcgagcaacacccacctggactttgccccgtcgcccgccaccggccgcccgggctaccgcctctcgcttgcgcagctcacgatgctcaacgccggaaacggcctgaacatcagcggcacagacctgagccagcgcgcggccgacatcggcatcgcccgcatgatcggcgcaaccggcaccttcgggaacgcggtcaacatcgcgaacgccaagggtgtggccgcgcgcatcgaggcgagcggcgccggcggctccatcctggcgatcacgggcgcgggagctgacgatgtccgcctggacctgcatgcctccgggctgaacgggaacttcgcctacatcgcgtccgaggtggcggggcggatccagatcggcggcgccatgtcgaacccggtgccgggcaactcggtgctggtggtcggcggcaacacgccggtgcgcctgtccgatctcgatgtgtcgggtccgagcggcccatcgctcctgtacttcgtctcgcagacgaacaaggtccgctgggtgtccggatcaaagtctggcgccgcgacgacctacgcgggctatcagccggcctacgccgcgccggccgtcgacatccaataa

SEQ ID NO: 7148 - DNA, 1401 bp, Methylobacterium sp.
ttgcgcgagatcaacgccgcggatccgcagttcggcggtggcgtcgtcccggactgcacggacgtcggtgtcggcaccgacaacggcccgcgcctgcaactggccgtcaacgcttggatcgcggccggaccgggctctgtcctcaaggtgccgcgcgggcgctaccgcatcacgacgcccgtcatcgccaacctcggcggccgggtcggcatggtgctcgacgccggcgatgcgctgctgacgccggacccggtcgccatggtggcggtcagtatccacaacggcttcggcctcatcctccgcgcgcggctcctcgagggcggcccgttcgcgggctggggtgctagcagcccctatccggtcgattacggctcgatcgccgacgtcgtctccgggggcggccaggaggcgatccggatctctggggtgagcggctacaccgtcgacctcaccgcgcagaactacgccgggcggctcctgcgcatcacgaccgccgcggccggcgagccgatgaccagcggtatcaagggccgcatcgtcacgacgcgggccacggatctgagcaagccccgggtcgggcaatcaatcttcaccgacaacggcacgggcgtggcgaccggcgcttggggccagctcgacagcctgcacaacgacttcgacgcgttcggtccgatctggcgggacgtgaacgatgtcgcggtcacctatctcgatggcgcctacgcctacacgggggtcgggcttcatggggtcgggatcgtccacggggcgagctggtacatcggcgacgtcgactcgaacgcgagcaacacgcacctcgacttcgcgccgtcgcccgcgaccggccgcgccggctaccgcctcgcgctcggccagctcacgatgctcaacgccggcaacgggctgagcatcagcgacacggacccgagccagcgcgccgcggatatcgccctcgtccgcatggtgggggcgtcctccgcgttcgggaccgcgctcaaggtcgacaacgccaagggcgtgtccgcgcgcgtcgaggcgagcggcttgggtgacgcgatcgccgctgtggccggggcggacaccgacgatgttcgactcagcctgcacacccccggtctgggcgggaacttcgccaccatcgcgaccgaggtgacgggccgggtgcagatcggtggcgcgctggcaaacccggtgcccggccgctcggtgctgtacgtcggcggagacacgcccgtgcgcctgtccgatctcgatgtgtcgggcccgagcgggccgtcgctcctccacttcgcgagcgcgaccaacaaggtgcgctgggtgtcggggtcgaagtccggggctgccatgacctatgcggcttctcccccggcctacgtctcgccggccgtcgacctcccatag

SEQ ID NO: 7149 - DNA, 348 bp, Methylobacterium sp.
gtgcacggcgtgatcgccggcctccttaccggcgccccgaacttcgagaccggcgcggtcgagcaggcaaacgtcgagaagccgagcgcggcccagatccgcaagtcagttcgggatgagggcatcgtcagcttcatcgacggcaagacctacaagacgctgaagcgtcacctgactagccacggcttggatccgcgcagctatcgcgaccgttacggcctgccggctgactatcccatcgtggcaccgagttatgccgcgcagcgctctgagcttgccaaggcgatcggcttaggtcagctcggcgcgatggctgggcgcgggcggaagggcgataaggccgcctga

SEQ ID NO: 7150 - DNA, 372 bp, Methylobacterium sp.
gtgcacgccgtgatcgccggcctcgttgccggcgccccgaacaccgagaccggcgcggtcgagcaggcagacgtcgagaagccgagcgcggcccagatccgcaagtcggttcgggacgacggcatcgtcagcttcatcgacggcaagacctacaagacgctgaagcgccacctgaccagccacggcctggatccgcgcagctaccgcgaccgctacggtttgccggccgactatcctatcgtggcaccgaattatgccgcgcagcgctctgcgcttgccaaggcaatcggtctcggccgtcccggagcgatggctgcgcaggttgacgaaggggttcagcctgagcggaaaggccgacgcaaggccgcctga

SEQ ID NO: 7151 - DNA, 555 bp, Methylobacterium sp.
ctgaacttcaacgacaacggcttcgacgccgccgtgatcggcacgaacatgaacttcaaccgcaccaacaacaccggtgcgatcggagcagattggatcgctcatttcgtccagagcatcgggccgaagccgatcggcagcgcgctcacggccatcggcaagatgcgggtcggtatcgatctctcccacgccaacttcgacgccgacaagatggccctcgctctgccggccggggcgaggatctacggcaacgcctacaacaccgacacccactccatgccccggtacacgatgccgaacgtggactggatcgagcggagcccgagtgggttctggggtatttactacaacaacgcctcgaccatgcagttcaacgacgctcaggtcacgtcaatcccggtgttcttcgcctacggcggcatccgcgagcccagcaatccgccgccaaatagccagacgggatgcaccacgggcgatcgtgcttgggattcgaacttcgaatatcggtgcgtcgctgctaacacctggaggcgggctgagctgaagccgttctga

SEQ ID NO: 7152 - DNA, 555 bp, Methylobacterium sp.
ctgaacttcaacgacgacggatacgacgacgccgtgatcggcacgaacatgaacctcaatcgcaccaacaacaccggtgccatcggagcggattgggtcgcccacctggttcagagcatcgggcccaagccgatcggcagcgcattgtcggcagttggcggcatgcgggtcggtatcgacttcacccacgccaacttcgatgcggacaagatcgccctcgcgctgccggctggcgcgaggatctacggcaacgcctacaacaccgacacgcattcgatgccgcgcttcacggtgccggcgactgactggatcgagcggagcccgaatgggttctggggcgtcgcctacaacaacttgaccgcgcttcagataaacgacgtccaggtgactactctgccggtgatttatgcttccggcggcattcgtgagcccagcaatcccccgcctaatagccaaacgggatgcactccgggtgatcggacctgggatcagagctgggagtaccgttgcgttgcgtcgaatacctggaaacgagctgagctgaagccgttctag

SEQ ID NO: 7153 - DNA, 186 bp, Methylobacterium sp.
atgggcgacgagcgcgatccggtcctcgaggccgccgaagctctccgcgccgacggggtggaggtcgagccagcgggcgacgacttcacgctgtggatggtgaagggcaagctgctcaccaacttggacctgctcgccctggccgtgctcctcggccccatcgacgcgctgataggggtgcagtaa

SEQ ID NO: 7154 - DNA, 186 bp, Methylobacterium sp.
atggtcgagaagcgtgatccggtccttgaggccgtcgaagctctccgcgccgacggggtggaggtcgagccagcggacgacgactacacgctgtggacggtgagaggcaaggtgctcaccaacttggacctgctcgccctggccgtcctcctcggtcccatcgacacgctgataggggtgcaatag

SEQ ID NO: 7155 - DNA, 654 bp, Methylobacterium sp.
gtgcctactcccctggcggagggcaagggtctcattatcggatcggaggctctgatcaggtcgcacagcgtcttctatgagggctcgatgttcggcgataagctcgtgaccggccacaaggttattgtccgtgagcttacaagagccggtgccagctttcaaatcggcacgcttggtgacatccaagggcactgttgcgttggcgactacgtccggtttcaaagcaacgtttttatcggcaagggagccacgatcgaggattgcgtctggatctttcctcacgtcgttttgacgaacgatccacatccgcccagcgatatacaactgggcgttaccgtgcgtaagtacgcggcgctcagcaccatgagtgtaatcctgccgggcgtcaccgtcggtgtaggcgccttggtcggcgcgtcgagttgcgtcaccaaggacgtcgaggattaccgcatcgccgtgggaaacccggctcgggataaagggccggtctggcgtatcaagcttagggatggcagcgggcagcctgcttacccatggatatcacactttcagcgcggctaccccgagcacttggtgcgggagtggcaggacctcctcaatggctcttgggaaaggctccggcccaacgatatggaaggttcgcctacctaa

SEQ ID NO: 7156 - DNA, 633 bp, Methylobacterium sp.
ttggccgagggaaagggcctgacaatcggagcgaatgccctgatccggtcgcacagtgtcttctacgagggctcaacgttcggggataaactcgtcaccgggcacagggttacggttcgcgaactcaccaaggccggtgccaacctccaaatcggcacgctgtgtgacatccagggtcactgcacgattggcgactacgtccgttttcacagcaacgtgcatatctgccatggggcaaccgtcgaggattgcgtctggatttttccctacgtcgtcctgacgaacgatcctcatcctccgagcgaactcaccttggggcctacggttcggaagtacgctgcgattgccaccatgagcgtcgttctcccgggtgtgacggtcggcacaggggcgctcgtcggcgcgtcgagctgcgtgacgaaggacgtcgcggattaccgcatcgcttcaggcaatccggcgcaggacaagggaccggtctggcggatcaagcttcgggatggcagcggtcagccggcctacccttggatatcgcacttccggcgcggctatcccgagcacttggtcaaggagtgggaagacctgctggatggcccacagatggtgctggggccggatgagatgagagactag

SEQ ID NO: 7157 - DNA, 486 bp, Methylobacterium sp.
atgccgaatcgagtccagtcggccttccgcgcggccgccgaggtcggcgtcggcctggtggcggcctgcaaccggctgcggctgcccagggcggcgaatcccttcgtcgtcggtgtccacgcgccgatgcgcgcggagctgacgctggaggacctgcccgtcaccgggacgatcccgcccggcctcgacggcctctatctcaagatgggggcgaaccccgtccgcgcggcgacgcggggccacgactggttcctcggcgacggcatggtgcacggtctcgcgctcgagggcggcagggcgctgtggtatcgcaaccgctggatcggctcgcgcacggccgccgcggcgctcgggcggcccgcggcgcccgggccgcggcggggcggcaacgacaccgtcaacaccaacgtcgtcgcgatcggcggccggatcttcgcggtggtggaggcgggcagcttcccggtcgaactctcgcccaccctggag

SEQ ID NO: 7158 - DNA, 486 bp, Methylobacterium sp.; identical to SEQ ID NO: 7157

SEQ ID NO: 7159 - DNA, 333 bp, Methylobacterium sp.
atgcgccgcctcgcgctgctgaccacgctcgccctgctgccggccgcggccatggctcaggactacgatccgtccaaggcgaccaagtatgcctcgccgcccatgtaccggccgaaggtcaatcagttgatcctgaagggcacgggtggcgtggtctgcgacaacccggccggctgcgatgcctcgaccctcagcgtcactctgccgagcggggcgaagctgaccctgccggacgccttcgcggcgaagatgtcgtcgatcaacgtggccgccgcgccgtcctcggccggcaattggggcagcgtcgacacggcgttcaccggcgacacctcc

SEQ ID NO: 7160 - DNA, 231 bp, Methylobacterium sp.
atgtaccgcccgaatgtcgaccggctcatcgttcgcggcgctggcggcatcgtctgcgacaacccggacggctgcgatgcgtccacgctcagcgtcactctgccgagcgggtcgaagctcaccctgccgaacgccttcgcggcgaagctgtcctcgatcaacgtggccgccccgccatcctcggccggcaattggggcagcgtcgacacggcgttcaccggcgacacctcc

SEQ ID NO: 7161 - DNA, 174 bp, Methylobacterium sp.
atgacgatcttccaggtacggcaggcgcgcagtcgcgcgatcgtctggactggcgaggccgaatcggctgaccgggcgctggaagcggcggcgcagtcggccggctatcataccttcgctgagatgccggatgccctccggaccgacatggccgtggaggctgtgaccgtctga

SEQ ID NO: 7162 - DNA, 174 bp, Methylobacterium sp.
atgacgatcttccaggtgcggcagacgcacagtcgcgcgatcgtctggactggcgaagccgccacggctgatcgtgcgttggaagcggcggctcaggctgccggctaccacaccttcgccgagatgcccgacggtcttcggagcggcatggctgccgaggccgtgaaggtctga

SEQ ID NO: 7163 - DNA, 255 bp, Methylobacterium sp.
atgatggacgagcgtcaagcactgactgccttcgccgccctgtcccaggagacccggctgcagatcgtgcggctgctcgtccaggccggaccagaaggcatggcctccggagttctggggagcgagctgggcgtgtcagcctccaccgtctccttccacttgaaggagctggaccacgccggtctgatccaggcgcggcgcgagggccggtcgatcatctacagcgcggcctacccggcgctctcgggcctcatc

SEQ ID NO: 7164 - DNA, 255 bp, Methylobacterium sp.
atgatggacgagcgtcaagcactgactgccttcgccgctctggcccaggagacccggctgcagatcgtgcggctgctggtccaggccggaccagaaggcatggcctccggagttctggggagcgagctgggagtgtccgcctccaccgtgtccttccacctgaaggagctggaccacgccggtctgatccaggcgcggcgcgagggccggtcgatcatctacagcgcggcctacccggcgctctcgggcctcatc

SEQ ID NO: 7165 - DNA, 114 bp, Methylobacterium sp.
atcgaggtgccggtgatgctgaccgtggtctggatcgtgaaccggagccagggctggtacgagcgcggcgccactcggaatgcggcgctcaagaccatctcccgtgaggtctga

SEQ ID NO: 7166 - DNA, 114 bp, Methylobacterium sp.
atcgaggtgccggtgatgctgaccgtggtctggatcgtgaaccggagccagggttggtacgagcgcggcgccacccggaacgcggcgctcaagaccatctcccgtgaggtctga

SEQ ID NO: 7167 - DNA, 282 bp, Methylobacterium sp.
gtgaggtctgaggcggtcggtcggagccgcctgacgatcatcagcgccctgggcgtagtcgagatcctcacctggggctcgtcgttctacctgccggccgtgctcgccgggccggtcgcgcaggacactggctggccgctggcctgggtggtcggtggcttgaccctcggcctgctcgtcgccgcgctcgcctcgcctcacgtcggtacggtgattgagcgccacggcggacggccggtgctggccctggcggcgctcctcctctcggccggcctcgtggtg

SEQ ID NO: 7168 - DNA, 282 bp, Methylobacterium sp.
gtgaggtctgacccgggcggtcggagccgcctgacgatcatcagcgctctgggtgtcgtcgagatcctcgcctggggctcgtccttctacctgccggccgtgctcgccgggccggttgcgcaggacaccggctggccgctggcttgggtagtcggtggcctgaccctcggcctgctcgtcgccgcgctcgcctcacctcacgtcggcacggtgatcgagcgccatgggggacggccggtgctggccctggcggcgctcctcctcgcggctggcctcgtggtg

SEQ ID NO: 7169 - DNA, 138 bp, Methylobacterium sp.
atgtcgacgtttgaacgctacctcaccgtctgggtggccctctgcatcgtagccggcgtggcactcgggcacgtcatgccgggcatcttccaggcgatcggctcggccgaggtcgcccaggtgaacctgccggtggcg

SEQ ID NO: 7170 - DNA, 138 bp, Methylobacterium sp.
atgtcgacgtttgaacgctatctcaccgtctgggtggccctctgcatcgtggccggcgtggcgctcgggcacgtcctgccgggcgtcttccaggcgatcggctcggccgaggtcgcccaggtcaacctgccggtggcg

SEQ ID NO: 7171 - DNA, 558 bp, Methylobacterium sp.
atgccccaccccgagatccagcctgccagccgccgcgagtggtggccggagaccttcatcgacgaggtctcgcccgacggccgcgccacgccgagcgactggctcatccgcctggagggcggcgggtacgcctatggcgatccgacagacaggctcgcgcccccgaaggctgtacgggaaggtgacgtcgtcgaattcagtttccgcgactatctcggctcatcgctgatgaccctcgacgcggacggcgagccggtctggaccccgcctctgccccagggcgtcaacctgttctgggacgggcacgactcggacacgatctgcgacaccgagggggccttcgccgagttcgtgaaggaatacggcgagcatcaggactcgcaggtcacggtgctctgccactggtccgagcgcacgcttcgctgccagttcacggcggccggcggcgtcctgcgcttcctcccgatcgacgacccgcctcctccccctgtcatgcccgtcgaagctccggtgcagccgagccacgacgacctgttctctgccgccccaaccgcctga

SEQ ID NO: 7172 - DNA, 543 bp, Methylobacterium sp.
atggctgagaacctgatccccgccatcgatggtcggcaatggtggccgtccgactgcctcgacgagatcatgccggagggacgagcgactcccgactcgtggctgttccggctcgctgacggcacgcaccgctgcggcgaggagggcgagaccgagcacccggtgtgctccgtctccgagggtgacgttgtcgagttcatcgcgagcgacaacctcggtcgtgctcgcatgacggtcgaggatgatgggtccgtgcgttgggagccgcggccgccggacgactcgcacatcttcgacgccgacgacttcgagatgagcggcgacgggccggacgacttcgtgcggaatctgcgctcgttcaacgacctcgacccgggcgagagcgtcgaggtctacgtcaccaggtggagcgctgccgtccagtgccgcttcaccgctgaaggtgggccgccacgcttcgtaccgctgagcgaccctccgccggcgccagagaagccgctcgcgccgcccgcacctcccgagccgcacccgacccttctctga

SEQ ID NO: 7173 - DNA, 1593 bp, Methylobacterium sp.
atggatcgggtcatcgtctacccgaacgcgcttccgcgcgcgctcgacgtcctgcgcaccaaccagttcgccatggtgggtctcggcgggatcgcccaggccacgctcggcacctcgacgatcgtcgacggctttacgctcaccccgaccagcccggcctcgctgtcgtgcaacctcgggccgggccagatctaccagatcgacagccttgaggagaccgcgatctcgtccctgccgtcggacgggacgcgcatcgtcaagcagggcctcctgaaggcgaccacgctgattaccttcgcgccgcagctcggcgtcgggcagtcggcctgctacctggtccaggcccagtacgacgacgcggacaccggcgaccaggtcctcaacttctacaacgccgccaacccggccgtgccgctggcgggcgtcgacggcaacggccagtccagcaagacgatccggtccggcgccgtcgccctggcggtcaagcccggcatcccgacgaacggcgtcccgaccgcgccgacccccgatgcgggctacgtcggcctgttcgtggtcacgatcgcctacaaccagacccagatcctcgccggcaacatcgcgacgtacgcgtatgcgccgacgatcctggacaagctcccggcgatcccgtcggcgctccagtccaacaagtacgtctacgtgaaggacgtcggcgcggtgaacgcgctctcggtcaacccggtgccggcctacacggcctaccaggaaggccaggagctggtcgtcgtcccgaacttcaccaacacgtcgacgacggtgacgctgtcggtgagcggccttcccgccgcggcgatcggcctggcgaacggatcgaacccggcggtcggcgacatcatccagggccggccgctgcggctgcgccgaagcggtaccggcttctggaacttcaccgggcccgcaccgagcgaggccggaccggccgcagcccagcaggcggccgcagccgctacgcagggcctcaagaccccgccgtactacaacctcgtgcccggcacctactcggtggtcgtcccggccggcgtcacgagctgcgactcggagctctggggcggcggcggcggtggcggcggcgtcggcgcggtcaacaacggctccggctcggccggcggcggtggcggctactcgttcaagaccatcaccggcctgacccccgggcagaccatcacgctggtcatcggcggggccgggaccaagggcggcgcgggcggtgctggcggcaacggcgggacgacgaccctcggcgcgtatcacagcgcgagcggcggcgcgggcggctcgcccaacggcatcggaaacggcggcgtcggcggcctcgggtccggcggcgatatcaacatcggcggcggctacggctcggccggtgcctcgacgggcgtgagcctcggcggcgcgggcggctccgccccgttcggcggccagggcggcggcggcgcgccgggcatcgcgggcgacggcacgatgccgggcggtgccggcggcggctccggctcgaccacgatcaacccgggcggcgcaggcgcgccgggcggctgcatcatccactggaagtga

SEQ ID NO: 7174 - DNA, 456 bp, Methylobacterium sp.
ggctcggccggcggcggtggcggctactcgttcaagaccatcaccggcctgacccccgggcagaccatcacgctcgtgatcggcgtcgccggcacgaaaggcgccgcaggcggtgccggcagctctggcggcacgaccacgctcggcgccttccacagcgcgaccggcggcgcgggcggctcgcaaaacggcatcggcacgggcggcgtcggcggcaccgggtctggcggcgatatcaacatcggcggcggctacggctcggccggtgcctcgaccggtgtcagcctcggcggcgcgggcggcagcgccccgttcggcggccagggcggcggcggcgcgccgggcatcgcgggcgacggcaccgtccccggcggcgccggcggcgggtccggctcgaccaccgtcaaccccggcggcgcgggcgcgccgggtggctgcatcctccgttggaagtga

SEQ ID NO: 7175 - DNA, 633 bp, Methylobacterium sp.
atgaccgcaatcctctccttgccgctcctccaggtcgcgttcgagaccgcgaccaacgaggactggcgagacggtctcgccttcgcgacggccggggaggccgttggctacgccgcgcccggcaataccggcaccggcacgatcactgatctcgccgtttcagccggcgcctacatcggcgactacgtggtcacgatggcgagccccacggctttccgggtcacggacccggatggctacacgctcggcgcgggcgcgctgggcgtgccgttctcgcgatccggggtcagcttcaccgtcacggccggcgcgtcgggcttcgcggcccgcgacaccctgatcgtctcggtgttgccggcgccgatcgacatcaccggcatcgccttccggatgcaggtgcgcacggccgccggcaacgagtcggtcaagctggacgtgtcgacggaggcgagcaccatcgtcaacggcggtgccacgggcgttctcggcatcgcggttccgggtgagcggatggctcgcatgaagccggccgcgctcgtgttcgacatcgtcgcgatcgccgacgggctggagcgaagggtcgcgaccggcaccatcaaccacgtcccgggcgtgacccggctcatcgcctga

SEQ ID NO: 7176 - DNA, 675 bp, Methylobacterium sp.
gtgtcgaacctcgccctgatccagccgcagccggtcgacttcgacacaacgcaggcgaccgactggctcgatggcctgccgatgatcggcacgcccggcgtgatcggtacgctggcgagcccgtccaacatcggaagcgccggcctcgtcgtatcggccgcgcccggggccgccctcggcgtccacaaggtcaccgtcgcggcgctcgtgaacgggctgatcgacctgaccgtctccgatccgtcggcgacgatcaccgggtttgggattgccggcctgcccttctatgccggtggcctcaccatcaacctgtcccaggttaccgggggcgctgcgcttgcgatcggcgacagcttcgcgatcgcggtcgtgccggtcgcgatcgacctcacgggcctgcgcttcgatctcgatgcccgcgcctccataggagatccgtcgatcgcgctccaggccacgagcgatggcccgaaccccacgatcgccaacggcggcccgctcggcgtgatcgccatggcggtggcgcgggcgagcatggcccggctgccggtgaagcccgagggctacccctacggcatcaccgcgtccgaccctgtctccggcctaacggtcccggtcttctacggcctcatccaccacaccgcggtgcccgctcagatcggacagggagcctga

SEQ ID NO: 7177 - DNA, 207 bp, Methylobacterium sp.
atgatcgtcgcgttgttgctgaccgctgccggcgtgatcgtcggcatgccgatcgtcctatacgggttcatacgcctcgacgagcgacccggacgcgcgagttggctgatcctgctgctgggtctcgtcatcatcgtcgcccccgtgaccaccgccctggtcctgcatcaggaagagagcggggctgggcgctacgtcggccggtag

SEQ ID NO: 7178 - DNA, 207 bp, Methylobacterium sp.
atgatcgtcgcattgttgctgagcgctgcgggcgtgatcgtcggcatgccgatcgtcctctacaggttcatacgcctcgacgagcgacccggacgcgcgagttggctgatcctgctgctgggcctcgtcatcatcgtcgcccccgtgaccaccgctctggtcctgcatcaggaaaagagcggggctggccgctacgtcggccggtag

SEQ ID NO: 7179 - DNA, 963 bp, Methylobacterium sp.
atgcaggcgggcggtatgacgaacgggggcaagaccgtggacacgcagatcgcggacgcactgcgcgaggcgctgatgtgcagtgtcttcatcagcccgtcagaccctggcctcacctacgaggagttgcaggaagtcggccgtcgcgcgggctacagggacggcgaggtgaacgacgcgcttcgccaagtggcgaacaactacaccggccgcgaccgctacgtccccgaggagaacaccttcatccatggtctgacctggatgccggacaatccggagctgcgcgacttcgatgccttcgacttcgtcgtgaaagctttgaacgagcgcatccgggacatcgggatccgggaagcgcggatcgaccgtggggtagtggtcgagcaggcggtgagttctggcctggaccgcgtcgccgtcgaagcggccatcacgtacatggtgtttggaaatttgctcgccgagagcaacggcagcctccgcacgacccaggtcatggggaccatggtggtgcccggagaccgctggcgcgagtggaagcgcggtagggatgtcgcctggccacggccacaccgagcgcgaatgcgcccgatcgtgagcgacgtcatcgggcgacgaaccaatgggcgtccgagccacgcagagccgctggccgccttcccagatgctctggatcgcctcggtttccggaccttcaaggtgtggtggacgcagatcgccagggagatgctgacgagcgatccgagttcggccgcaacggcacggatcgtcctcgcggcagcgctcgttgaaggggtactgaccttcgtggtgcagcatgccaggtccaaggggttggcggtgtttcaatcgtccgacttccagaggaccccggagcactggaagattgtcgacctcatcaggagcgctgcgaccggcgggaaggacgcggtcctgacgcaggatgccaaggtgcgggcagaa

SEQ ID NO: 7180 - DNA, 963 bp, Methylobacterium sp.
atgcagccgggcggtatgacgaacgggagcgagatcgtggacacgcagatcgcggatgcactgcgcgaggcgctgatgtgcagcgtcttcatcagcccgtcagatcctggtctcacctacgacgagttacaggagatcggccgccgcgcgggctacagggacggggaggtgaacgacgcgctccgccaagtggcgaacaactacaccggccgcgaccgctacatccccgaggagaacaccttcatccacggtgcaacctggatgccggacaatcccgagctgcgcaatttcgatgctttcgacttcgtcgtgaaggctctgaacgagcgcatccgggacgttggaatccgggaagcgcgaatggaccatggagtagtggtcgagcaagcggtgagctctggccttgaccgtaccgctgtcgaagcggccatcacctacatggtgttcggaaatctcctcgctgagagcaatggcagccttcgcacgacgcaggtcatggggaccatggtggtgcccggggatcgctggcgagagtggaagcgcggtcgggatgtctcctggccacggccacaccgagcgcgaatgcacccgatcgtgagcgacgtcatcggtcgacggaccgatgggcgtccgagccacgcagaaccactggccgctttccctgatgctctggatcgcctcggcttccgaaccttcaaggtgtggtggacacagaccgccagggagatgctgacgagcgatccgagttcggccgcgacggcacggatcgtcctcgcggcagccctcgtcgaaggggcactgaccttcgtggtgcagcatgccaggtccagggggttggcggtgttccaatcatccgacttccagaggaccccagagcactggaagatcgtcgacctcatcaagagcgcggcgaccggcgggaaggacgcggtcctgacgcaggatgccaaggtgcgggcagaa

SEQ ID NO: 7181 - DNA, 336 bp, Methylobacterium sp.
atgaagaacctgaggcagcaccctgacggcagcggagggatgtatctcaactggacgaaggagcagctcgtcgaagcgctgcaggatcgcatccagcggaaggacaaggtgccaaatggcggcccctacgagcgctacttcctggtcatcatcacggacgagttcatgctgaccagcgacgtggtgagcgcctatctggaagcgaccgtgttccgagtggagctgatcaccgacgtcattctcggactgtcctacgagcccagtccgaccccgaacgaccgcgcggggaccaccccaacctttcgtctccctctcgcggctcgagagaggcgctga

SEQ ID NO: 7182 - DNA, 336 bp, Methylobacterium sp.
aaggcctccatgaagaacttgaggcagcaccctgacggcagcggagggatgtacctcaactggacgaaggagcagctcgtcgaagccctgcaggatcgcatccggcggaaggacaaagtgccgaacggtggcccctacaagcggtacttcctggtcatcgtcacggacgagttcgtgctgaccagcgacgtggtgcgcacctacttggaagcggctgtgttccgagcggagctgatcaccgacgtcgttctcgggttgtcctacgagcccagcccgaccccgagtgactgcccggggtccaacccgatctttcgtctccctctcgccgctcggtaa

SEQ ID NO: 7183 - DNA, 495 bp, Methylobacterium sp.
atgatccggtccgccctccgacctttctggtgggcgtactgggcgtgcgtggcgctgttcatgctcggcaccgtggccggcgccgtcggcccgagcgtgcaggcgagggtcgcgccgatccacgaggacatgcaggcggtgtcgatcgcccggacgcccgagcggatgtgctgggactacacaagccggaagctccgtgaggcggcgaccgacgatctcgacacgttcctgtacgtggccgggcacgaccgcatggtggtcgcgccagtcggcgaggtcgacggcatgccctggcgcgcgagccgggcgcccgggatcggcccgtaccgcaagcgctggtgcatcgacttgccgcccggcgtgccggtcggtgagccgatccgcttcgagctgacggcctactaccgcggcccctggggcctgtggcgcatgccgctcgcctggccgcctgtcggcgccaaggggctgcccgggacccggacaaccacaccctga

SEQ ID NO: 7184 - DNA, 1089 bp, Methylobacterium sp.
atgactgccgttgtcgcatccgccccggcgcccgcgcggcgccgcctggaggtcaacctgccggacgcccacattggcctctggcagaaggaccccaacgacccgacgctccggaccgagatctacgagggattgctgggccacctgaagcgccgcgggtttaagatcaccgcggttccgcgggtggcgaagcaccaccgctgcatcagcccgctctaccgcctcgcggcccggggcgacctccgcgccgagatccacgtcagcggatgcgtcgtgcagctcgactggtggtcggaggcggcgcccgagggaaacaagagcggccgccagtacgacttcggtcgccgccggcgcatgccctacctcgacggcctccggttcgagctggaggtgcgccatctgctggcctgggtggccgagcgggcggacatcgtcacgcgcccccagcaccgcggtgatcgccgggtcgggatcggccgaggtgaggtgtccgccgccgagtacatcgaggcggcgtacgcgacgagctggcacaccgacaaagacctgggccggccgaagtgctcggactcgaaccggaaatccgccgacggcgacctgatcgagcaggagtcgcgcgtgtggttccgcgactggcacgggcgcatgctcaccggcatcgcgtactacagcctcaacaaccgctggatgatcgtcacgagcgcccacagcatgtcgtgggcgagcgcatacgagatcttcacgcgctgcccgcccgacctgcggaggaagcgcaacgaacgccagcggcgcaagcgcctcgagggcgagctggcgaaggcgatccagcggatggacttccggcgggccgagacggtgcggaagatcctgttcggcaccgagttgacctatggcatctaccacgtggagcacgacgcgctctatgggccaggcttctccggctacacgaaggaccggctggaggccggccgcttcacctggaacgaggccgcacgcgaggtgcgcggccacccggatctgctgcgcctggtccttccggacggaaagcacctgcctgcatccgaactcggccaggcgaaggcggcgtga

SEQ ID NO: 7185 - DNA, 1440 bp, Methylobacterium sp.
atgaacgctcgccgaagcaacaagcttaccccgctggaggaagagctgctggacctgcgcgaccgcgtccaggaactgcaggacgcgctgcgcgagcgagacaaggcgttcgcccccgagatccgcatcccggccgaatggggcctgtcccgcgccgaggccgtgaccttctcggcgctgatgaacgcggtgggcaagacggtgcgccgcgccggcctccttctcgtctgcctgccgagctacaccgtcccgtccgacgaggtcctggacaagaccgtcgccagcttgcgcaagaaggtgacgccgcacggctacaccatcacgtcggtcatgggcgtcggctacagtatcacggccccggccgacccggctgaagtcccccagcccgcggcggccgccgtcgccgcgcccgcgccgcgcaagcgcccggccggaccgaacgcctactccgaggcggaggacgccatcatccgggccggcgtcgaggccgggaagctcctgcccgcgatccgactcgacctggtgtcggccggcttccgtcgctcctgcacgaagtcgatccggtcccgggccgagtggctcgggctgaaagtcccggtggagctcaagcggtggacgccggaggaggacgagatcgtcgccaccaacacgaacgcgccgatcaagcgggtgcgcacgctgctcgcgaccgcggggttccggcgcaccatcaaggcggtcgcctcgcgccggatcgacctcggcctgcagccgcgccccatgggactgacgccggaactcaagcagatcgtccgcgcctgcatcgcccagcagatgaccgacccgtcgaccctcgcccacttgcgcggactcggccacgacgtgacgctctcgcaggtcaagaacgtcgggcagcagatccgggccaggagccggccgggctggaccaaggaacgcgtcgacacgctgcgcgccatggcggaggagggaaagcggccgatcgacatcgctcacgcgctcgggctgaccaactcgaagacggtcaacgagaaggcccgccatctcggcatctcgttcgcgcgcctgtggctcgacgaggaggtgcgcacgctcctcgccatgatgggcgagcgcaagacttcgatcgagatcggcgaggcgctcaaccggccgccgtcccaggtcgtcaacaaggcccggcgcatggggatgtcgttcgagcgctggccggaggagtcggcgtggacggacgagaagatcgacgccctgcgcaaagccagcgaggacggcgtgcgcctcgccgacgccgcccgcgcgcttggccgggcgccggacgccgtgttccaggccgcgcgccgcttcggcatctcgttttcccgcgaccgcaagaacttgctgcccctcgccaggactgagcaaacaaagatcaacggcaatcattattcggttgcgcaacagtag

SEQ ID NO: 7186 - DNA, 558 bp, Methylobacterium sp.
atgctgtcgccagcccacttcgattacctggtcagctacgcggtcgcgcgggagatccgctactggtcccgcgccgacaagtgccaggagcgcgtcacctcgacgggcgcgaacgcggtcggccgcatgctcgccagcgccaacgcggacgcctacgccaaccgctactccagccacggcgacgagttcgaacgcggcgagaacttccgcgccgcccgcgagtaccgttggcgtccgttcccgggcccgttcgatcccgtccaggtcatcaaggccgtcgactgcctggagtatcaggcgtgcgaggcgtcgggctgggaggacagcgacgcgtcgatgctgtgccacgccatccgcgcttatgccgtgcgcgcgctggccggatatgacgacgccaagtggtgcatcgacgacgtggccgacctgcgcccggccaagcccgccgcggcgcccgcctccggcgtagcctcccgcgcgctgcgcctggccgccgccgtcccggcgttcacgcctcccgctccgcccgctccgttcttcggccagggcgcgctcttctag

SEQ ID NO: 7187 - DNA, 624 bp, Methylobacterium sp.
atgcctgacctgagccggcgagccctgctcgcctccatcaccgccgcggccgcgaccatcgcgctcccggccagcgcggcgccgctctcggggaccgtcatcatcgacgacccgtggcactcgataccgcctgcgccgcggccgctccccacgttgcccgagctgaaagccttgtccgagcgagccctggcggcgctggagcggcactggccgaggcacatctacggcgagacgttcctgtcggagggcgacagcccgcacggcctggtgatccgctgcgactgcctggaccgcccggacacgtcccacgggcggagcggctaccgctgctcgagcgtcctgcccggcacgcccatgatcggcgccatgtccggatatttcgagccggagtgggacgagcgcaccacctacggcatcctcctcgacgtgacgtggtggaacgagcggccggccgcgatcagcgacgcggactgggccgaggtcctggcgatcgtcgacatgacgccggagtcgcacgcggagcgcatggccgaccttgctcgccagaccggcgaggcggacgcggcctgggatcgcttcgccgaggagttcaaccgcacgaatggagagttgccccatgtctga

SEQ ID NO: 7188 - DNA, 477 bp, Methylobacterium sp.
atgaagcgcgagaccgccccaccacgcccgatgactgcccgcgaagcccacgccgccctggagcaactgcgctccgagatcgggccgaaggcttacgtctcgatcagcatcgcggcctctgacatcagcgacgcgataatccacgccagcatctacgctcacggcatcgcacagacgtcgcccaacttcgcctgcaagggcgaggacctgggcgaggcggttgccgcactgcgcgccggctgggccgggtttcaggaggagcacgcccggcgcatgtccgccgatatggcgctggagatcatccgcctcacggacgcgcacggctgctgcacagacgctgctctgcgcggctcgaagttctcggtcggcgacgtccggcgctggggcgaggccgcgtgcgcccgggcgaacgagatggccgggcggggcccgttcaccatcgtctcgatcgccggcgcgaacggggaggcagcctga

SEQ ID NO: 7189 - DNA, 456 bp, Methylobacterium sp.
atgaccgacatcatcaagacttccgcctggtcgcagaaggtgccctccgatcatatcaagatcggtatctcgcgcgggaccccgcgcggtcacgcggcgggctaccgcctgttcaagaccctcgcgcccggcgcctggttcaactcggtctcggcgaccgaataccgcgagcgctacttcgccgagatcctggcgccgctcgacccggccgcgatcgtcgccacgatccagaagctggccggcgacaaggtgccggtgctcgtctgctacgagagcccgaccaaggacgaggactggtgccaccgcggctacgtctcggcctggctgaaggacaagctcggcctcgacgtgcccgagctcggacacgaggagcgcgggtgcggctggtcgcatccgaagctgccgccgacccagcgcgtgaagccggccgtcgacggccccgcccgcctgctctga

SEQ ID NO: 7190 - DNA, 549 bp, Methylobacterium sp.
atgctgacgttcaagcgcacccgcggcagccgcctcgacccgctcccgacgttcgaggtcctggcgggcgcggcccggctcggcttcatcaccgacactggccctgaaggcgcgggcatgcgctggaagggcacggcggctgacggcacgcccctcgccgcgaccagcaaggcgaagatcgcccagaagctccagatccacgacgcggcgacgcggaacgcgccaggccccctcggcccggtctacgcggagcccgcccgtgtctcggacgcgcacggccggtacttcagccacatccatgccggcacgggccgcgaggaccgcggcaacgtcatcgcggccgtctaccagggcggcccaggcggtaccctgaacaccggccccgcggtcgacgcggccgcccgcctgctcgccgcggcccccaagctgctcgccgcgctcaagagcgtccaaggctgcccgcaggccgccccgtggctggccgcggccggcatccacgaagagatccaggccgcgctagccgcggccggccccgccccgcgcacctga

SEQ ID NO: 7191 - DNA, 393 bp, Methylobacterium sp.
atgcgcacagtcttcgctatactcattctcgccgctgtcggaccggccgctgctgcggatgtctacctgttcgatctgctgcgccggcccgactacaagcgcgcctacaacgcgatgctgaaaagtggttcttcagtgccgaagtgggtgacggcctatagccgcacgttgaacggcccgtcccaaccttccagtgaaataaaagcggacggcgaaacctacctgctcgctgacgtgtgcaaggtccacgactgcctcgaccataagcttcacgtgatattcgcgccgggcgggcggcgtgcgtggggccggctgtatgagaatggcagcaccagctggataggcagcccatcgccggcgctcaggaaggcggccgaacggatcgagttctga

SEQ ID NO: 7192 - DNA, 1023 bp, Methylobacterium sp.
atgtatgacggggaaggccggttcccgcggatcgaaggccgccgcgacatctcggaatacgcgaccgggcggatcagcaccgacgaggtgccgccgcacgaacgcatcgatcactggaccgaggcgtgccgaaccgcgttcggcgggttcgaattcgtggatgtggagcggaagggctttcacgccgcgttgagcacgctgacggtcgactgcctcacggtcggtcactacgtcggctcgccccacgcgatggcccggacgaaggcgcatatccgatcctcggacaacaatttctacctcgtcatcctgggttcggagcggaccttcaatctggaacacggccggtacctgaactcagcccccggcgggatctcgctcctcgacaacacgcagcccttcctgggggcgcatccggacgggctggacatcatcaatgtcttcatcccgcgggccgtgctggagcaggctgtcggcccggcccgatccatcgcgggattgtcgatcgacgccacgcagtcgacctatcccctgatcgcgtcctatctctccgcgctgatccggcacggcggcgccctcacgccggcacgccaggcgcgcatggccgcggtcgcggtcgaactcctcgcggccggcttcgcggagcggatcgagagcggatcgccgcggtctctgagcggcgcggcgatcctgtgccgggcgcaggccttcatcgccgagcatatcggtgtcgagggcctgtcgatcaacgacgtcgcggccgccctcaacatctcggtccgccgccttcaggaagtggcctgtgcggagaacgtcgcgctgatggactggatgtgggagcgccgtctgcaactggctcaggcgaagctcgccgatccggccaacggcgtcatgccggtcgggctcatcgcgtatcaatgcgggttcgccagccaggcccacttctcccgccgcttcaaggagcgattcgggcagacgccgaccgagttcaaggtgtgggccgggctccagcgcgctccggcgtga

SEQ ID NO: 7193 - DNA, 321 bp, Methylobacterium sp.
ttgctctacgccaggatcgaaccggagtcagagcatcgccagaacggcctgctgcatcctgagaaggtcatccaggcgggttccatacaactgacctcggtgagcttcgagaacggctcgctccccatcatatcggcctgtgcggagttccagctatcgttcgaccgggcgttcagggacacgggcggactatacgattggatggaacagaccgattggctggatcatgccctatgcttcggcttccgcttacaagatggtggtgagtgggatgcgacgtacgatcacgcgggcatagatttcgaaatcgtcacgccctga

SEQ ID NO: 7194 - DNA, 537 bp, Methylobacterium sp.
atgtccggatccggcgttgtccacgaggcggccgtggcggcgagcgagcctttcggcgcgttcgcggccggcctggcggacctgtcgcccctgcggtgggcggtggtcgcggcctgccggcggcccgaacgggactgcgtggtcccgctcctcgaagaagcgcgcctgccgcccgaggcggcgcggcgcgtcgccgaggacgcgcggcgcctcgtcgagaccctgcggcgccggggcacccgcggcggcgtcgaggggctgatccacgagtacgcgctgtccagccaggagggcgtggcgctgatgtgcctcgccgaggcgctgctgcgcatccccgacgcggcgacgcgggacgcgctgatccgcgacaagatcgccggcggcgactgggccgcccatctcgggcacagcccgtcgcccttcgtcaacgcggcgacctggggcctgctcgtgaccggcaggctcgcggcgacccgggacgaggccggcctgtccgccgcgctcacccggctgatcgcccgcggcggacaggccggc

SEQ ID NO: 7195 - DNA, 177 bp, Methylobacterium sp.
atggtctcccgggcggtgtgccgaaccgccggtccgaactgcctgacgggcggagtcctgctcgccgaaagcggcaaatctgagaaggacatgagcgccttgccgggccgcagcgcggtggtcgaacggcgcgcgtcggccgccgccttcgccgagaaggctccaccggtcgcttga

SEQ ID NO: 7196 - DNA, 117 bp, Methylobacterium sp.
atgctgcgcggcgtcgacatcctcgccgacgcggtgaaggtgacgctgggcccgaagggccgcaacgtcgtgatcgagaagagcttcggcgccccgcgcatcaccaaggacggtgtg

SEQ ID NO: 7197 - DNA, 168 bp, Methylobacterium sp.
atgcgccgcttcatcgtcctctggaccgtcccgggcctcggtttcgccttcgaggcggacgtggccgccacctccccgcgcgaggcccgcgccgcctttcgggccatgttcccctcggaccgcgtcaaggcggtcaagctcccccgcggcaatggccgtttcgtctga

SEQ ID NO: 7198 - DNA, 495 bp, Methylobacterium sp.
atgctctcgccgggcctggacttcgatccgcgcttctggccgtctgatccgtctcccgacgagacggtctgcctccagctctcggaccggatcgactgctactgcctgctcgaccggcaggactacctctgggcccggcgctggctctggtgccacacctacggatccgggtcgttcgacccggacacctggacgattgatcgcccggacgggatctacgcccgccggtccgtgcccatccccgggcgcatcacgccgagcggccggcccgcctacggcaacctgttcctccaccgggagatcctggagcgcgccgaggggccgccgccggatccgtcctgggtcggcgaccacatcaacggggacacgctcgacaaccggcgctgcaacctgcgctgggcctcgaagtccctcaacgcccagaacaccgtccggcaccgcgccgcgaccctcgcccgctacgccgcgcagcacgccgcggcctgttccgcatag

SEQ ID NO: 7199 - DNA, 225 bp, Methylobacterium sp.
atggcggacgatatgtccgaagacaagacagcgtcaagacagaaatcagacgccgcgatggagcgaacccggaagctagtcctcgatacgctcccaccgggccccgttcgggaccgtttcgcggccctcacgctcgacgagctgcggggcctcgaatttgacagtgacctctggcgtcaggtgcgcgttgcgctcagccacgtcgaaggccgccacctcaactaa

SEQ ID NO: 7200 - DNA, 147 bp, Methylobacterium sp.
atggtcgattgtaactgcaccggcctgaggttcggtaagctcgtcttcgtctggctcaggcgcgagcgcgccttccgcctcaacggcttcttcgccttcaccttcgctttcaggtcgatccgctgcctctgcctcaagcccgcttag

SEQ ID NO: 7201 - DNA, 870 bp, Methylobacterium sp.
atgtcgagcctgatctttcacgacctgccgcgcggcccattgcctctctacatcagcgagccggtgccggggttggaggaagcgaaggctacgctcctgctcgaccatcaccaccgcgaggtccgcttcgttgcggcggacccattcacgccgttcacgataccgccggccggcgtcgaccgctatagctggtgggatgtcgacccgatgctgccgcgctggcaggtccgcgagctgtacggcgaggcccggccgctcctggagcggattcagatgggcacgaccctgacgcaactgccgacacactggcaccggacccggaccccggaggcgctcgcggcggccgagatggtcgaggagctggcggcgcagcctgcccaggcggcggtcgagtgggtgccgggtctgcggccggtccgcgaggagacggcgctggagcgcgcgatccggattaccgaagcagccgtgcgctccgagttcatccatcagttccaccagaaggaactggccgggatgccgatcgaagcccacgagcgcaatttccggaacctgctcgctcacggcaaggacattttttactcgcacggcgaccgcacgctgggcatgagcggcagcccgatcctcaacctgagcccgggcaccggtaagtcgcagggcgtaatcgggcttttgaacgcgatggggccggtatcgaagtcgcttgcgaccgatgacggctcggctgtcggcagcccgtcgcaggagaccatgcgccgccgcaccaagggcgtgatcctgcctggcaaccacgatcgctacagccgcaagggcatcaacggaaagtggggcgctctgttcgaggagagcgacgtgcgccggatcgccggctga

SEQ ID NO: 7202 - DNA, 138 bp, Methylobacterium sp.
atgaccaagtccctccagatcatcgacaccaagctcaacaagatcatcctcaccaagatcagcgagcatgaggctcacaagcgggtcgacctgctcaactcctgcggcatcgtccggtacaaggcccgggcgatctga

SEQ ID NO: 7203 - DNA, 1461 bp, Methylobacterium sp.
atgagctgggacaatgagaaagtcgtggccttccggccgaccgacagccagttgctggagcggctaccgcactgcttcgacaccgagcgggcgttgctggcggcgctgctgctgaagccggatcaactcaccgaggtggcgcacgggctcaaggtcgacgacctgttcggcgccgagcaccgtgaggtgtacgggaccatgctggccctgagcgccggcggcttgccggtctcggccgtcacggtcgcgcagtacctcaagacccgcgagatcgccggccagccgccggcacgctacctcgccagcctcgcggccgatgcggcttcctgggacgcgcccggccatgccacgatcgtgcgcgagttcgcccgtcggcgagcgctggtcatgatcggcgaaggcttggctgagcaggcccgtcagggcggcgccgaggaccaggcgagcacgctgatcgacgagaccgacacggcgctcctcgaggtccgcggcacgggcagcgatggccggatgagcggccaggacgcggcgcaggccacggcctggatgcgggagcggattgaagggctgcggtccggactgctgcggtccacggcggtgccgaccggcatcgcggatctcgaccgggccacgaacgggggattccagcgcggtcagctctggctgctcgcgggccggcccggcatgggcaagacggtggcgatgacgtcgctgagccggttcgccgcccgcgaggccggcgtgctggtcttccagtgcgaagtgaccagggaccagcagatcgcccgctacctcgcggatctctcctacctccacaaccgcccgctgaccttcggcaagatcatggcggcggtcgagctcgacgatgacgagctgtggcgcattgacgaggcgatgaagcgctacgagcgcctgcacctcaagctcgaatgcgagccgtctgtcagcgtcgcccagatcgcggcggcggtgaaggccgagaagcggcgcctcgccaagatgggccaggatctgggcgtcgtcttcatcgactatctgaagttcatcaaggtctcggaccgctaccagggcaaccgcgtgctggagatcggcgagatctcaggttcgctcaagcagctcgcgaagtccgaggacatctgcgttgtgctgctgacgcagttgaaccgcggggtcgagtccaaggaccgggccgacaagcggcccagcctcgccgaccttcgggattccggcgagttggagcaggacgccgacgcggtgctgatgctctaccgcgaggcctactacctcgagaagaagctcaaggggtccagcgatgacgacgtcgcgacccgactgatcgagaagcagaacactctcgagatcatcctggccaagaaccgcagcgggccgtgcccgaccctcgacctgtggtgcgacgtggcctcgtccgcaatctcccagacgacacggggtccccgatga

SEQ ID NO: 7204 - DNA, 513 bp, Methylobacterium sp.
atggcgctgccgaagatcctcgctctcgacctcgcgacccgtctgggctgggcctatggctcgcccgacggggagccgcattacggctcgaagctcctgccctccaccggggccgagatcgggcgcttcggcgacgcctacgatcagtggctcctcgacatgatcacgctggagaacccggcgctggtcgtgttcgaggcgcccttcgtcagcggcaccggcaattcgaacaccgcccgcaagctgatgggcttgtgctggcagaccgagctcgcctgctaccgccggcagatccggtgcctggagcacaacaaccagagcatgaagaaggacttcgccggcagcggtcgcgcggagaagctcgacatgatggcggccgcgcggcggcacggctgggatccgaaagacgataacgcggccgacgccttggcgctgtgggcctgcgccgttcacgagaaggccccgaagtattctcgcctgaccctcggccggctcggcgggagggcggcgtga

SEQ ID NO: 7205 - DNA, 234 bp, Methylobacterium sp.
atgctcggcaagaccctcagagaccgcattaccggcttcaccggcatcgtgaccggccacgtcgaatacctgaccggctgcaaccagtgcctgctcaccccgcccatgcgcgacgggaagcggatggaagccgagtggttcgacgtgcagcgcctggaggacaccggcgccgcgatcatcgtcctcgacaacgggctcacgcccggctgcgaccgcgccgccccgaagcgctga

SEQ ID NO: 7206 - DNA, 402 bp, Methylobacterium sp.
atgcgcaacctccgcctcctcgatgtctaccgcgacgcctccccgcgcgtgatcgcgatgtacggcgacgccggcgatcacagctacggcgtctttcgcgtgccgtcgccgaccggcggccagccgctcgtcgtcatcgcttcgaccggtgagggctgggaccacgtcagcgtctcgctcccgaaccgctgcccgaactggccggagatggagcacgtgaagcggctgttcttccgcgaggacgagacggccatgcagctccacgtcccaccgtcggaccatatcagcgtgcatccgtactgcttgcacctgtggcgcccgctgagcggcgagatcccgcgcccgcccggctggatggtcgggccgagcagcaccgaggcagccgggaaggtggtcgcgtga

SEQ ID NO: 7207 - DNA, 330 bp, Methylobacterium sp.
atgcggatcatgctcagcgccaagatgggggagcaggttcgcaaggacccgcgcaccgtcatcgtcgaccgggtgccgtgggagctgttcgacgagcaaaccacgcgcgcccgatgcgagagcaaccacggtcagacgatcgagcggatctcggagcgcggcggcttcgacgcgaccgaggccgtgggcgtcctgaccggcctgaagtggggcgagcttcggcatctccgcgaggagcacgcgcaccgcatcctctaccagatggtgcacctgttccgccgcggcgtgctcacgggccggcggtcgatgcaggaggccagcaatggttga

SEQ ID NO: 7208 - DNA, 222 bp, Methylobacterium sp.
atgatcggccggacgtacctcgaagcgggctcgcccgtccgcgtcctgatccgatggggcaggacctccgccggcccatccgcgccgattggcccgctcagcgactgcagctggagccggcgccgcgcccctcacaacgtcctgatcgagcgccaggacggcagccgggtcgtccgcccgttccgcggactgcgcaagctgccggaggtggaccatgggtga

SEQ ID NO: 7209 - DNA, 402 bp, Methylobacterium sp.
atgggtgagccgatgaaggccctctcgatcatgcagccgtgggcctggctgatcgtcaacgggcacaaggacatcgagaaccgggattggcggtgccaccgccgcgggcatgtcctgatccacgccgggaagaagatcgaccgggacgcgatgcaggacctgcgctccggccggcatccggtcaccggcgagttgctgcgcctcgacctgcctgaggtgttcgagaccggcggcatcgtcggcgaggccaccatcgcgggctgtgtcgagcggtcggaaagcccgtggttcgtcggccgtttcgggatcctgatgcgggacgcccggccgctctcgttctggccctgcaagggcgcgctcggcttcttcgtgccggcgccggtcgccgaggtggcggcatga

SEQ ID NO: 7210 - DNA, 225 bp, Methylobacterium sp.
gtgatcgccccaactgaagccgacatcggccgccgcgtcatctaccacccggtccgcggccacaccgtcgaggagggcgtgatcacgtccttcaatcccgcctacgtcttcgttcgatacggcgctgacgcggggagcaaggccacaccacgcgagctgctggagtggttcggcccggcgtccgactccgggctgaaggatcagggaggggacagtgccgcgtag

SEQ ID NO: 7211 - DNA, 297 bp, Methylobacterium sp.
gtgggcgcctccgagatcccggtgggggcgcagttccgcctggagatcacgtggcgggtgctcgggccgggtccggcattcgccggcatgccggacgatggggcgatcaccgcgacctcgccggatggcggcctcgcggtcgatcagccgaacggcaccgtgacctggtcgtacacgaccgcgcagagcctcggcatcccgctcggcgcggtcgcccgctacacgctgcgctgcctctttggcagccatacgcaggtctgggcctacggtccgctgcgggtgcgaggcgcggcgtga

SEQ ID NO: 7212 - DNA, 183 bp, Methylobacterium sp.
gtgccgacgccggcgccgcgtcccgttccgaagcggggcgaggacgcccggctctacgcacgccgcgccctcgactacggcgatgccaacgcggccggcctcaccgacaccgcggaccggtaccgcgcgctcgccgaggcgatggagcaccccgcaccagcgccggaaacgaccgcgccgtag

SEQ ID NO: 7213 - DNA, 1527 bp, Methylobacterium sp.
atggggatcctggtcccagtcggcatcgtcgcggtctgctccgcgatgctcctccagttgcgccaggacgcctgggacaaggctgaagaaacctccagaaacctgatccaggtcatcgagcgcgacatcgaccgcaacgtcgagatcatagacgtcgcactgcagaacgtcgtcgaaaatctgaaactgtacgacctcgaggacattagcccgaagcaccgacagcgcatcctgttcgaccgggccatcaacgccaaggacctcaacgctctgctcgtgctcgatcagtacggcaactgtatctacgatgctgcaggctggcctccgcgccgctacaacaacgccgaccgggactacttccaagcgcacaaggccgatgcgagcctcggactcggtatcagcgggccgattatgtctcgatcagtgggaaagccggtcatcatcctgagccggcggacagggatgcgcggggacgacttcaacggcatcgtgctcggcagtctgtcgctgtcttacttcgaccgcctgttccaggacctcaagctcgggcaggccggtacgatcaacctcttcctcgacaacggcacgcgcatcctgcgctatcctcagaacgacacaggtaccccaccgaatttcgcagacgcgccgaacttccagcgattccagcgcgaggggcgcggaagcttcgtcgcaacgacccagaccgacgggatcgaacgcctgtataccttcacccgggtcggaaatctgccgctgatgctcaacgtcgcgctctccacccgggagatcgaggcggattggcaggccagagccctggtgatcgggcttctcgtattcgcgctgtgcgggattactgtcgggctctcgcttctcgttgcgtgggagctgaagcggcgcaacgcggcggaggccgagctggcagtactctcgcataccgacaccctcacggctttgccgaaccgccgtgccttcgaggcggcgtttgcgcgggcctgggccgcgggccgccgatgtggaggttccgtcgccctcctcatcatcgatgccgatcacttcaagcggtacaacgaccgccacggccatgacggcggcgaccgcgtgctgatggcgctcgcccaggccttcgcctcctgcacacgccggccgggggatttcgttggccggatcggcggcgaggagttcgtcgtgctccttccggacgccgatgcagagggcgctgcctcagctgcggacaccgtgcatgcggctgtcgcatccctctcggtcgaggcgggcggcgtccatgtcggtcgaatcacggtcagtatcggcctcgcctacggtgttccccgtcgaggcggctccccggaagacctcttacgcctggccgacgctgcactttacaaggccaaggccacgggccgcgaccgaacctgctacgtggtcatggatgagcaccgagctgtgggtgcaaaagcgccttcgaacccaagctccgatcccggcgccagacccacgcgacctgaaccagcatccctcgtagcctga

SEQ ID NO: 7214 - DNA, 423 bp, Methylobacterium sp.
atgtttcgtcgacctctctcgccgacgcggcttgtccgggcggcggtgctcggcgcggcccttctcggcacctcaactgccgcggaagcgcgacgcgccgcgcttcgggcagacgtcgagggttacgcgatggcggcctgtctgacccggcaggacgtgccgtacctgcgcgagcagggccatctgtggggcaatgcgatcttgcagcgcgggcacggatcagtggaggattggaccacactcgccgacgccgtcggcgcagcagccgcgcggcagaccatgtccatggctcgaggcgacggagcagttcatgacgcgctgaaaccgatgccgctgctgttctgtcacgaactcgtccgcagcccagcggtccgcgccgccaaggttcgggcgatgcggcacttggcaccggattaccgatag

SEQ ID NO: 7215 - DNA, 117 bp, Methylobacterium sp.
atgaggaacaagatcgagacgaggcggcggcactacaacgagagcggtcctcagaccgccctggagtggccaacggcccaggaattggacctggcaacggccttgcaagccgcctaa

SEQ ID NO: 7216 - DNA, 204 bp, Methylobacterium sp.
  modified_base (149)..(181): a, c, t, g, unknown or other
atgatcaacgaggcggtgcgcgagcgcctcggccgctggcgctcggccgacatcctgatgcgctcggtcgacttccaagcggtggttgacatgcagcgggcggtcctctgggacgagatcggccaccacctcggcacggcggccccgcnnnnnnnnnnnnnnnnnnnnnnnnnnnnnnnnnatgcacacggcaccggccgctga

SEQ ID NO: 7217 - DNA, 771 bp, Methylobacterium sp.
atgacgaagactgtagccatcgtgacgggagctagccagggcatcggtcgagccacggcgatgcgcctggcccaagacttctcggcgctcgtgctggtggcgcgcaaccgcaccaagctcgaagagacggcctcggctgttcgggaagccgggtccgaagccttcgtgatcgacctcgatctcgccgaacccacggcggccgcgacagtcgtccagcagaccctgtcggcgttcgggcgcatcgacgcgctggtcaacatcgccggtgcggttcccgggctggacgtcttccagatgacggacgagcagtggcatgcgggcctggaactcaagcttcacggagctcggcgcctcaccattcaggcgtgggatgtcctgaaggcgacccgaggcgcggtcgtgttcatgtcgggcaacgccgccgtgaccccgaaggcggccgcagcggctgtgggcgcgatcaacgcgtgcatagaggccttggccaaggcgttcgcggaacgcggcatcgtggatgacgtgcaggtcaacagcgtgtcgcccggcgctatcatgaccgaccgccgcacggcgatgcttcagagagccgccgaggccaagaaaatcgacatcgcggaggcgaaacagggcttcctgaaacaggccgggattacccgcttcgggacagcggaagagatcgcggatgtggtggcattcgccgtctccccggcggcgcattggatgaccggcactgtgctccggatggacggaggtgaggtcaggtcggtttga

SEQ ID NO: 7218 - DNA, 972 bp, Methylobacterium sp.
atgcgcgccatcgtcctggacggcttcggaggcctcgacgtcctgacctacagggacatccccgaacccgagccgctcgctggccacgttgtcatcgagatcaaggccttcggcatcaaccatgccgaagtgcacatgcgtcgaggcgaatgggccgaggcagcgccggtctcgggcatcgaatgcgtcggtatcgtcaaatcgtgtcccggcggcgagtttccggtgggcgccaaggtagcggcgctgatgggtggcctcgggcgcaccatcaacggcagctacgcccagctcaccagtgccccagtcggcaacgtcgcgctgatcgaggcggacctgccctgggccgagctcgcggccatcccggagacgtacgccaccgcctggacctgtctgttccgcaatctcgaaattcaaaaggggcagcttctgctgatccgcggcgcgacctcgtcgttcgggcaggccgccctcaagatggccgtgaacgccggtgcccgcgtcatcgccaccacgcgtaaccccgagcgcttcggcaagctgcaggcgctgggtgccgagcgttgcgagatcgagcggcctgacctgtcgaagcacatcgccgacgcgaagcagatcgatgcggtgctggatctcgtcggcaacagcgtcgtcctcgactcgctcgcgatgctccggcgtggcggccgttcgtgcctagccggctggctgggcgggctcgatccgatcccggatttcaacccgctgctgcagatggcgagcggcgtctacctgaccttcttcggcagcttcgtgttcgggacgccaggctttccgctagccgatgtcccgctgggccagatcgcccaggacgcggctgctgggcggctcgatgtgaagcccgtgcgaatcttcggcttcgacgaggtccgagaggcacaccgcctaatggaggcgaacgcggccggcggcaagatggtcgtcgtgcactga

SEQ ID NO: 7219 - DNA, 981 bp, Methylobacterium sp.
atggcaacacccgaggactggctgagccgcctgctcgcgctcgtccccgtccgcggacgcctcgacatctactgcacctatggggccccctggcgcatcgaccaagccggcgcggcggtcggcgagatggcctatcacgccgtcgtcgccggatcggccgtgcttgaggacccgacaggtggcccgccgctgcgcctctcggccggggacatcctgctgcttccgcagcgggtggaccacatccttcacgatggcagcggggcgcccgcggcgccagcgcatacacggacggccgccaacctgttgatcagcgagaacgagggcacgggcgagcggctcgacatgctctgcgggcacttcgtgctcgcgcgcgcccaggaacgcctgttgcgggactacctgccgccgcgcctcgtggtgcgaacggccgacccgggcgcgtccgcgacgttatcaggaacccaggacgtgctgactggcctcgtgtcgctcatgcgccacgaggcggtgtccgacggactgggcggccgggccatgctgaacgcgctgtctacggcactgttcacgctgacgctgcgactggccagcgaggcccgtgacaggccggtgggcttgctggccctggcgggccacagccgtctggctccagccttgtcggccctgttcaacgagccgggccgcccgtggacgctgcccaagctggcgcggctctgcaacatgtccagggcgaccatggcgcggcagtttcaggagagactgggccagtccgccaacgaactgctgacggacatccgcatgaccctggcggcgaacgaattacgcaacccgtccgcgagcacgggcgcggtggcggagacggtcgggtaccagtctgaagccgccttccagcgcgccttcaagcagcgcatgggggtcacgccggcgcagtggcgccgggacgcgcagtccgtggaaccgcccgtcccggccctcccgtcgtga

SEQ ID NO: 7220 - DNA, 522 bp, Methylobacterium sp.
atgccaggcctgctcagtagaatactcgcgtgccgtccgctcctccttcgctgggccccagtcccgctgcgcctggtcgtcggatacggcttcctggcgcatggtctggcaaaagccgcccgtggcttcgatgccttccccgccatcgtcgaggccatgggattgccgctgcctcatctgttcggatggctgaccatactcgtggagatcttgggcggattggcgatcctgctgggtgctctcgtcccgctcgccagccttcccatggcgatcatcctgttggtcgcagcgttcaccgtgcaccttccctacggcttcagctcgatcaagctccaggccgtgaccgcggctggggcgtcctttggaccgcccgggtacgagacagatctgctctacctcgcgtgcctcctcactctcgttatggccggggccggtccgctctcgatcgacgaactactgcgcaagcgtctcggcgcggtacctgcagatcagactctccggcacgtgggcagacgaggctga

SEQ ID NO: 7221 - DNA, 231 bp, Methylobacterium sp.
cccgtcacgctgcaggacgcgatccaggtccgcccgtggctcgccaacgtcctgcgcaacggcggccccaacgtgcagctcgtgcggcacggattcgtcctgccgctggtgtgccgcctcgtgcatccgggctccgggacctcggatgtcggctcgggaggcacctccaaggccgagagcaacgccgagtatcagcggctggtcgaccgcttcggccgcatcccctggtga

SEQ ID NO: 7222 - DNA, 267 bp, Methylobacterium sp.
atggtggcgaccagtctcgccatttcgttcacggtcggcgctatcgcgattgcgcaaatcggcccgttcgcggaacgagccacgccggtgctggcctcggtcgcaatcggcctcgggatgctggctttgatcggtgggctgtctcagctcaacgcagagggtgcagctgtctctcgggccgatccccgtcccgaatttgggatgagctggcgaccgcctgcgacggagccctacgatcgcacgggctccggtcgcaccgagcgttag

SEQ ID NO: 7223 - DNA, 243 bp, Methylobacterium sp.
atgagcaccgtaaatctcgagaattcaatcggcatcccagtcgagaatgccctcaggttcgcgcgcctgatggattcctggttcgcaggcgtcggccgggttgcagtgccgcccggcaatccgtttctgggcatcaatccggaggagcgggaaacgatcgcgttcggcttcgctgatctggttgagcgtctcgcggctatcgacgcgcaggtcagcggccccgacgggatctgccctcgatga

SEQ ID NO: 7224 - DNA, 330 bp, Methylobacterium sp.
atgacgatgcggagatcgtttcccccgctcgcggcgctccgggccttcgaggcggccgggcgccgcctgagcttccgcgctgccgccgacgagctgggcgtcacggcgaccgccatcagtcatcagatccggcttctcgagcagaccctggggctgcgtctcttctaccgcgagacgcgccgggtccggctcactgccgagggcaccgtgctgctgcccgtgctgcgcgacggtttcgacgcgttcgcccgagccatcgacgagatccgcggccggcacgcggccggcgttctcacgctctcggctccgactgccttcgtggcgaagtag

SEQ ID NO: 7225 - DNA, 450 bp, Methylobacterium sp.
atgcgcgaccgggcgggcaaccgcaccacgatgtcggcccgggcgctgcgcggctccggcggcgaggcgcaggcgccgttctacgtggcgatcgccgcgtcgctcgccagcgcctactacccgggcgaccggccgggcgacgagaatccggggctcggcctgtgcctgctcgacgaggcgttctcgaagctcgacgtgcgcaacagccaggcgctggtcgatctctaccgcgcctgggggctgcagctcctgatcgccgcccccgaggacaagcgcacgacgctgaccgaggtgatggacacgatcgtgacggtctacaagagcccggatctgacctcggtccggatcgaggccgagcaccccctcgaggcggcccggcgggcgctgcacgcgatcaaccccgaccaggtcgggatcgagggcttccgccagtcggacgccgcggagtga

SEQ ID NO: 7226 - DNA, 585 bp, Methylobacterium sp.
gtgagcgacgtcccggccccatcccgctcccgcccgccagaatacgtggccatcggcctgatccaggatgccgaggcataccgggtcgccgccatgcgcgtgcatcccagtagggagacgttcggggctcgagaagtggatctcctcgcccccgcttggcacctcctctgccactcgtccgagttggccttgaaggcctatctgctgagcaccggagtcgatcagggatcaaagaagggcggcctcatgcactcgtccatccggcacaacctgaatggcctctaccaatgggccatggagcgggggttcgagccgccggacgaggacttcggagacctgatcgagttcctcgacccgtaccacagcgctcacgtgttccggtatcgcgagccggaccgcatgccgttcgtcccgcctttcgtgatcgccgacatcctgaagccggtgatctcgggcgtcgcccgaacggttcgagcgaaatggaaggccactcgagaggcaggcagcgacgatgcggacctagcgagcgtcggcttggcgcaagcgcagccgcctgagagcaacacaaagccctcaaggggttag

SEQ ID NO: 7227 - DNA, 201 bp, Methylobacterium sp.
gtgtccacgaccctgaaggcccgcatgatgcggctggagaactgctaccccgacctgaagcctggtccggagcgcatgagcgacgaggagctggatggcgtgattggcgtgctgcggcagctcgaagccggcgagaccgttgatccaacccggctggattgggcgacggccatcatgcaaagggagcagatgctgtcatga

SEQ ID NO: 7228 - DNA, 279 bp, Methylobacterium sp.
atgaacctgaaagcgctcgaagctcgcctcgtccgccttgagacgaagcatggggccggtcagttcgaccacttgacctacgaggaggtcgaacgggccttgtttgatcgtctgcaccggatggccgacgcggccggcggcatcgacgagctgatggccgagtgggacgccgagaccgacccggagcactctgccctgatcgcgcagatccggtcccacgagtgcgacgtccgcgcgagctacctggagatggaggggcgcctgtgtccacgaccctga

SEQ ID NO: 7229 - DNA, 246 bp, Methylobacterium sp.
atgagcgccgtcctgcagttcccccggttccgggcctaccgccccgagccagacgccatgcggctcgcgttcgatttcggcgactggtgcgtcgagctgcgcaggagcggcaagctggcgcggcggatccgcttcgcctcgctcgaggaagcccgcgccgaggttgcacgccaggaggctgctggtctccggcggctccccgacgcgcccatgccggagccgatcggcggggaggacatcgcctga

SEQ ID NO: 7230 - DNA, 204 bp, Methylobacterium sp.
atgcgcccgctcgtctattccgacacgatcacggtccgcactgacgcggacctgcgccgcgcgatcgacgccgcggccgagcgcgaaggcgcatcggccagcgagtgggtgcgccgcgcgttgggctccatcgtcagaatagacggtccgcctcgttcgcccacgcccgctgctccggcgggtgccctgccggccgcggcgtaa

SEQ ID NO: 7231 - DNA, 207 bp, Methylobacterium sp.
atgcagacgctggcctgccggaccgaactggcgaccctgctccggggcatccagggcatcgctggcttggccgcctgcaacctcgaaacgggcggctcggtgcaggacctctgcggcctcttcagcgcccttggacagctcgacgcgaacgcgaccgatctcgcgggccgctacggcgtcctgatctccacggcgggttcggcctga

SEQ ID NO: 7232 - DNA, 288 bp, Methylobacterium sp.
gtgatctcgcgctccctccagctcgacgacttcctctgggcgctcgacaacagccggcgccggtaccgggtgcgcccgacgcggcttggggatctgaccttccggttcggggagacctaccccggcctcatcactgtcgtgagcgtgaacggcatccaccacgtcgtgatgacggcgcggtgtgagatctctcccggcccgtggctcgataccgacgcctacgccgacttccggctactggcgatcaatcgcaagcgcgctctgcggaattatggaggcgcgcgatga

SEQ ID NO: 7233 - DNA, 129 bp, Methylobacterium sp.
atggagacttcgatgaccctctttacccgcttcgccctcgccacggccgtcgccgccgccaccgtcgcggttctcgccgggacctacgtcgagatcctggaccgcgccctcccgatgcacttcgtctga

SEQ ID NO: 7234 - DNA, 270 bp, Methylobacterium sp.
atgaagaagcttatcaccaccctggtcgccggcaccgcgctgctgggtgcagcctctgccgttcaggcccatgagtggggtggcggctatggctatggctacggctacggtccgggtcacggccattcccgcgtgatcgtgcgcgaaggctacggcgacggctatcgcggcgtgcgcttcggccaccgtggctgggatcgtccggatgttcgcgtgatcgagcgtcgcgggtacgggcatcgttaccacgacgacgattgggacgattga

SEQ ID NO: 7235 - DNA, 264 bp, Methylobacterium sp.
gtgcgttcaacgatcattgccgccgccctgctggcggccctcggttccgccgtcgcgatcccggcctccgccgcgccgatcggccccgacacgggcgtgtcggcgcccgccggcatggtctcgacggtccagatggatcccgtcgagcgccacatgatgcgccgtcgcatggagcgccggatgatgcgccaccggatggagcgccacatgatgcatcgggagatgcgccgcgagatgcgtcgcgagatgatgcgccgcatgtga

SEQ ID NO: 7236 - DNA, 417 bp, Methylobacterium sp.
ccgggcggcaccgtcctggcggcgctcgccgaggacgccgagggcgagcggctgatgctggacggcgtctggcgccggctgcgcgcggtccgccgcggcgcggagctgacggtgatcgtcggcggccggaacgcgacgctggtccacgtcgatcccctcgccccgccccggaccgaggcgtccggcagcgaccgggtgacggcgcccgtgccgggccgcctgacccagctctgggtgcggcccggcgatgccgtggagaagggcgcgccgctcgcggtgatcgaggcgatgaagatggagatcaccctccgcgcgccgcaggccggcaccgtcgccgaagtccgccacgccgtcgacgacatggtcgaggagggcaccgagatcgtcaccttcgcggcggaggagcggcccgcatga

SEQ ID NO: 7237 - DNA, 357 bp, Methylobacterium sp.
atgggcgacataaacggcgacatcgaccagaccaccttccagcaggtcggacggctcctcggggccgagcgcgccgccgagatgctcggactgctccgcggcacgctgacggcgctcgccgacatgaccgacgatgacctgcgcggaccggccgggctggccggcgtccatcgcctcaagtccgaggccggcctgatgggcttcgggcgcgtgtcgcaggcctgcgaggccgtcgacgccgttggcacgaacggctccgtgcctcagggccgcctggacgacctgcgcgcggcgatgacctcggcactggcgacggtggcgacgctcggaccgaaccccggacgaccgacgctctga

SEQ ID NO: 7238 - DNA, 423 bp, Methylobacterium sp.
atggcgacggcatcggcaagcgtcgagatcccggctccggcctccgaggtgtggcggctcatcggcgggttcggctccctgccggactggctgccctacatccccaagtccgagttgcacgagggcggccgcgtccgacacctggcgaaccccgacggcggcgtcatcgtcgagcggctgatggccttcgacgaggccggacggagctacagctaccacatccttcaatcccccttcccgcaaagaggttacctctcgaccttgcgggtccgggagaccggcgacgggcagcggtcgcgcgtcgagtggtccggcgaattccagccggtcggggtcagcgacgcggaggtcacgaagctcttccagggcatctacgaggaaggtctcgccgccctgaggaagcactatgccgacgagggctga

SEQ ID NO: 7239 - DNA, 315 bp, Methylobacterium sp.
atgaagcgtcggcgcgggctcctctcgttcagccgcgtccggtcggccgccgcgaaccataccgaagctctcgtgacgcggtggcttcccgacggccaccgcgagggccgggagtgggtcgcccgaaacccaacccgcggcgacgcgcgggcgggcagcttcaaagtaaatctcagcaccggcgcgtggggtgacttcgcaactgatagtaagggcggcgatctcatctcgcttgccgcctaccttcgcaacatcagccaacttgaagcggcgcgcaacatcgccgagatgctgggtatcgacgcgtatgagtaa

SEQ ID NO: 7240 - DNA, 459 bp, Methylobacterium sp.
ctggcgctgaacgccacgatcgaggcggcccgcgccggcgatgcggggcgcggcttcgcggtggtcgccagcgaggtgaagcagctcgccgcccagaccgcccgggccaccgaggagatcgccggtcaggtcggccgcatccagggcgcgaccgggcagaccgtggacgcgatcgacgggatcacggcgcgcatccgcgagatcgacggggtggcgacctcgatcgcggccgccgtcgagcagcagggcgcggcgacccgggagatcgcccggaacgtggccgaggcggcgtccgggaccggcgcggtcaccgggacgatcgacgcggtggcgcgggcggccgacgacacgggcacggccgccacgcggatgctggcctcggcgtcgagcctctcggaggaggccgccgagctgcgccgggagatcgacgccttcctgcacaccgtgcgcgcggcctga

SEQ ID NO: 7241 - DNA, 318 bp, Methylobacterium sp.
atgaggggttcggatcagcgttcggggacgttgttctcctatgtgaattgggaggctcgggtccggcccgaccatcccttgcgcacgatccggcagctcacggacgtggcgctcgtagcgctgagcggggacttctccgcgctctatgcggctcggacgggtcgcccgtcgatcccgcctgagatgctgctgcgggcgcgcattgcctcgcctgaaatgctcccggacgttgggtcgttgccgcatctgatttgctccccacgcaggttcggcggtgggagtgacgatgaggcgagtgagcatggcgacgcgcgatga

SEQ ID NO: 7242 - DNA, 246 bp, Methylobacterium sp.
atgggcgagccgactgaagccgacgtgctggcgcgcgccaagcgcaccttcatcgcgaagaaccacgacgatcgcgcttgggatgcgggctttacagagcgggaggcccgcaacggccacaacgtcgcctgtctaacggaagtcgagcgccaggagtatctcgagcaggcgcgccacgagcttcgcaccagttcgccatccgaaagaaccgatcgcagcaaggcgaggcggaagggtatcgagtag

SEQ ID NO: 7243 - DNA, 177 bp, Methylobacterium sp.
atgctgagtccgattgatgccttgcaaaaactgcgcgaccagatggttataaaccgccgaaaaatcgtggatcaggaggagagcattcaaaatgtgcaagccgagatcgaagccatagaccgggccattaaggacgaggagattattagtaagagtactggctccaaagtcacttga

SEQ ID NO: 7244 - DNA, 414 bp, Methylobacterium sp.
atggccttgttgaccgatacacctgagtcctctgccgacgcagttccgaagcagaaccgggacgagtgggccgagacggtctcgagctacatcgagcgctcgttgctgatcgtggtgggcgcgtcagtgaccgtcgtcgcgggcttcctgagccaagtgtggtccagtgcgagcgtagcgttcaggacggacctagcgaccaacctgaaggcgctgggcaccctgttcgtggcgaccttcgtcctccctacgctgaggttcttcgtcgagctccacagggacgacgatccgaagaagtcgcgtaaggcgttcatcgtttgggtgatcgcggccgcactgatgttctccttctacacgcgcttgatcgaccagctcggcgacatcgtgttgaagtacgcgaaggttgtaggctga

SEQ ID NO: 7245 - DNA, 201 bp, Methylobacterium sp.
atgccgcagacactcacgggatgggtcttattcgccgcgttatggctcacggggccgatcgccggctacgccgcgatgaacttagctgccgcccgctgggaacgtgaggcgataatgaggcgcgacatcctcgccgtcactattctgggatctcttttgctagtttccgcgctgctgctgatgttcgtggatggactgtag

SEQ ID NO: 7246 - DNA, 111 bp, Methylobacterium sp.
atgttctggacccatcccaccgagaccatgatgtgggtcggcgtcagtctcgtcatcgggctattcgtcggcgattggggcgcggatcggcagcgactgccgcccggctga

SEQ ID NO: 7247 - DNA, 546 bp, Methylobacterium sp.
gcgctggtccgggacctgcgggagagcgcgacgcggatcggcgacgtggtcggcctcatctcgggcatcgccggccagaccaacctgctggccctcaacgccaccatcgaggcggcccgcgccggcgcggcgggtcgcggcttcgctgtggtcgcgagcgaggtcaaggaactggccgagcagacggcgagagccaccgaggaggttgcccggcaggtcggcgagattcagtcctggactggggacgcctccgacgcgatcacgcgggtcgtcagccgcatcaacgagatcagtgcggtgtcgagcgggattgccgcggcggtcgaggagcagggttcggcgacccaggagatcgtccggaacgtcgggcaggcggcactcgggaccggagccgtcaccaacaacatcacggacgtggcccgctcggcggagggggccgggagcgccgccgcacaggtgctcgaggcggcgtccgggctgttggggcaggctcaacggctcgacgcggaagtgggccgcttcctcgacacggtccggacgggttga

SEQ ID NO: 7248 - DNA, 177 bp, Methylobacterium sp.
atgtcgccgcggttggctgccgtcctgagcctcgagaccgcgctgtgctccgcgatcctggttgaggctgcacacgatcggcttgaagaggaagcgcccgcaactgggatcgcccgcgtgtcagcgtggctcctgctggccgccatcgacttcctgctctggtcgaaagccacctga

SEQ ID NO: 7249 - DNA, 201 bp, Methylobacterium sp.
atgatcgccttcacaccgaacccccacaagctgcgcgtaacgccctccgcgaaggagcctggccggttcgactggtcgatcacgcgcgacggcgtcatcgtgcgccagtcggttcgatccttcgggtcggaaggtgcgtcagaggcggacggcgatgtggccttccgggagatcactgctcggtggcagagcgctcgctga

SEQ ID NO: 7250 - DNA, 816 bp, Methylobacterium sp.
atgacagtgctcgcgccgacatccgcgcaggagacctcgcgcaatccgctggccgcgttcggtggcggcgcggcgatcggggcgctgggtgggctgatcgggctcggcggtgcggagttcaggctcccgctgctgatcgggttgttccgcttcgacgccttggaggcggtgatcctcaacaaggccatgagcctcgtggtcgtcgccacggccctgccatttcgggcgaggaccgtacccttcgacgagatcggggcgcactggccagtgatcctgaacctgctcgctgggagcctcctcggggcctggttcggggccgggtgggcgacacggctccggtccgagaccctctacaaggtcatcgccggccttctggtggtgatcgccgccgtcctgatgttcggacatgacgcggccgctggcgcggctcttgtgacgggctcggtgcagattgtggtgggcgtgatcgttgggttcatcatcggcgtggtggcgtcgctgctgggcgtggccggcggcgagctgctgatcccgaccctggtcttgctgttcggcgccgacatcaagctcgcgggcagcctgtcgctggcggtgagcctcccgaccatgctcgtggggttcacgcgctatagcagggatcagagcttctccgtgatcgggcgcaaccgggcgtttctcttggtcatggcggccgggtcgatcatcggcaccttcatcggcggccagctgcttgggatcgtgccaagcggcgtcctgctcccgctcttggccatgatcctcctcgtgtccgcggtaaaggtctggcggcacgcctga

SEQ ID NO: 7251 - DNA, 282 bp, Methylobacterium sp.
atggtgaccgacgcctcagccgacctcgccgtctacctgctcaaagaggtcgcgagccgcgcgcccagcatcgtcgccttcatggtcgcagaaggtcgccgcctgcctgaggaccccgacgaagcccgtcaggaggtccgccagcgctggcccgagatgtcggacgatgagcgggacatggcgtttaggatggccatcaacgtgttgcgccggatcgagcgcgactgcgctgagaacatcgccaggctcgacgcgctgaccaccgacgctggacgaggctga

SEQ ID NO: 7252 - DNA, 756 bp, Methylobacterium sp.
atggtcgggctcgcacgccggaagccgaagaacgatgccgttgccgccgtgcagccgctgtccgtgattgacgggctgcgcgccgctcgcgcccaggccgatgccgagcgtgccgatgccgttcgcgctcgcgtggatgccgagggccggcgacatgccgccgtgaaggccgaggacgagcgcgcgctcgcccgccttgatgatgagatcgcgaccgcgcgtcgccggatcgacatagccgaagctaagttcagccgcctcgacggcgagttggcgcaagccgagtacgatgccgagcagaggcgccgacacggtgtgcgttccgaggcggaagccgcgctcaatcaggcccgcgagatcatgcggaccgagtaccccgcagctgccctagccgtcgtggaagtgctgcgccgagttcgcgagttgcagggggctgcctaccgggccaacgccgatttgccggacgacgccgcgccgctgagcctcatcgtggaccccatgcacgttgcggcagcatcggcgccgcaagcgatgatgtgggcccatgtcctgttcaatcgcagaaccggcgaacgcgcgccgtcatccgtgcagagcggccccgagtacgagcttcgtcaagtcatggtgccgcgaccggccgctgataatcatgcgccgaccatgcaggccatcgccgacttcgtgaacctgccaggcgttgagccgggcaaatacttctatggggcggtccgttggggccagccgcgcaactga

SEQ ID NO: 7253 - DNA, 102 bp, Methylobacterium sp.
atgatccagcctccgttgcgccgaaagatccgtgttttgtccacgatcggccggatcagcgtcgcgttaatgcggactatgcgcatcctccgttcggattaa

SEQ ID NO: 7254 - DNA, 402 bp, Methylobacterium sp.
atggcctccgttcgcgtgccggtgaagccgataggcgttccgttcgcccgcgcgggtggcatgatgggcgctcaggccaacggcgccgagagcggccggacgatcatcccgccgatcctcgatcggatccgccgtgagccgcatctgctggccagtctgcccgggttggtggaagccgcgattgaggccggcgctgctgtgctggtccaagctgagatctctgctgccgacatcgccgcttggaaacgaggcttcatccatgccgccaacgccttggtacatccctttttcgaagagatgcaggccctcctagattcgagccctggcgtcggtgagccggcggggattccagcaggccgctcgctgcgaccggaagacctcggcgccctgccaccgcgctga

SEQ ID NO: 7255 - DNA, 240 bp, Methylobacterium sp.
atgcagcgcaataaggtgagcaccgtgttcacgccagccagagtcgccgccgacctcggacaggatgaagacgcactgttcgacatcattgtcgacatggaacccgaggacggcctgatctgggtccacggctccggcgacgaggcatacctagcgtttaccaacgatgggatccacgagctgaaggagcggatcaccgcccttagggcggaaagagatctgctcccgccgagaccgtag

SEQ ID NO: 7256 - DNA, 255 bp, Methylobacterium sp.
atggtcctgccggagcccgcgagcgagttagaggcgctaaaggcacgcttggctgttgccgagcagcgcgaggaagccgtccggatggtcctgcgggcgctgatcgctagcctgcggccgttcggcttcgacaagaagcggttcaagcggtgcatcttcgaggaaggccaggacacccctgacgaaggcccggcatccagccgacatgccgtcctgcaccaagaagggcgccgggttctgcgcgaggcgcgctga

SEQ ID NO: 7257 - DNA, 237 bp, Methylobacterium sp.
atgaacgcgaccgcttctgacgtcgagaccatgcgccggttcaataggctctacgtcggccaactcgatgccgacgagatcgcggccttcgacaatctgtgcagtcaggtcctgatgcagcgctcctacgagcgcctcgccggtctcatgggcctctcccaagcccgaatccccagcgctgggcacgcggcgatcgacgccgcttccaccacccccgtcaccaccgccgcggagtag

SEQ ID NO: 7258 - DNA, 1401 bp, Methylobacterium sp.
atggcccgcctgcggatcgccatggtctctgcttggtgtctcatcccagccggggccctcgtcctgctcgtgccagccctcgtgaacggctttcccttcatcttccaagatacgtcggattacctgatcttcacaccgcggctctaccgaagcccgttctacggcctcttcctgtttggctttcatctaaaccgcttcatttgggcgccggtaatcgcccaggccctgatcgggagcgctctcatctacatgctcataaagaccctgccgatccggaaccgaccgggcacattcgcgggccttatcgccttccttggcgccttcacatctcttccctggtttgtcggcttcctcatgccggatatcttcaccgcgtaccttttcatcgcggtctacctgatcggctttcacctcgagcgcttctctcggccgctgcgagtggtgctcgtcgggttcgccggtctgaccatggtggtgcacctctcgcacctcgtccttggttgcggtgcaatcgctgtcttcgtgctactcagctgttggctccggcagccttggcgtcagaccatcgttcgtgctgctgttctctgcatcccggttgcgctcaccgtcggtgcctacctcacctacaacctcgcggtcttcaaggccgttgcggtctcgccggcgggccaaaccttcttcttggcaaacctgatcgagtatgggccggcgcgtgactacctccgggacgcatgccccggggccggctacaagatctgcgaccaggtggagacgttgccgtctaccgccaacgccttcctgtgggaggccggccatctcgaccgactcggcggctttgccggcatgaacgccgagtccgcgactatcgtccgggccaccgtgatgtctcggcccggctacgtggccgccgtggtggccaataatttctggcgtgccctcggcgcccatgcgcccgacaccgacgtttcctcagcattcccaccctactcggcgatcttcgaggtcatcgcgtcgaagttcggttcgcaagcgctcgccgcattccaagccagcgcccaaatgcgcgatgtggtgccccacagcctaattaggacggtcgacaccgtcctgatcgcgctggcctgggtcctagcggctgcgacttgcctggtagctgtcgctcggagagagcgtgaactcacggcgctgccgctgttctttgcggcctgtgtcttgagcgatactttggtctgctcagctctgtcaggcgtgtttgaccgctaccaagcacgcgtcatttggctgctgcctatgacagcaattctctgcctcgtaagtctaaaagaccgcgcctggcaacagcttgaccgagcccgcgcgccctacagcagcaacacgcccggtctgaacgcagctagctga

SEQ ID NO: 7259 - DNA, 561 bp, Methylobacterium sp.
ttggtggaacgccgctaccgcgaagcgcagcggatgcagcgtcgtcagggtggggacttcatgagccacttccgtaccgcccttgcacgcgagtgggcgagcttccccggcgactacgggcagcagggcatcaacgggggtatgtaccccggccagcgcgccagcatctcgcgcgagcggctgacggcgtcagctcaagcatggctcgataggcgagagggtcgcgtcgcttcaagcgcatcgcgtcgcgctgaggttctggccgaccccaacgacgagcgtcgcaggccagattttgccagcacctatcgagccctgaaggccgaacaggatgccgtgcgcgatgatatgatgccgagggtgggtgagccctcgctgcttcagaagtcgctgagggcgaatggtgtcggggtcacgcccaacgtcgagggcgccgtcaacatccgcatcgacaagcccggccccgacacgaaagtgagggccggagccagcggcaccctcttccgcacgatcaggcagagccgtgggcgtcagatgcagccggcgggtgaggatgtctga

SEQ ID NO: 7260 - DNA, 693 bp, Methylobacterium sp.
gtgctcacatcgagcgatccggactacttggagaagctggcccacattcaagccatcctcgccgacctgcggcgagacgaggcattcttctcaatcgacgagttcgggccattcgcagttcggatgcgagcggggtgcaagcttgtggcgccaggtgaggttccgacggtgccgcaatggcagccatcgcgcggcagcctgatcctcacggccgcgctggagctgtcgagcaaccagatcagccacttctacagccaggccaagaacaccgccgagatgatcaggatgctcgacctgttggtggtgcgctaccgcgaccgacggcgcctcttcctgtcttgggatgctgcctcctggcacgtgtcgaagaagctgaacgcccgagtcgcagaactcaacgagatcgcagccaaaggcggaggtccgctcgtggagaccgcaccgctgccgagcggcgctcaattcctaaacgtgatcgaggcggtgttcagcggaatggcgagggccatcatccacaacagcgactacgctgacgtagaggccgcgaaggcggcaatcgatcgctacctcgccgaccgcaatgccgccttcctgcgtcacccccgtcgagccggacggaagatctggggtaaggagcctgcggcaaccacttactgcgaagcgggtctcttcaaggatccgctgttccgatag

SEQ ID NO: 7261 - DNA, 231 bp, Methylobacterium sp.
gtgtcgcgctacttcatcagcacagctaacggccacgtggtcgaggacgacgagggcgtagagctatcgagccgcggggcattgcgcgccctgctcgggaggacgctgacggcgatcctccacgacgaatgcgcgatcggcggggcgaccgagtgcagcgcccgagcttacgacgaagaaggcaagctcgtgatgcaggcgcgggccaccatcgacatcgcggatcagtag

SEQ ID NO: 7262 - DNA, 153 bp, Methylobacterium sp.
atgaccgaggatttcggcagtcgcgacggacagcgcgacgacaagaccggcccgtcacccttcgccgacatgatcgaggccacccgcctgaccggcctcggccggctcgaggaggcgaccgccctcattcagcgcagcctcggggggcagaag

SEQ ID NO: 7263 - DNA, 294 bp, Methylobacterium sp.
gtggcccgctcccacctcgccgagcgcctgagtcggcccgctcggccgcacggtccctaccgcaagcccgaggatgcgcagctgctgccgacgatccgcgcgatcgtcgatgcccgcccaagctacggctatcgccgcgtcaccgcactggtgaaccgggccctgcgctcgcgcggcgaggcgagcgtcaatgccaagcgggtgctgcgcatcctgcgggcgaacgggctcaccctcgcgccgcacaccgcccggcggcccggccgcacccacgacggcatcgtggtggcgtga

SEQ ID NO: 7264 - DNA, 387 bp, Methylobacterium sp.
gtgctggcgctgcacgtcacgcccgccaatgccgatgaccgcaccgccgtggccacgttggctgacgccgtgcaggaggcaaccggcgacagcgtagatctcgcctacgtcgatcagggctataccggcgagcgtgcggcgaaagcggcagccgatcacggcatctcccttgaggtcgtgaagctacccgaggccaagcgcggcttcgtgctgctgccacgccgatgggtcgtcgaacgcgcctttgcttggatggcccgcttccgccgattggctcgcgactacgagcgcttgcccgccactctggccggattgtatctcgtcgccttcagcgtcctactccttcgcagggccgccgacttcgctgcagtccgtaacagcctctag

SEQ ID NO: 7265 - DNA, 162 bp, Methylobacterium sp.
gacgaggcgcccgcccgcgtcccgccgccggacgcgtccggtcccacatccggtcccacatccggtcagggcccgtcgccccggtcgacggcagggcggcggacgaacgagctgcggctcggcgagcgctggaagcggcgcctgccgcacttcatgcgctga

SEQ ID NO: 7266 - DNA, 162 bp, Methylobacterium sp.
atggcgacgctgatcgtgacggccaagctcaacgcgatcgatccgcaggcttggctcgccgacgtactcacccgcatcgccgatcaccccgcccctcggctgcacgaacttctgccgtggcattggcggtcagcgaccgccccgcttgccgaggctgcctga

SEQ ID NO: 7267 - DNA, 168 bp, Methylobacterium sp.
atgacggcactccccttcgacaacagctacgcccgcctgccggagcgcttctacgcccgtcggccgccgacgcccgtggcggcgccgcgcctcgtccggctgaaccgcgcgctcgccgaggagctcggcctcgatccggactggctcgccggcccggacggcgtcgcg

SEQ ID NO: 7268 - DNA, 495 bp, Methylobacterium sp.
atggtgaccctgcggccgatgatcttcgagggcctgacgccacaggagcgctacgtctggacgaagaagcgggtcaacgcgatgcgccagctcttcgccgacaacgacgacttgcccgagtttgcggctctgtggtcacgggagtcgacccgggtcaggaccgagccgccctacggggcgaaaggcgagcacctgcacttgctcgtgcacactgccggcgcccgggagctgctacgcaaggccctgcacaagagcttcagtcgacgagaggcctttgtcgatccggccgacgacgtcgtgcgccgcctggacaacggccagcttggcgacgcctcgacctacctcctcaaggcggtccaccagaacgtctggcgcacctacccggcgacgccacaccgcccatccggcgagatctacgggccacgggtcggctggacgcgcaacatcctcgatgagcagccagtccgccggccggccagccgcgtcggcggctga

SEQ ID NO: 7269 - DNA, 519 bp, Methylobacterium sp.
atgacgaaccacctcttctccctggtgcgggacggcgccgccgatcccgccaagaccgtgatcgagacgccggacgggcgccgctacgcgtacgcggacctgatcgcccgctccggcgcctacgcggcggccctgcgggcggcgggcgtcgcgcccggcgaccgggtggccgtgcaggtcgagaagagccccgaggtgatcttcctgtatctcggcgcggtccgggccggcgccgtgttcctgccgctcaacaccgcctacaccccggcggagatcggctacttcctcggcgacgccgagccgaccgtgttcgtctgcgacccgggccggcgcgaggcactggccgaggccgccgccggcgtccgcacggtctggacgctggacgccgcgggcggcggcagcgccgcggaggccgcagaccgggccgcagatgcgggcgccgccttcgcggacgtgccccggggtccggaggatctcgcggcgatcctctacacctcgggcacgaccgggcgctcgaag

SEQ ID NO: 7270 - DNA, 264 bp, Methylobacterium sp.
ccggtgccgggccgcagcggcgtgccggtctccgggcgcccccgcctcggcgcgccggaaccggccgcccgcgcggaggccgcgccggacgcgggcgccgagcccgacgacgccccgatgaagccctggaaggtcgtcctggggatcttcgtcctgttccaggcggccgccctgctgcacccggcgctcgggctgctcgtcctcgcggtcgccctgctcctcggcctgcgacgcctgctgcgccgctggcgacggcgccgatga

SEQ ID NO: 7271 - DNA, 306 bp, Methylobacterium sp.
ttggggcgcgttcggcggctgagaccggtcgccgggcgcacccggaccgcccggacgctgacccggcggtccgcgatccggcgcggaccggtcgggggccgcgtcgcgctgcgcgggacggttcggctggtcatcggggccggggcgatcccggtcgggcgcctggcgctgctgcggcggggccggcggacgctccggcgcgggccgcccctggggcggcggaacctgatcgcgatccggcccctgctgacgctcgggccgcgccggggccggccgccctgcggcccgcgatccggacggtccggc

SEQ ID NO: 7272 - DNA, 546 bp, Methylobacterium sp.
atgcatgtgagagttcgcctcgacggcgcgaacccgcggcgctggcacgtcgcgctgctggagcggctgtccggcctgccgggcatcgcggcggtgagcgtcgacgcggcgcccggtccggacgggtggccggcacaggccgacctgctgttccggctggaggccctgatcttccggctggcgccgaacgggtcgcggctcgtgccgcccgcggatctcgcggcctggacccgtcccgcgaccccggacctcgtgctcgacctgtgcggcgacgcggtcgccccctgcccggtctggcgcgtggcctacgacggcggcctcggcgagaccggcctgctcgcgagcctgctcgccggccgggtcccgcagctcgacctcctcgaaggcggcaccgtcgtcgccgcgggtcgcctcggctcggactaccggggttccatcgccgtctcgttcgaggatgccctgtcgcgcacggcgacgctcgtcgccgccgccctgcgggccctgtcggacggccgcgccttcgcggcgacgcccgccgcgggcgcg

SEQ ID NO: 7273 - DNA, 231 bp, Methylobacterium sp.
cccgtcacgctgcagcacgcggccctggtccgcccgtggctcgccaacgtcctccagctcggcggccccaacgtgcagctcgcgcgccacggcttcgtcctgccgctggtgtgccgcctcgtgcatccgggctccggaagctcggatgtcggccagggcgggacgtcgagggccgagagcgaggccgagtaccggcggctggtcgaccgcttcggccgcatcccctggtga

SEQ ID NO: 7274 - DNA, 624 bp, Methylobacterium sp.
cccccccgccgctacagcgtcgcggaggcgctcctcgaccggcgcgtgctcgccgtcgccttcgtgtatttcggcaacgtggcgctgctctacgggctcagcttcttcctgccgcagatcgtcaagggcttcgacctcacgaacctccagacgggtctcgtcagcctcatccccttcgcgatcgggatcgtcggcatgctcgccctcgggcgctcctcggaccgcaggggcgagcgcaaggggcacgcggccttcgcgctgctgctcgcggccggcggcacggccgcggcggcgctggtctccgatccctacgccaagatggccctgttcagcgtctcggccttcggaatcttcggcggcctcccggtgatctggacgctgcccaccgcctacctgtccggcgccgcggcggccggcggcatcgccatcatcaacgccctcggcaacctctccggcttcgccgcgccctacgcggtcggcgcgatcaaggatgctaccggcagcttcacgggcggcctcctcctcatcgcggcggccggcctcgccgccatggtgacggtcctctgcctcacccacgaccggcacctggagcaggcggcgcgcggcgcgcgggcggcggagtag

SEQ ID NO: 7275 - DNA, 96 bp, Methylobacterium sp.
atgactacgcctgaggcacgcgccctcgggctgcccggggcgagcccgggcgagctggcccacgcggatctcgtcgggcgcctcgcccgggagatc

SEQ ID NO: 7276 - DNA, 237 bp, Methylobacterium sp.
ctcggccccaccgtcgacgcctatcgcgaccgcttctgcctccgctaccgcaaccacatcacgcccaaccagtacccgatcgagcgcgtgatcgccggcgagcgcttccacgacgtggtggtcgaggtgcggcgggccgacaagcccgacatggacttcgtgcactcgctgcgcagcctcgtggccacggaccgcgacggcaacccgagctgcctcgcgctgatcctgaaggacgtc

SEQ ID NO: 7277 - DNA, 195 bp, Methylobacterium sp.
gtgaccgaccgccctgccctcgacgtggtgatcgtcaactggaacggcggcggcctgctgcgcgcctgcctcgcgagcctcgcggccgcgcgggacgccgcggccgtgcaggtcaccgtggtggacaacgcctcgacggacggctccaccgagaccctgcccgccctgccccgccccctccggctgatccagaac

SEQ ID NO: 7278 - DNA, 213 bp, Methylobacterium sp.
atctcgttctggttcggccgcggtggggccggcgggaccgggggcgcgggcgggaccgcggagatcgtcaacgcgggtggccggatcgcgaccgagggcgactcggccttcggggcgttggtgcagagcatcggtggcagcggcggcagcggtggcggcgccttcccggccggggccttcttcgcggtcggcctgggcggcagcggcggccgg

SEQ ID NO: 7279 - DNA, 1074 bp, Methylobacterium sp.
atgagcgtcaaggcacacgcgaaggaggctctgcccggcacgaccgccgccgaggccccctcgctcctgcccgggctcctcgtctgcctcgcgatcacggcggcggcggtcgcgctgcaatcggccgaggagcacctcaccggccatccctatgtcgaggcgctggtcatcgcgatcctggcgggcatcgcgatccgcaccgtctgggtgccgggcgagcgctaccgggcgggcatcgccttctcggccaagcaggtgctggaggtggcggtgacgctgctcggcacctcgatcagcctgggggcgatcgtggcgtccggcccggcgctgctcaccggcatcgtcgggacggtgatcctggcgatcaccgcgagctacgcgatctgccgggcgctcggcctgcccgcccgcatggcgatcctggtggcggccggcaacgccatctgcggcaattcggcgatcgccgcggtcgcgccggtgatcggcgccgacagcaaggacgtcgcggcctccatcgccttcacggcggttctcggcgtgctgatggtgctcggcctgccgctgttcctgccgctggccggcctcagcgagcaccagtacggggtgctggcggggctcaccgtctacgcggtgccgcaggtgctcgccgccaccgtgccgatcagcctgctcgccacccaggtcggcaccctggtcaagctcgtgcgcgtgctgatgctcggcccggtcgtggtcgccttcgcgctgatcgcgccgcaccttccggccgagggcgcgacgggcaaggcggggccgcgtcgcctcggcttcttcaagctggtgccctggttcatcctggggttcctggcgctcgccaccctgcgctcgctcgggcttgtgccggagtccgtggtgcagccggtcacgcggctggcgggccttctgacggtggtctcgatggccgcgctgggcctcggcgtcgacgtgcgggttctggcccgcgtcggcgcgcgggtgacgctcgcggtcaccggctccctcctggtgctgctggcgatcagcctcgtcctgatccggattctcgacctcggctga

SEQ ID NO: 7280 - DNA, 1359 bp, Methylobacterium sp.
ttgcgcaaggtggtgttgccgggcgggcgcgaggcgtggctcctcggcctggcggcccttctcgtcctcgcggccgtcgcgctgttctccgtctcgcgcgcgacgacgctgacgctcgcggtcgcgccgaacggcggcaccgagccggccctgctgcgggcctacgcggacgaactcgcccggcgcaagctcgggatccggctgcggatcctgtccttcgacggggtgcgcgagagcgcggaggccctccggagcggcaaggcggatctcgcggtgatccggccggacgtggcgatgccgggcaacggcctgaccctggcggtccttcgggaactcgccgccttcgtcgccgcaccggccgcctccggcatcaggaccatcccggacctcgcgggccggcgcctgggcatgctggcgagccggaccgcggacaggaccctcgtgggcgacctcgcagcccatcacgggctcgaactgctgaccgaagtgccggaggcgggcgttccgaagacggccgtcgcgctcgtgccggtggcggagaccgacgtcgcggcggccctgggcgaagggcgcatcgacgccctggcgctggtgacgacgccgacttcggcggccgcgcggcggccgatcggccatgtccggcaggcgagcgcggacggcgaggtcgcgctgatcggggtgcccgacgccgccgcggtcctggcgcgccggccgcgcctgcagcccgtcacggtgccggccgcgctgttcggcggcaatccccgcctgccggccgaggacatcgcgacggtcggttccgcataccgcctggtcgcgcgggccgacctctcgcgcagcctcgccgccgaggtgacgcagcacctgttcgagatgcgcgcggcgctggccgaagccgcaccggccgccgaggacgtcacgcatccgagctacgaggacaccgcggacgccaccagcgcgcgcctgccgatccacccgggggcgatcgactattacgagcgcgagcaggaaaccttcatcgagcgctacgagagctggatctacctcgtggcgatcctgggcggcggcgtcggctcgacggtcgcctggcttcggcagcgcctcggccgcatccgccgcgagcggatcgcggtggccacggagcgcctgctcgaactccgctcgaacgcgcgccgcgagacggatcgcgagcgcctggaggcgatggcgggcgaggtggacgacctcgccgccagcatcgcgcgccaagccctcaaccgaccgaccgagccgcgcatgctgggggccgccaccgtggcgatcgaggccgcgcgctcgaccgtccggcgtgccctgacgggacccggcgacgcgtccggctga

SEQ ID NO: 7281 - DNA, 246 bp, Methylobacterium sp.
atggccgagcacggtgtgacctgctcgacgagccggtcgggcaacgtgtgggacgacgcggcgatggagagcttcttctcctcgctgaagaccgagcgcacggcccggcggacctaccgcacgcgggacgaggcccgcgccgatgtgttcgattacatcgagcgcttctacaagccggcacggcggcactcggccctgcgctatctcagccctgtcgagttcgaaaaacgtgccgagctagcttag

SEQ ID NO: 7282 - DNA, 1203 bp, Methylobacterium sp.
gtgaggcttgatccgggcaaccgcctcaccgtcatctccgccctgggcgtggtggaaatcctggcctggggctcgtccttctacctgcctgcggtgctggccgggcccatcgcagccgataccggctggccgctgacgtgggtggtcggcggcctgtccatcggtcttctggcggcggccatcgcctcaccccgcgtaggaaccgccatccacaggcacggaggtcgccccgtcctcgtatgcgccgccctgctgctcgcggcgggccacgtcgtgctcggctcggcaccgaacttgccggcgttcctggcgggttggctcctcctcggcctcggaatgggctgcggcctctacgatccggccttcgccacccttggacggctctacggggccgaggcgcgatcggccatcaccaccctgacgctttggggcgggttcgccagcaccgtctgctggccgctttcggccttcctcgttgagcaggtcggctggcgctacgcctgtctcgcctatgccggtctccacctcgccatcaccctgccgctggtactaggcctgatcccgaaggcgcctgctctcacggccgcaaagggtgcggagcaccacgccgacaagccgctgacgccccgcgagcgccgggccttcctgctgatggccggcgtgctggtcctgggcggcaccgtgatgacgctggtctcggtgcacctgatcgcgctgctgcaggcccgtggcgtcgcgctggccgcggccgtctcttacggcgccctgatcgggccggctcaggtcggggcccgcatcgtcgagatggcgaacaagggtcggcatcacccgctctggaccctgaccgtggccatggcgctggttgtggtgggtctggccatcctggcggtgggcgtcccggcggtcggcctcgccctggtgctctacggcgcgggcaacgggatttactccatcgcccggggcacggtgccgctcgccctgttcggcccgctccgctacccggtgcttgtcggacgcctggcgcggccgggcttgatcgcgcaggccgtggcaccctctctcggagcggtggcgctcacctacggcggcgccgacgcggcctacggcctgctggtggctctcgcgctggcgaacctgggtctggccatagccttgtggggcgcgcggccggacgtcgtcgacggaagcggggcgactggctga

SEQ ID NO: 7283 - DNA, 792 bp, Methylobacterium sp.
atgccggcgagccccgacgccatcgcgggcttcctcgtctcggaagcggaggctggccgcgccgcctcgacgctcggccgccggctcgccgcgatccggtacgcgcacaagctcgcaggcctcgcggacccgacagacgacgagggtgtgcgcgccgcgatgaagggtgcccgccgcaaggtcggcgtcgctcccacgcagaagaccgccgcgaccgatggcgtgctgctgctgatgctggcccgcacgcccgacaccctggcgggcaagagggaccgcgcgctgctggcactcggcttcgcgggcgcgttccgccggtcggagctcgtcgccctcgacgtggccgacctgatcgaggatcccgaaggcctgcgcgtcatggtccggcgctcgaaggtcgatcaggagggcaggggcttcgagaaggccgtccctcatgggcgcacgatccggcccgtggcgctggtgcgcgagtggctggacgcggccggcatcacggaaggtcccgtgttccggccggtggcccggtcggggagggtgcgcggcgaccggcggcttaccgcccaggtggtcgccaccatcatcaaggggtacgcgacggcggccgggctcgacgcctcggccttcggggcacacagcctgcgggccggcttcatcaccgccgcggccgagcgcggagccgacatggcccggatcatggacgtctcaggacacagggatccaaggacggtcgttggctacatccgccgagcgaacgccttcaaggggcacgctggcagcgggttcctctag

SEQ ID NO: 7284 - DNA, 747 bp, Methylobacterium sp.
atgccctccgcttccaacgctcatgccgtcaacatgctcgtccgcaagctggagagcatcgctcgcctctccgatgatgagcataatgccatcctgaacctgccgctcagggtgcaggctctgccgccccggcaggacatcgtgcgcgagggtgacaggccctcgcagtgctgcctcatcctcgacggctgggcctgtcgcgacaagatcgtgggtgagggccggcggcagatcttctccttccacatccccggcgacatcccggacctgcagagcctgcacatccacacaatggatcacagcctcgccacggtgacgagagcaactgtcgcctttatcccacacggcgccttgcgcgatctcacagcctgcttccccggcatcgcggccctattctggcgggatacgctgatcgatgcggcgatcttccgcgagtggatgatcggcatgggccggcgctcggcctacgagcggatcgcgcacctgctctgcgagatgtacctcaagctggaggcggtcggcttggctggcgaacaccgctgcgcgttcccgatcagccagaccgatatggccgatgcactgggtctcacgaacgtgcacgtcaaccgcacgctgaaggctctgcgcggcgacgggctgatcacgctgcacaaccacaccctcgtcgtggacaggtggaatgaacttgtcgcggcgggcgagtttgatcccaagtacctgcacctggagaagcgggccgctggatga

SEQ ID NO: 7285 - DNA, 219 bp, Methylobacterium sp.
atgaccgttcgcaccgtcatcctcgccgccctcgcgtccgccacgatggcgggcagcgcgatggccgacgagcgcatcaacctcacgccgacgctctaccgcgaccaggctcgcgccacggcggccgttcggcctgcgtccgagctcaccaccacgccgcgcctggtgccggccgcaccggccgctccgcggatcgtcgccgaggccggcacccggtaa

SEQ ID NO: 7286 - DNA, 816 bp, Methylobacterium sp.
atgctggcgctccttgggctgacggtcgccgacgcacgggccgcggacctcggatacgattacctgcgcggctccgaattcgacgagcccgccatcgtgacgacgccgctgatcgactggagcggcgtctacgtaggcggtcacgccggttacagcacgacgaacttcgcgttcaagaacgcgggccggaccgagatcgcgcagatcctgaggcagacggcggtcgaatccgagttcaacgtctcgggatggaacacgcttactgacaagcggagaagcggcctgtcgtatggagggtttgccggttataatatccagtacggagatgcggtcttcggcctcgaagcagattacacgagcctgtaccagaaggcgtggtccgaggacgggctcgcgcgccgtatgtcgggtaaggacggcgtctattaccggactgccaccagcacatatgcgcgtgccacgctcgaggattacgggacagtccgggcgcgcttgggctacgcgtttggtcccctcctgccgttcgtgacgggcggtgtcgcgttcggccgagccatcgtcggcagcacggtgacggtggattcgcgggaatacagcgatcttcagatgacccagcagatcggcgggatcacgcgatcgggcggaagcttcaaggagaagttcgccgccggcgccgccctcggagggggtattgattacgcgatcactgccaacgtcttcctgcgggccgagtaccagtacctcctcttcggcaagttcggcgaccagcagatgaacgtgaacaccgtccggagcgccctggcggtcaagttctga

SEQ ID NO: 7287 - DNA, 933 bp, Methylobacterium sp.
ttggcgccggtcttcgacgcgcggccggtgccggagacgcatgtcggcgcctcggtggggatgcggagctacaatctcggggcggtcctcgtcggcgaggtctcggccccggcccaggatctcgagcgcaccgcgcgcatggcggcagcgcagggcatcgatcacgtcctgatgcagtaccaccggagcgggacgagcgtggtgcgcacggagcgcggggagaccacggtgcggccgacggacttcgtgatctgcgacctcgcgcagccgatcagcatctcgtctccgcccgtgaccgcgatcaacttcctggtgacacgcacggccctcggggagcggggcagcgcgatcgacgccctgcacggctgcgtgttcaatgccgggcgcgacgcggccacgcagatcttcgcctcctacctgagcgacgtcgtgagccacggcgaccggatcgaggcgcattacaggccgggcatcgccgaggcggcggcgaagctctgcggcgcggccctgcccagcccggccggggaggccacggcgaccgagcgctgggtcagcctcgagatccgggcctttattcaggcgcacctcgccgatccggatctcgggccggagatgatctgcgagcgtttcggcctgtcgcgcgcgaccctgtaccgccagttcgccgtcgatgacggggtgcagaactacatccgcaaccatcgcctcgcccgcgccatgacgctcctgacgcgcgccggcgacgggccgcggccccgcgtctcgagcgtcgcctacgcggtgggatttgccgacgagaagaccttcagccgcgccttcaagcgccggttcgacttcctgccgcgcgacgcggctctcgatcgggcggcccggccggcccagcccggcaccggctcgccgctgggtgcctggatccggcagatcgcatcctga

SEQ ID NO: 7288 - DNA, 1038 bp, Methylobacterium sp.
atgtcggacacggatgccgggaacgcccgcaacgacggcgcgcgggtcctctgccaccgcttcgaaccgcccgccgacgcggccgagctcggccgtgcctggcgcgagcacatcgcgccggtcttcgcggtcagcttccgggccgagaccgacctcgcgatcccgatcgcgatgcgctcctatcacctgggcgatctgatcgtcggggacgtgatcgcgccggcccacatcctcgagcgcacgcccgcgatgatccagcagcaggggctcgaccacatcctgctgcaattctaccggcgcggtcggagcacggtcgcgagcggggcggtggccgggccggtcatggagacgcagtgcgtggtcttcgacctcgcccagcccgtccgcatcgtcgccgacgccgtcgacgccaccaacgtcgtgatcccgcgcgcccttctggaggaccagggctgccggccggacgccctgcacggccacgccttcgaccatggcggggacccgttcgcgcggctggtccacgccttcgtggccgacgtcgtcgcctgcggcgacctgctgcaccagcacgaggccgcgaccgccgcgcgggcgatcgtgcagctctgcggcacctacctgcgcgggcggagcggggcatccggtccccagaacctcgacgcgagcatccgggcgcgccgcttcatcgagcgcgaactgcacgataccaggctgacgccggccacgatcgcggcccggctcggcatgtcgcgctccaccctctaccgcctcttcggggagaccggcggcgtgctcgcctacatccgggaccgccgcctgatccgcgcgatgcggatcctggtcgggagcggcgcggcgcggccgctgcgcatctcgcagctcgcctacgaagtgggctttgccgacgagaagaccttccggcgcgccttccgccgccgcttcggcttcatcccgagcgaggcgggctcccacccgctcggcctgggcgagccgcagaccgggatgtccgtgctcaggagctggttcgacaacctgtga

SEQ ID NO: 7289 - DNA, 498 bp, Methylobacterium sp.
atgtccgtcattctccggcaagacccccttccgagccaggacgagccacgcgccgagggccggacgcgctgcgcggacgacctctacacctgggtccaggagcaggtggcgctgctccgcgcgggccgagtggacgcgctcgacctcgacaacatcgccgaggagctgagcgacgtgggttcggagcagtacgacaagctcgagagcgccatcgacgtgcttctggcccacgccctcaaatgggaccaccagcccgagcgccggacacgaagctggtccctgaccatcgccgagcagcggctgcggatcgaacggcagctacgccggaacccgggcctcaagtcgcgcgtcggggaggcgatcgaggagggcttccgcctcgcccggctccgtgcggcccgcgagatgcggcgtgccctcaagaccctgcccgcggagtgtccctacggctgggacgacatcctgaaccgtcccttcgagtacgaggccgaccggtag

SEQ ID NO: 7290 - DNA, 516 bp, Methylobacterium sp.
atggaggagcccgtggcgcgcccggtcccgaccgatgcgatggatgcggaccgcccgtccgcaccggtccgcgcgcgctacgaggacgatctctgtggctgggcgctggagcaggtcgccctgctgcgcgcccgccggttcgacgaggtggacgccgaccgcgtcgcggaggagctggaggatttgtcgaggcgcgagttctccaagctctgcagctgcctgcgcgtcctcgtgatgcacatgctaaagtgggaccagcagcccgagcaccgcacgccgagttggatctactcgatccgcgagcagcgccgtcgtttcgaccggctgctcaaggagagcccgagcctcaaggcccgcctcgacgaggccctgacggacgcctatcccgatgcgcgggactgggccgccgacgagaccctcctgacgccggacgagttccccccggcctgcccctacggcttggacgagatccgggagcgccccttcgacctcgactccgcgaagaggtcgcgctga

SEQ ID NO: 7291 - DNA, 486 bp, Methylobacterium sp.
atgagcgccgtgaaggcagcggcccggcccagccggaccgggaccgcctacgaggacgacttctacacctggacgcaggagcagggcgcgcgcctgcgctccggcgacgtcgcgggcctcgacctcgaaaacctcgccgaggagatcgagagcttgggccgcagcgaattcaacagtctggtcagcgcctggcgcgtgatcctgctgcacatgctgaagtgggaccatcagcccgagcgtcggacgcgcagctgggccatctcgattcgaacgcaccggaacagggcggcagacgttctgaaggataatcccggtctgaagagctgcctgacggatgccctgacccgagcctaccgcgatgcgcgggacgaggccgcgggcgaaaccggcctgccgctcaagaccttcccaacagcctgtccctacacccgggaggagatgctcgcgcgccccttccccgccgaccccgacgacacgaccgactga

SEQ ID NO: 7292 - DNA, 702 bp, Methylobacterium sp.
atgcggctgaacagcccctacgcgccggagcttcgcgccgaggccgagcgcctcatgcgggagagcgaccggacacagctctcgatcgcgcgcgaactcggcatcccgcccagcaccctcgggcgctggaacctctgcgggagctggcgcacgccgcggcttcggctcgcgcacctgaatccgacgcactggccgcaggcccgccgcgaggcggtggcgcgcctctactacgagccccgcgtggcgccgccggacctggcacgggcgctgggcgtcgggcggctctcggccgccgcgttcttccggacgctgggcttcggcgtgcggcgcaggcgatccggcgcgcaggcggcgcccgtcccgctcgatccggccctggcggcggacgggccggccctgcgggcggccctgcgcggccacatcgcccgccagatcgcggccttcgacgccgcgctctccggggagggcgcggcggtggtcgattcggcccgggtcctgcgcgacctcggcgggctgaagcggctcctcgacgaactgagcctcgagcgggaggacggcgatggcggcgcccacggagccgacgacctgccggccctgcgcgcggcactggcgcgccgcctgtccgcccgacctggcagaggcggacctcgcccgcgcgctcggcgccctgccggccccggcgctgcgggcgctggcgcgtga

SEQ ID NO: 7293 - DNA, 1311 bp, Methylobacterium sp.
atggcacaggcttccgacggcgttcaccagccggtgcgcgcatccaccgccgccttcgtcggcacgatgatcgagtggtacgacttctacgtctacggcaccgccgccgccctggtcttcggccggctgttcttcccgcaggccgacgggttctacggcacgctcgcggccttcggcaccttcgcggtgggcttcctggcccggccgctcggcggggcgatcttcggccatctcggcgaccgggtcgggcgcaagacctcgctgatcatcaccctcctgatgatgggcgtcgtcacggtgctgatcggctgcctgccgacctacgagaccgccggcatctgggcgccggtgctgctggtggccctgcgcctcgtccagggcatcgcggtcggcggcgagtggggcggggcggtgctgatggcgggcgagcacgcgccgacccaggaccggcgcaccttcttcgcctccttcgcgcagctcggcagcccggcggggctgatcctgtcgatgctgatgttcaagctcgtgaccgcgctgcccgacgccgacttcctgtcctggggctggcgggtgccgttctggttcagcgcggtgatgctgggggtgggcctcgccatccgcctcggcgtcagcgaatcgcccgacttcctcgccgagcgccgccgccggctcgccgaggcgaaggcggcgcagccgccgctgcgggaggtgctgcgcggcgcgcccggcctcctggcgctggcgatctgcgccaacgtgctcggcatcgcgggcttctacttcaccaacaccttcatgatcgcctacgcgaccggctacctgaagatcccgcgcgccctggtgctcgactgcctgctgatcgtctcggtgatgcagttcctgatcacgccgctctcggcctacatcgccgagcgggtcggcgtgcaccgcttcctcgtggccaccgccgcggtctcggtgctcacgccctacgcgatgttcgcgctggtcgatcagggcacgctcaccggcatcaccctcggcgtcggcctcgcggtggccgggctcggcgccttctacgcggtgatcgcgggctatgtcagcgacagcttcccgacccgcacgcgctacacgggcatctcgatggcctaccagctcagcggcgcgatcttcggcggcctcaccccgatcctcggcaccatcctggccgagaaggcgggcggggcgtggtggccgctcgccctcctgttcagcacgatcgcggcgatctcgctggtctcggtgctggcgctgcggggcccgcgcgagcgccagatgatgcgcgcggcctga

SEQ ID NO: 7294 - DNA, 1314 bp, Methylobacterium sp.
atgccgctggaaggcggagtgcccctggaccgcgacgcggtctccgacgcggaccggcgccagatcgtctggtccagcgtgatcggcaccaccgtcgagtggtacgatttcctgatctacggcaccgccagcgcgctggtgttcagcaagctcttcttcccgagcttcgaccccctggtcggcacgatcgcggcgttcggctcctacgcggtcggcttcctggcccggccgctgggcggcgtgatcttcggccatttcggcgacagggtcggccgcaaggcgatgctgtccctgaccatcatcatcatggggctcggcaccttcctgatcggctgcctgccgacctacgcccagatcggcatctgggcgccgatcctgctcgtggcgctgcgcctcgtgcagggcatcggcatcggcggcgagtggggcggcgccgtcctcatggtggtcgagagcgtcccgccggagcggcgcggcttcttcggcagcctcgtccagctcggctacccgctcggcgtcgtcacctcgatcggcgccttcgccctggccggcctgatgcccgaagcggagttcctggcctggggctggcggctgcccttcctggcgagcgcgctcctcgtggcggtcggcctgttcatccgcctgcggctgcacgagaccccgtccttccggcgggtcaagcagcgggccgccaccgccaagctgccggtgatggagatcctcaccgagcatccgcgcaccttcctgaaggcggtcggcctcaaggtctccgagatcgcctatgtgagcatcgtcacggtgttctcgatctcctacgtcaccggccagctcggcctgtcgcgcagcgtcatcctgaacggcatcctgatcgcggccgtcatcgagctcttcaccctgccgctgttcgggtggctgtcggaccgctacggccgccggccgctcttcgtggcggcctgcctgttctcgatcgccttcgcgttcccgctgttcacgctcctcgacacgcgcgatccgacgatcatcaccctcacggtcgcggtcgcgctgagcttcggccagggcatcatgttcggcaccggcgcggcctggatgtccgagctgttcgacgcgcgcctgcgctacagcggcgcctccctcggcttccaggtcggggcggcgctcagcggcggcttcaccccgctgatcgcggcggccctgctgacctggagttccggcgcgacctggccgatctcggtctacctcatcgcgctggcctgcgtgaccctgctcgccacgctcgccgcgcccgagacggcgcgccgggccatcgactga

SEQ ID NO: 7295 - DNA, 531 bp, Methylobacterium sp.
atgccccgcacgctcacacccgcggcgaccgcgctcgcctgcctgctcgtctcgctcgccctcctgccccgggccgccctggcggccgacgccgccgtgaacctgccctggggcgactggctcgtggccctcgcccagaccctgcaggcggtgctgacgccgatgctcatcggcctcgtcaccggcctgatcgcccgcttcgcgccgctcctcagctacgtcgtctcccgcgggatggtcgagggcatggtcgcccgcgtcaccgactacgccctgaacgcggtggcgggcgcggccaaggggcgcgtgctcaccgtgccggtgggctcggcggtgatcgccgccgccgtgcagcgcgccgccgaccaggtgccgggcttcgtgatccgggccgcgggcggcctgccgggcctcgccgagcgggtgttccgccgcctcgacctggaggagggcgccaccgccgccaacaccctggcgccggccctcgacgcggtcggacgcccggtcgggcgcgggcgcgccgcacgctag

SEQ ID NO: 7296 - DNA, 1206 bp, Methylobacterium sp.
atggcgcccatcatcacgacgatcgaggatctgcggcgggttgccgggcgacgcgtgccacggatgttctacgattactgcgattccggttcgtggaccgagtcaacctatcgcgccaacgaggccgattttgccgggatcaagctccgccagcgcgtggcggtcgacatgtccgatcgctcgctcgccacgacgatggcgggtcagcctgtcgcgatgcccgttgccctggcgccgacggggctgacgggcatgcagcacgccgacggcgagatcctggcagcacgcgcggcggaggaagcgggcgtgccgttcacgctctccaccatgagcatctgcagcatcgaggatgtggcggagaacgtgaccaagcccttctggtttcagctctacttcatgcgggaccgcgccttcaacgaccggctcatcgaccgcgcgaaggcggcgggctgctccgccctggtcctcacgctggacctgcagatcctcgggcagcgccacaaggacatccgcaacgggctctccgcaccacccaagctgaccctcggcacgacgctgaacctcctcaccaagccgcgctggtgctggtccatgctccgcacacagcggcggaccttccgcaacatcgtcgggcacgtcgagggcgtgcgggatacgcgttccatctccgcttggtcggcggaccagttcgacccgcgcctcgactgggacgacgtgcggcggatccgggatcgctggcagggtcccctgatcctgaagggaatcctggatgcggaggacgccgagaaagcggccacgaccggggccgaggcgctgatcgtctcgaaccacggggggcgccaactcgatggcgcaccctcgtcgatcgccgcgctccccgaaatcgcggacgcggtcgggtcccgcatcgaggtgctgatggacggaggcattcgctccggccaggacgtgctgaaggccgtcgctctgggggcgaggggcgtctttatcggccgcgcctttctctacggactcggcgcctatgggcaggccggcgtcgccaagtcactggcgatcatccgccaggagctcgacaccacgatggcgctgtgcgggcatcgcgacatccgcgccgtcgaccgctcgatcctccggacgccgcccgtgcgggaggtcggcccggacgcccagatcagggcgccgctccagcggtccgccgcctcgtga

SEQ ID NO: 7297 - DNA, 1344 bp, Methylobacterium sp.
gtgaggctcgcgcaccgcctgcgcgcgatcctcgggccgcgctcgctccagcgccggctgctgatctcagccctcggcctcgtggtcgcggccctcgtcgtcgcgggcctctcgatcggcttcatcctcgatcgcttcgtccgcggccagatcgacgggcgtctcgacgaccgggtcctggcgctcgccgagcgccagggggagccggcgccggatccgccgcccttcgaccggccccgctcgggctggtactggcaggtccgccagggcgaccgggtcctgcgctcggcctccctggagggccgcgatctcgtcctgccggagcgggagcccggcccgcgccgggacgggcgccctcggcccgcggagggcacggggccctggggcgaggcgctgatcctgcgcgtcctcgtccggccggccgcggggggcgggtcgccgtcggtcgtcgcggtctcggcgccgagagccgccctgcgcggccccgtccgggaggcgctgcaggcgctcgccctcagcctcggcctgctcgggctctttctctcggccggcgcggtggcgcaggtgcggctcggcctgcgccccctcgcgcgcctgcggcgggacttggcggccgtgcggacaggccagcgcacgcacctgccggccgaccagcccgccgaggtcgccgggctcgtgcgcgagatcaacgccctgctcgatcagaacgcggcaaatctcgcccacgcgcgcgcccatgtggcgaacctcgcgcacggcctgaagacaccgctcgccaccctcggcatggcggtcgccgaccgggacgcggatcccgacggcgccctcgcccgcctcgtggcggatatggatcggcgcgtgcgccaccacctgcgccgcgcccgcgtcgctgccgtcgccggcccatcgcggacccgcgttccgctcgcgccgaccgtcgccgacctggtcgcggtgctcgtccgcctgcatgccgacaagggggtcgcgatcgagacggccattccctccgagctcgtggtcgcctgcgacagccaggatctcgacgagatgctgggcaacctcgtcgagaacgcctgccaatggtgccgccgcacggtccgcatctccgccgccgcggagggcgcccatgtgcgcatcaccatcgccgacgatgggccgggcctcacacgggacgaggccgcgaccgtgctcgcccgcggccgccgcctcgacgagagccttccggggcacggcttcggcctgccgatcgcgcaggaactcgccgaactctacggcgggcatctcgagctcgggcgcgcggacttgggaggcctcgcggtgcggctgaccctgccggcgtga

SEQ ID NO: 7298 - DNA, 1212 bp, Methylobacterium sp.
atgctcgacagacgcgatctcatcaggcgggcgggcctcaccgccctggcgggcctcggcggtggcactttcgcgtccttgcgcacgctcgcgggcgacaacgccacgctgcccttcggcaacggcgaacggcccctggtggcctatccgggcaagcgcccgctgctccagatgaccgcgcgtccgccgcagctggagactccgttctcggtgttcgacgagggcgcgatcacgcccaacgacgcgttcttcgtgcgctaccatctcgccgacatcccgaccgagatcgatcccgagacctaccgcgtcgcgatcaagggccatgtcgagcgggaggtctcgctctcgctcgccgacctgaaggcgatgccgacgaccgagatcgtcgcggtcaaccagtgctcgggcaattcccgcggcttcttcgaaccgcgcatggccggcgggcagctcgccaacggcgccatgggctgcgcccgctggaccggcgtgccgctgaaggccgtgctcgacaaggccggggtgaaggcgggcgccgtggaggtcgccttcaccgggctcgacggcccggtgatcccggagacgccggacttcgccaagtcgctcaagctcgaccacgcccgcgacgggcaggtgatgctcgcctggggcatgaacgggcaggacctgccctggctcaacggctatcccctgcgcctcgtcgtgccgggcttctacggcacctactgggtcaagcacctggagagcatcagcgtgctcgacaaacccttcgacggcttctggatgcagaaggcctatcgcatccccgacaacgattgcgcctgcaccgagcccggcaaggcggcggacaagaccgtgccgatcaaccgcttcacggtgcgctccttcctgaccaacctgaccgacggggcgcaggtgaagtccgggcgcacgcccttgcgcggcatcgcctttgacggcggctccgggatcaaggcggtggcggtctcgaccgacgacggcaagacctggacggaggcgcggctcgggcaggatctcggcccctacgccttccggccctggaccctcgacacggacttgtcgccggggacgcacgcgatccgggtgcgggcgaccgccaacgacggggcgagccagccgatggagccgcgctggaacccggccgggtacctgcgcaacgtggtcgagaccacccgcgtgcgcgcggcctga

SEQ ID NO: 7299 - DNA, 1188 bp, Methylobacterium sp.
atgtcggttgcgtcctggtctggttctctgttggcctgggagcgggagttgacagcgctcaaggatcgcatcgggctgtgcgtgcggcggcgtgagttgcgcacgtcgatcgggtactacctcgatgggcttctctctggcgtcgagcgcaagacgggctggcttctcgccgagcgcgcgggtgaagcccggccgcatcggctacaagccgtgctggggcggggacgatgggatgcggaggcgacgcgcgatctggtgcgcgcctacgtcgtcgaagccctggccgatcctgacgcggtgctcgtggtcgacgagaccggcttcctgaagaagggcgtgcactccatcggggtggcgcggcagtactccggcacggccgggcggatcgagaattgccagatcggcgtgttcctggcctatgccagccgctacggccaggcgctgatcgacaggcagctgtttctgcccgaggcctgggccgcggatcaggcccggcgggccaaggccggcgtgccggaggcggtggcgttcgccaccaagcctacgatcgcgcgcgccttgattgccgccgcgctcgatgccgggctgccctgcgccttcgtgctggccgacgcgctgtatggatcggacaagcggctgcggatgatgctggaggcccgcgcgcagccctacgtgttgggggtgcgcagcaacgagcgcctgatgacgatggagggtggctttgcgacccaggacgcctctgccatcgccgacgcgttgcccgcctccgcctggcatcggcacgcggccggcgaaggggcgaaggggccgcggctctacgactgggcacgggtgcgcctggctcgcctgcaagcgccgccctgggaccactggctgctggtccggcgcagcttacgcgagccgtccgagcgcgcctattatgtcgtgttcgcacccatggagacgccgctggccgaactggccggggtggccgggctgcgctggaccatcgagacctgctttggcacagccaagggtgaactgggcctcgaccactgcgaggcgcgctcctgggacgggtggcatcgccacatgacgctatgcatggccgggctcgccttcctcgcacggctgcgcactacgttggtgcgcggcgcggctggcaaaccgaacgaaaggagtccagacaccgtcgccgaggccgcctga

SEQ ID NO: 7300 - DNA, 330 bp, Methylobacterium sp.
gtgacgacgatgacccgcatcaccctcgccctggcggcggcgcttgccctcgcgaccggcgcggcgctcgccgcgccgaaatcctacgcggtgccggagccgaccgcggagctgcgggcgccgaaggccggcacgcacgcggaaggcttcgaggcggcccaggcgaactgcctcgtctgccattcggtggactacatcgcgatgcagccgccgggcaaaggcgcggccttctgggagtccgaagtgaccaagatggtcaaggtctaccacgcgccgatcgacgaggcgcaagccaaggccatcgccgcctacctcgccgacacctactga

SEQ ID NO: 7301 - DNA, 471 bp, Methylobacterium sp.
atgctgcgcctcgccctgcccgccctcgtcctgctcgccggcacgctgcccggccacgcgatcgaggtgcagaagtcggccgatctccccgcccatcccgacaaggtctggcagacgatcggcgacttctgcggcatcgccgactggcatccggcgatcgagaaatgcgtcgcctccgagaaggatggacagaagatccgcacgctcagcctcaaggggggcggcacgctcgtcgagcaacaggtctcccgcgacgacaaggtgatgagctacacctacaccatcctggagggcccgctcccggtctcggattaccgctcgacgctggcggtcgcgcccgagggttccggctccaaggtgacgtggcagggcagcttcggtgccaagggcgtgccggacacggtcgcgcaggacgtgatctcggggatctacgacgcgggcctgaagggcatcgccggcaaggtgaagtag

SEQ ID NO: 7302 - DNA, 345 bp, Methylobacterium sp.
atgcgttctgaacggggccggcgcgccctggtcgacatccgcgagaacgccgcgacggcgctcgccttcgtggacgatatgtccgtcgcggccttcgaggccgaccggcgcacgctctacgctgtcgtccgctgcctggagatcgtctcggaagccagccgccggctcgatccggccgtcatcgaccactatccgcatatcccttggcggcaggtggccgacgccgggaatgtctaccggcacgcctacgacaacgtctcgccacgcatgatctggcaaacggtgcacgaccgcatgcaggagatcatcgcggtctgcgacgcggaactcggccgcctgccctaa

SEQ ID NO: 7303 - DNA, 1236 bp, Methylobacterium sp.
ttgagcgcgaccgcctccgtccgggccgcggggctcgtggccgagctgcgcccgctggcgccattcttctgcctgtacgtgaccttcggggccacgctcggcttcctctccgggggtgcgccgctgatcctgcgcagccgcggcatggagctcgccgagatcggcctcctgcagctcatcaacctgccggtcggcctgaccttcctctgggcggctctgctcgactgggtccgcctgccgttcctcgggcaccggatcggctggatcaccctgacgctcggcctgaccgtcgcgctgctcgccgtgctcagcctcggcgagcactggcccctcggcgtgctgctcgcgctggcggtgctcgccgccgcctgcatcgccacgatggacatcgcgctcgaggcgctggtggtcgagacggtgccggcgcggcggcggacctacgtcgcctcggcgaagctctgcggcgcctccctcgggggcatcctcggcgtcggcgtcctgctcgggtcctacgacacgctgggctggcggggggcggtgctggcctgcgccgccctcgacgcgctctgcctgctgccgatcctcgcctatccggaggcgcgcctgcgcggagcgggcggcgcgccgccgcgctgggcgggttccttcgcccgcctcgggggcctcgtcgcgccgatcctggcgctcggcgcctatttcgcggcggcctatctcgtgtccgggcccaacaccctggcgctgctcgatctcggcgtgccgctggcgcaggtcggcttcctgacggggaccgtcctgccggtcgtcaacctcgtcatggcggttctggcggccccgctcacggcccgtttcgggaccgtccggctgatcctggcgggcggattcggcgtgctcgcgaccggcggcctgatggccctggcctgcgcgtccggcgcggccgggctcgcggtcggcgccaccgtcctgaacttcctctgcgggggcatcctcggcgtgccggtgttcaacatgatctatcgctgggcccaggggccgcagcccgccaccgactacgcgctgctgttcggcgcggccttcttcgccgcgatgcccctgcgggtggcagcccccgcgctcgccggctgggccggctggcccggctacttcgcgggggcgatgccggtctacggggcggccgtggcgtggctcgccctcgtggtcgcccggaccctgcgggccgacccggcggacgcgcgatga

SEQ ID NO: 7304 - DNA, 297 bp, Methylobacterium sp.
atggattgcgccaccgccttgcagatcctgcgtacgcacgaatcggatctccgcagccgcggcgtccggcatgccgggctgttcggctcgacggcgcgcggtgaggcgggaccggacagcgacgtcgatctgctgatcgagatcgacgaggacagggttcgggacgtctacgcctacgtcgccgtcgtgcagttcattgagggcctgtatccgcggcgggtcgatgtcgccaaccgtgcggccctgaaggccgaggtgcgtccgcacgcgctacgggacgtcatcgatgcgttctga

SEQ ID NO: 7305 - DNA, 282 bp, Methylobacterium sp.
atgcagtcggccgagaagatcagcatcacgatgacggcggaccagctccgggccgtgcgcgagagcgtcacggcgggtgagtacgcctccaccagcgaggttctgcgcgacgccgtgcggctctggctgcgccagcgtcgggaagacgcggagcgcctcgacctcatccgggcgcgcctgcgacgctccctggacgatccgcggccctctctgagcggcgaggaggtccgggacagcctggagggcctgttcgcgcaggccaggcgcgacggaacgtcgtga

SEQ ID NO: 7306 - DNA, 1413 bp, Methylobacterium sp.
atgcgccgtcaccgctacgccaagatcgtcgccaccgtcggccccgcgaccaacacgccggagatgctgaaggccctgttcctggccggcgtcgacaccttccgcctcaacttcagccacggggtccaggcggaccacgcgcgggtccacgccgcgatccgcgctctggaggccgaggtcgggcgtcccatcggcatcctgcaggacctgcagggaccgaagatccgcgtcggcaccgtccgggacggccggctcgatctcgcctccggcgagcgcgtccgcttcgtgctcgaaggttcggacggcggcaaggacgcgatcccgctgcatcatcccgagatcttcgccgccgtcgtaccgggacaggacctgctcatcgacgatggccgcgtgcgggtgcgcgtcgtcggaatggacgctgccatgatcgaggccgaggtcgtcacgggaggggtgatctcgaaccgaaagggcgtgaacctgccggggaccctgctcgacctctcgccgctgacggcgaaggaccgcgccgacctcgccttcgggctcgagctcggcgtcgattgggtggcgctctccttcgtgcagaagccgtccgacgtcatcgaggcgcgtggcctgatcggcgaccgggccggcatcatgaccaaggtcgagaagcctcaggcgctggagcggatcgaggacatcatccgcctctcggacgccgtgatggtggcccggggcgacctcggcgtcgagatcccgcacgaggacgtgccgggccgccagaaggagctgatccgggcctgccggctcgcggtgaagccggtcgtggtcgcgacgcagatgctcgactcgatggtcacggcacctgctccgacccgcgccgaggcctcggacgtggcaaccgcgatctacgacggagcggacgcggtgatgctgtcggccgagtcggcgacgggccggtacccggtcgaggcggtcgcgatgatggaccgcatcatccgctccgtcgagggacacaaactctaccactcgatcatcgcggccctggagcccggcgaggaggagaccccgcctcatgcggtcgccaccgccaccgccacccttgccgaggcggtccatgcccgcgcgatcgtcgcctacacggagagcggaacgaccgccgcacgggttgcccgcaaacgcccggccgtgccgatcctggcgctgaccccgaacatcgcgacgtcgcgtcgcctcagcctgctgtggggcgcccacagcgtccgcacggacgatgtcgacagttacgaggcgatgaccgccaatgcgtgccgccacgcgcaggaggagggtttcgccaagaccaacgacatcgtcgtagccgccgcgggcatcccgtttcataccaccggcaacaccaacaacatccgcctcatccagatctga

SEQ ID NO: 7307 - DNA, 1557 bp, Methylobacterium sp.
atgaacctcgacgggatgcggctctacgcggggaccgaccccgtcgatgcggtggtgatcggcacgggggcgggtggcgcgcccgtgctcgcgcggctggccgaggcggggctgaaagtcgtggcactggaggcggggccgaacttcgagccgggccgcttcgccttcgacgagacgctggccgacgagatctattggaccgaggagcgtctcagcggcggcaccacgcctgaggctttcggggccaataacagcggcaccggcgtgggcggctcgaccctgcactggggtgccttcgtgccacggcccgatgcccgcgatctcgcgctcaacgcggagaccggggagggctgcgattggccggtcggcctggaggagctcgtgcccttctacgagcgggtcgagcgcttcatcggcgtctcgggcgcgaatccctatccctgggacccgggccggcgctacgggctgccgccggtgccgcgcaacggtccggccgacattatggctctggcctgcgggcggctcggcatcggtgccgccgatgcgccggcggccgtcgtctcacgtcccttcccgcaggagggcgggccggagcgggaggcctgcatcaattgcggctactgccatcagggctgccgcaacggagccaaggccagcatggacgtgacctacctgccctacgcgctccgctacggcgccgaaatccggccgggcagcatcgcgcacgggttggagcgggatgcggccgggcgcatcaccgccgtgatctaccggcgcgacgggatcgaccaccgccagcgctgcggggcggtcttcctctgcgcgggcgccgtcgagacgccgcgactgctgctgaacctcggactcgccaattcgagcgaccaggtcgggcgcaactacatgggccatgtggcgacccaggtctggggcagcttccccgatccgatccgcatgaaccggggctatccgtcctcgctgatcaccgaggacatggtccggccgcgggacgccgatttcgcagggggctacctcgttcagagcctcggcgtgcagccgctgacgctggccaacgcggtggcccgcacccgcggcctctgggggccggcgctccacgcctgcctcgacggctacaaccatcttgccggcatcggcatcaacggcgagacgctgccctgcgacgagaaccggctgacgctctcggacgagaccgacgcgctgggcttgcgcaaggcccatatcagcttcggctacggcgagaacgagcgccgcctcgacgcccacgcgaccgcgctgatgcgggatctctgggaagcggcgggcgcgcgggacatctgggttctggaacgcgtcgcccacacgatcggcacctgccggatgggccggagcggcgacgcagcggtggtcgatccctatggcaggagcttcgacatcccgaacctctggatcagcgacggctcgaccttcccgagctcgctcgcggccaaccccgcactcaccatcatggccctggcactccggagcgcggaggcgttcctgaagcgggcgggggacgcctga

SEQ ID NO: 7308 - DNA, 1194 bp, Methylobacterium sp.
atgagcgagcatctcagcgcgctgaagatcccgcatatcgtcctggagcgcagccggatcgcggagaactggagttccatgcgctgggactcgctcgtggccaacggacctgcttggcacgaccggtttccgaacctgacgttcgaggacgtgcatccggacgcatttccgaacaaagatcgggtcgcaaaatacttcaacgattacgctgcgatgatcaaggcgcccatccggacgggcgtggacgtcaagcacgtcaagcacagccagggtcgtccgggctataccgtgacgacgtccgacggcatcttcgaagcccgacgtgtcgttgcggcgaccggcccgttccaggtcccgtcattcccaagcatcgtccccgccgatgccgcggtcgaccagttgcattcctcgacctacaagaatcccggtcagctggcggacggagccgtgctggtcgtcggatgcggcgcttcgggctcgcagatcgccgaagaactctgcaaggccgggcggaaggtctacctgtccgtcggcgagcattatcgcccgccgcgcgcttatcggcagcgggactattgctggtggctgggggcgctcggcctgtgggatgaagtcaagtcgaagcggaagaagaggcacgtcgccttcgcggtgagcggttacgagggcgggcggaccgtcgacttccggcgcctcgcccatatgggcgtgacgctcgtgggcgtgacgcgctcctacgagaacggtacgctccacttcgagaacgacctcgtgaggaacgtcgccgagggcgacgaggcctatttcgaagtcctgcgggacgccgacgcctatgtcgagcgcaagggcctggatctgccgccagaacccgaggcgtggcagcgcttcgacgacccggactgtctcaaggagccgatcctcagcctcgacgtgaaggattccggcatcggcaccatcctctgggcgaccggcttcaagtacgacttcagctggttggacgtcgacgcgttcgacgagcagggcatgcccctgcacaagcgtggcgtctcggcggagaacggcatctacttcctcgggcttcccgacctgacgaaccgtgcctcggctttcatctacggttgctggcaggacgcgaagcacatcgccgaccacatcgtgatccagcgcaactacgacgcttacacccgggcctag

SEQ ID NO: 7309 - DNA, 324 bp, Methylobacterium sp.
gtgacgaggctgccggtcgcgtatcggccggaggcgcgggaggatctggccgcggtgttccgcgccgtcctcgacgtcagccggaacgccgacgtggccgagcgcttcgtgcgccggatcttcgagcgctgcgagcggatcggcgacgcaccccacgggggccgcccgcgcgacgacttggaacccgggctgcggacggtgccgttcgagcgctcggccgtgatcgcctaccgcgtcgagggcgaccgggcgctcgtcgtcaacgtcttctatggcggtcgtgacttcgaggcgctttaccgcgacgatcgcggcgagacgtga

SEQ ID NO: 7310 - DNA, 576 bp, Methylobacterium sp.
atggcgctggaggagaggttggccgccctgatgcgcgcggggcaggcaggcgacgcggatgcctaccgcgccttgctccgggcgtgcctgccggtgatccggacggcggtgcgcgcgcaagggctgcgcggcgaggccgtggaggacgccctccaggacacgctcgtgaccctgcaccgggcgcgggcgagctacgatccggcgcgggccttcctgccctggctgcgcgccatcgcgcagcgccgggcgatcgacagcctgcgccgcgccggacgccgcccgcgggaggtgcacgacccggccgcctacgagggcgagcccgatgcccggcccgagcccggcgaggacctggaggcgcgcgagcgcgccgccgaactcgcccgcgcggtggcggccctgcccgccggccagcgccaggccatcgaggaactggcgctgcgcgagcgctccctcgaggaggccgcggcgatgaccgggcgcagcaagggcgccctgaaggtgaacctgcaccgggcgatcaaggccctgcgcgccagcctcacgaccggcccgggcgcgggacgtccgggagcgtag

SEQ ID NO: 7311 - DNA, 840 bp, Methylobacterium sp.
atgccccatcccgcgatcagccccggccgcgccgcggtggtgacgggtgccgcgagcggcatcgggctcgccgctgcgaaggccttcgcgcaggccggcatgaacgtctggctcgccgacctgccgggcgaggcgctggaggcggcccgcgccgaggtcgccgcgctcgccgctgtcgaggtgcgggcggtgcccaccgatgtcgggcggcgcgaggccgtcgagcacctgcgcgacgcggtcgcccgctcggggccacccgcaatcgtgatgctgaatgccgggatcgaggccggcgggcgcctgttctcggatgcggagacgtggacccgcatcctcgacacgaatctctggggcgtgatcaacggcgtgcaggccttcgcccccggcatgatcgcgggcgggcagccgggcgccgtcatcgtcaccggctcgaagcagggcatcaccacgccgcccggcaacacgccctacaacgtctcgaaggcaggcgtgaaagccctcgcggaagcgctcgcccacgacctgcgcggccgggagaactgccgcaccagcgcccacctgctgattccgggcttcgtctatacgggcctcacccgggcccgcggggtggaagagaagcccgcgggcgcctggacgccggaggagaccgtgcgcttcatgctggagcggctggaggccggcgacttctacatcctctgcccggacaacgagaccacgcgggcgcaggacgagcgccgcatcgcctgggcggccggcgacatcatcgagaaccgccccgccctgtcgcgctggcacccggactacgccgaggcgttccgggcgcacatggagcgctga

SEQ ID NO: 7312 - DNA, 450 bp, Methylobacterium sp.
atgtcctccgaatcgggcgatccgccccccgatccctctcgcgatccaccctgcacctgcacggccctgcgccgggccgcccgcgcggccaccgcgtcctacgacgcggccctggcgcccgtgggcctgcgggtgacgcagttcgcgatcctgcgcatcctcgcccggctggggccgctgccggtgacccggctcgccgaggaggccgcgctcgaccgctccaccatggggcgcaacctcgacccgctggagcggcgcggcctcgtgcggctcgcgcccgatccgcgggacgggcgcgcccgcgtggcgcggctgaccggggaggggcaggcggcgatcgcggccgccctgccgcactggcgcgccgcggaggcccggctcgggggccgcctcgcccccggcgcgctggccgccctggtcgccgcgctcgcgcccgctccgcacgcctga

SEQ ID NO: 7313 - DNA, 486 bp, Methylobacterium sp.
atgccccctgccgaagcggccgggccggcgcgcgcacgtgccgagaccgtgaagaaggccggcggtgcgccgctgatcccgagcccctgccactgcctcgccatccggcaggcggcgcggcacatgacgcagttctacgaccgcttcctcgccgtctcgggcctgcggacgacgcagttctccgtgctggcggtgctcgaccggaccggcccgctggccgtgaacgagctcgcgttgcatctcgtgatggaccgcaccgcgaccggacgggccctacggccgctggcccgcgacgggctggtggagattgggccgggccgcgacggccgcacccgctcgctgagcctcacgccgacgggccgggccaagctggaggcggcccgggccctctggcggcgggctcagacggccttcgaggcgcagtacggtgccgcggaggccgatatcttgcgcctctcgctcgcccgggtggtcggccgggcctga

SEQ ID NO: 7314 - DNA, 2253 bp, Methylobacterium sp.
atggaggtgagagtgcagcgctcgctctcagagttggccgcgccgctgcgcgacgtgagccggtggaaccgtctactcagcctgccgtcggatcggcgaagcgggtatctcagcttcgtcgaaccggcctgtgcggttcgcgacgcgctgtcctcgggcgagcgggtcgctctgcgtgagcctgtcctggcgctgcgcgacgactggtcgagcgcagcgccagggctgctcggggccgaggaggcagcgaggcgcctgcggcggctcgatgacctggcgcgcgacatcgacgaggagacgggcgtgagcccgctgatgctcgggttggggctcgtgctctggcgcgacggcgagcgcgtgcgggtggccccgctgatgctctgcccggtggtgctcgacggcttgccggaggcgccaagcctgcgccgggccggggtgccggtgggcaatccggtcctgttcgatcgcctcgggatcgatccggaccgtctgcggccggatccgctgacctggacggcggaggatctcgccgggcacggggtggtgtcggtgacgccggtggcggtgctcggcctgttcgacgtagtgcgctatcggcagtggcagcggctcgatgcgcgccgcgatccgcgtctggtgcgcgatccccgcattctcggtctcctctccggcggccgggaagggagctggcgtcagctagctgagcccacatcggcgggggcaacacggatggtcgcctcgctcgatcgcagccaggagctggtggtccaggcgagccgggctggcctcgatctcgtcgtccaggggggaccgggcacgggcaagactcaggcgatcgtgcacatcctgggcaacgccctgcgggacgggcgcacggtgctgttcctgagcgggcgtcagagcgcgttccggtctgcgcgggagcgcctgaaacggttcgtgccggaggcgtgctggctggctctctacgggccggaatgcagcacttctgtcgtggccgggcgtctcggggtcgcacccggggagacggtgctggatacggctcgccgcgcgacgcgacggccgccactggtgatggcaacacccacgagctacgcggcccatctgccggcggactggatcttcgatcttctggtcgtggacgaggcctcgctggtgccgctggccgaggcgctgccggccgtcgcggcctgtcgtcagatcgtgatctgcggcgacagccagcagatgcagaaggacccgccgctctgggtcctgttcgacccggacaatccttacgtgcccgccccgacgttgcttgatgcagcggaggcagccggggctccccgcacgaggctgacgcatcattaccgctccctgcatccgacgctgatgcactacaccaaccggatgttccaccgcgggctgatgcgcatgagtgtgagccctgtcgcggaccgggagcgcgggctgcgcctggtcacgctcgacgggacgttcgacgggcgcgccctgaccaacgcggcggaggccgaggcggttatcgacgagctggcgcggcacgtggccaccgggagcacggcgtccgtcggcgtcatcgcgatgacgatgcagcagcgcgacctgatccggaggcggatcgcggagcgggggctcgatctcgagcctgtatcacgtacggcgccggtgctggtcgccgactacaacggcgttcagggcgaggagcgggacgtgatcctgatctcgctgaccttcgggcggcggccgggcaatggggcttggccgacgagctacggcgcactctcgctgccaggcggagagaagcggctcgccgtgatcatgagccgggcgcgcgagcgcatggtggtgttcgcgtcgtttccggcagaatccatcgatgcaagcctcgcggccgggcacagcgcgcttctcacctacctgatgagcgcggcgcggcagcacgaggacgatccgcggccctacaagggcgtgctgtcgggggtgctcgatcgcaacagctggcagggtttcgatctcggcaacgcgatcaaggtggtgagcgggaggacgggccggacgctggccgcgatctacgtcacgggcgtgatcgacgcgctcaccgagcgctccgagatcgcccagtaccgcaacgccggctggttggtactggaggtggacatcgcggaggcagaggctgccgccgccgacgacaagcatctcgcggcgctctgcagccgtctctggcggcagcagcggacgcccgtggcgacctga

SEQ ID NO: 7315 - DNA, 669 bp, Methylobacterium sp.
atgaaggttctgctggtcgaggacgatgcgccgctcgcggccgagatcgccaaggtgctgcgggcggagggcttcgccctcgatcaggccgccaccggcgaggacgcgcagcatctcggcgagaccgaggcgtacgacgccgtggtgctcgatctcggcctgccgcggggcgacgggctctcggtgctccaggcttggcgcggggcgggccgcacgatgcccgtcctgatcctgaccgcccgcgacggctggagcgacaaggtcgcgggcttcaaggccggggccgacgacttcctggtgaagcccttccgcgtggaggagctgctgatgcggctgcgcgccctcgtgcggcgggcccaagccggcggcgcggcccgcgtggtctgcgggcccttgagcttcgatccgggcctcggaaccttcgagcgggacggtctgcccctgcgcctcaccgggctcgaatggcgcgtgctctcctgcctgatcctgcgccgcgaggcggtggtgccgcgcagccagctcatcgagcgggtctacgagggcgacgccgacgtcgattccaactccgtcgaagtcatcatcacgcgcctgcgccgcaagatcgccccggccggcatcgagagcgcgcgcggctacggctaccgcctcgtgccggcggacggcgcgtga

SEQ ID NO: 7316 - DNA, 642 bp, Methylobacterium sp.
atgtcgaacgagaccgcgaacgactccgccgcccccgcccggacggtgaagcccggccggcacaagcgccgcctcctcgccgccgccgccgtaccgctggcgctcggcgccgccggcctgtccctggcgcagaccagcaccctgacggcgcccctgacgcccgtcgccgtctccgccctggcgccctccgccgccgtggccgccaagggcgaggtcgccgagatcttcggcaacaagttcgtcctccaggacggcaccggccgggcgctcgtggagacgggcccggccggcgagagcggcaccctggtgaaggcgggcgagagcctgaccgtccaaggccgcttcgagaacgggttcctgcacgcccggcagatcacccgcgccgacggcacggtggtggccgtgggcccggcgggcggaccgcccggcggcctcgaccggctgcgcgagcgcgtcggcctcggcgcccagcccgacgccgaagccctcacgggccaggtccagcgccagggctacaccgatatccgcttcctcggccgcggtccccgccacttcgacgtcgtggcgaaggcccgggacgggcgcgagcggctgctccatgtcggattcgacggaaccatccgcgagaagccctcgctctga

SEQ ID NO: 7317 - DNA, 141 bp, Methylobacterium sp.
gtgctcgacgcgctggcgcgcgagcgtctcggccgtcagcttcaggccctctacgagcccgttctggacgagggcctggacccgcggctcgccgagctgctgcggcagctcgaccgcgaccgccagggcgaggagggctga

SEQ ID NO: 7318 - DNA, 714 bp, Methylobacterium sp.
gtgtctcagcctcagcaatccaccgttcgtaaccgcctgctgaaggcgctcacagccgacgacttcgcgctgctccagccacacatggagctgaccccaaccgagctgcgtcagccgctgatcaagcccaacgagccggtcaagcagctgttcttccccgaggtcggcttcagctcgatcaccacgtccggctctgagggaaaggtcgaggttgggatcatcggacgcgaggggctggtcggcgtcatacccatcttgctgggctcggatcgcacaccgcacgaccacttcatccagagcccgggcgaggtgctggccatcagcacggaggctctctgcgctgccatgagcaggagcgcgagcctgcacaagctcctgctgcgctttgcccaggtgcagtacgttcagacagcccagaccgccttcgtgaacgcgaccttccagatcgaggcgcgcctcgcgcgctggttgctgatgtgccacgaccggctggatggcgacgaggtgcgggtcacccacgagttcctgtcgctgatgctgggcgtgcagcgcactggcacaaccttggcggtgcaagcgctggagggccacaggctcatcaaggcgcagcgcgcccgcatcacgatcctggatcgtgcggcgctggagctggtggctgacgacggctacggcctgcccgaggccgagtacgcccgcctgatcgagggcgcctga

SEQ ID NO: 7319 - DNA, 777 bp, Methylobacterium sp.
atgcctgtgatcagctccgcacacggtggggatgagtccgcgataccgcgtcaatcagaggtcagaaaccggctgctgcgcgcgctcgatccggccgacttcgcgcgcctcgcgccgcatctgaggcccgtcccgctcccgctcgggtattccctgatcgcgccgaacgatccgatcacggtctgcgtcttcccggaggccggcttcgtctcggtggcgaccgcgcacggtcaacagcgcgtcgagatcgggctggtgggccgcgagggcctggctggcgccgcgcccgtcctgctcgcggatgcggcgaccccgcaggcccatgtggtgcagatggcgggctccggccttgccgtcgcgaccccggcgctccgcgcggcggcggacgagagcgcgagcctgcggacgacgctgctcgcctatgtccagacccagctgctccaggtcggcgagaccgcctacgcgcacgcggcgctgaacctggggagccgcctcgcgcgctggctgctgatgtgccacgaccgggtcgagggcgacgagctcgccctcacccacgagttcctgtcgatgatgctcggcgtgcagcgggcgggcgtcaccctggcgctgcagagcctggagggggcggccctcatccgcaatcggcgcaagcgcgtgctgatcctcgaccgcggcggcctggaggcgctgacccacggcagctacggcgcgccggaggcggcctatgcccgcctgatcatgcctcctctcacgcctcggcccgcggcgtcgcgttga

SEQ ID NO: 7320 - DNA, 642 bp, Methylobacterium sp.
atggcgcacgaccaccacgatcatgagcacccgcacgatcacccgcacggcagcgacctgacgccggtcgaggcgcgggtgcgggcgctcgaatcgctcctggtcgagaaaggctacgtggagccggccgccctcgacgcgctcgtcgagatgtacgagacgcaggtcggcccgcataacggcgcccgggtggtcgcccgggcctggaccgatccggccttccgggcgcggctcctcacggatgccacgccggcgatcgcggagctcgatatcggcgggcgcggcggcgagcacatggtggtggtggccaacgcgccgggcgagcacaacctcgtcgtctgcacgctctgctcctgctatccctggccggtgctcggcctgccgccggtctggtacaaggcgccgccctaccgggcgcgcgccgtgatcgacccgcgcggggtgctggccgagttcggcctgcacctgcccgagaccacccgcatcaccgtctgggattcgaccgccgagacccgctacatggtcctgcccgagcgcccggccggcaccgagggctgggacgaggcgcggctcgccgccctcgtcacccgcgacgcgatgatcgggaccggcctgccgaaagccctggagcaagccgcatga

SEQ ID NO: 7321 - DNA, 882 bp, Methylobacterium sp.
atggagcttcggcatctccgctacttcgtcgccgtggccgaccgcctcagcttcaccgcggcggccgagagcctcggcgtctcacagccgccgttgagccagcagatccgcgacctcgaacgggagctcggcacgccgctgttccggcgtacgagccggcgcgtggcactcaccgaggcgggcgcggtcttcctcgaccatgcccgcgcgatcctggcgcaggtgcaccaagccgccgaggccgcgcgctcggtgggggaggggcggaccggggtgatccatgtcggcctgaccggctcggtcctcaccgggccgctcggcggggtgatccgcaccttcgaggcgctcttccccgaggtcgaggtgcggctgcatcaggccccgcccgaggagcagcgcgcggccctgcatgccgggcggatcgatctctgcctgatgcgcgggccacccgaggatccggagctcgccgcggtgccggcctggtccgaggcggtcggcgtcgcgctgcccgccgcgcacccgctcgccgcgcgggacagcctagtcctgagggacctcgccggcgagcgctatctctcgctgcggcgcgcggattcccacttcgccaatatgctctgggccgcctgtctcgccgagggcttcgtgccgctcctggcgcacgaggtggtggaggcccaggcgctcctcagcctcgtggcggcggggctcggcctcgccctggtgccggagcaggtgggccggctcgcccatccgggcgtcgcctacaggccgctccgcgggtccgccccggccgccgacgtcagtgccctgcaccggagcccggcaagcccccgtgtcgcgaacttcctcgccgtgctgcgcgccgagaccggcggggcctga

SEQ ID NO: 7322 - DNA, 1485 bp, Methylobacterium sp.
gtgacgatcgaacaggccatcgccgcccgcggaggggagccatacccggccccggtcctctgcctgccccggggcggcctgcggcactggcacctgcggctggccgagggattgcgggccgcggggatgcacccgcgcgtcgcctggaccgagaccgagcccgcgccggccgggatggagacgctgttcgcgctggagcgcctgctccggccccgtcccggcccccgcccgagcgagcgggcccccgccgccggattgcccgaggctgacggcagcggcgtgcgcatcgtcctgccgggtgcggcggagggcggcgcggcgctcggcatcctgttcgacggccaccccggcgaggcggggctgctgcaggccctgctgcggggcggcgcgccgctggtcgagatcgtcgatggcggcgcggtgctcgcccaggggcggccctccctcgaggccgcggccaacctctgcgaggcctacgagacggtgacgatgcgcctcgcgcccctcctcgtctccgccctgctgcggccggcgcccgcggcgcccgcagccccccggctcgaccggggccgcccgctcgccgcgcacacgctgcggcgcctggcgcggatcctggcgcggcgcctctaccatctctgcttctacgccccgcactggcgcaccggctggcgcttcagccggggtgccacggtctgggacgccgcctcgctcggcggggagccctggcgggtcctgccggatcccggccaccgcttctacgcggaccccttcctgttccaccggcagggccggacccacctcttcgtcgaggatctcgaccaccgcacgggcaagggcgtgatctcggccgtcgccttcgggcccgacgggcccctcggcgcgccgaggccggtgctggaggagcccttccacctctcctacccgttcgtcttcgagcacggcggcacggtctggatgatccccgagacatcccagaaccgcacggtctcgctctaccgggccgatccctatcccgaccgctgggtgcgcgagcgcgacctcctcaccggcatcgtggcgagcgacgcgaccccgatccggttcgcgggccgctggtggatgttcgcgacgctgcacgacggcgcgggggcgcactcggacatgctgggcctgttcctcgccgacgacctgttcggaccctggcgcccgcatcccgccaacccgctgctggtcgatgcgggggcggcccgcccggcgggggccatgcgggtgcgcgcgggccgcctctggcggccggtccaggactgcacgcgcctctacggcggcgcgctcgccctggccgaggtgaccaccctgaccgagacggccttcgcccagacggtgcgcacccggctcgcccccggccccgcctggtcgggccgccgcctgcacacgctgaacgcggcggccggcctggaggtgatcgacggctccgccgccccgctccggctgttccaccggccgtga

SEQ ID NO: 7323 - DNA, 840 bp, Methylobacterium sp.
atgcaggccagaagcttcggcgccaccggcatctccgtcccggtgatcggccagggcacgtggcgcatggacggcacggagcgtgccgcgtccgtcgcggcgctccgcgccgggatcgatgccgggatgggccacgtcgacaccgccgagatgtacgacgacgccgagtcgatcgtggccgaggcgatcgccggcctgcgcgaggaggtgttcctggtctcgaaggtggtgcccggcaacgccacgcggcgcggcgtggtgcgggcctgcgaggcctcgctccggcggctgaagaccgaccggctcgactgctacctgctgcactggccgggccaccacccgctggaggagacgatcgcggggttcgaggacctgcgccgcgacggcaagatcctgtcctggggcctcagcaatttcgacgtggacgacctcgacgcggcgctccgcatcgccggcccctaccgcatcgcctgcaaccaggtgatctaccatctgggcgagcgggcgatcgagcacgcggtgctgccctggtgcacgcgcaacggcgtggcgctggtgggctactcgcccttcggcagcggcgagttcccggacccgtcgagcgcaggggggcgggtgcttgccggcatcgccgaggcgcacggcaccagcccctacggcgtggccctcgccttcctgacccggctcgacaacaccttcacgatccccaagaccgtgcgggcggcgcgcgcgatcgagaacgcggcggcggccgatctccacctcaacgcggccgagatcgccctgatcgacgcgcatttcccgcggggcccgcgtccgcgcacgttgccgatgctctag

SEQ ID NO: 7324 - DNA, 633 bp, Methylobacterium sp.
gtgttccccgaggcgttcatcgacggctatccgaaaggggccgacttccacatcgtgatcggatcgcggtaccctgaaggccggcgggagttcgccgcctatgcgtcgcgcgcgatctcggtgcatggcccggaggtcacgcgcctcgggcgagcggcgcgttccgcgggtctctacctcgtcatgggcgtgatcgagcgcgacggcgggacactctactgcacggccctattcttcggtccggatggccgtttcctcggcaaacaccgcaagacgatgccgacggcagccgagaggctctgctggggctttggagacgggtccaccttgacgactgtcccgacgccctgggggcccctcggcgcggtgatctgctgggagaactatatgccgctcctgcgcaccgcgatgtacggcaagggtatcgcgctctactgcgcaccgacggcggacgatcgcgatacctgggccgcctcgatgcgccacgtcgcgctggagggccgctgcttcgtcctctcggcctgccagtacctaacgcgcgaccgtttcccctctgacatgcgcaaccgcatacccgaggagaacggcgaactcttgatgcgcggagggagcttgatcgtcgatctgacctga

SEQ ID NO: 7325 - DNA, 1005 bp, Methylobacterium sp.
atgaccgatcgcaccccgctgccgcgccgcagaggccgcctcgtcccgcgcaggcctctgcggcgcggcctgctcgccgggctcctcgccgttgcgctggcggcgaccctcggccaccctgccctcgcggagccggtcttcccggccgcgggctcgctcggcctcgcaccgccgcccggcatggtgccgtcgacgcgcttcgccgggttcgagcacacgtccggcgcctcggtcatcctggtcgagatgccgcccgaggcctgggaccagatcgacggccggttcaccccggaggcgctcgccgcgaccgggttcagggtgcgcggcggccgggaagccctgccggtggcgggcggcgcgggcttcgtgctgcgcgggacccagtccgccaacggcctcacctacgccaagtgggttgcggtggtgcggggagagcccggcaccggcctcgtcaccgtgcaggtgcccgagacggccgcgaaacaggtgccgggcgcggccgtcgaggcggcgctccgcaccatcgcgttccggccgaaggccagcctcgccgatcaggtctccgccctgccctacgcggtcggcgacatggcgggctaccggccggtcgcggtcttcgccggcaacggcctgctcctgaccgatggtccgaaggacgtcgatccggcgcgcgagcagccggtggtggtcgtcgcgccctccctcggccaggcgccggtgccggagggcggggagatcgccttcgcccgcaaggtgttcaccgcgcagaaggacctcacggatgccgcggtgaccgaggaggcgcgctccacccgcggcggcgccgtcgtggtgcggctgcgcggcaccgggaccgacacgaggagcggccgcaccctcgggatgacgcagacgatggtcttcgcgggcgcgcgctacctgcgggtgatcggcttcgccgatccggcgcgggccgacgcgctggaccgggcggagcgcgtcgccgcctcggtcgcgatgcgctga

SEQ ID NO: 7326 - DNA, 2274 bp, Methylobacterium sp.
atgtcccagcccgcccgtctcgcagccctcgcctcgctgctcgtcgtggggccggcagccgcgcagcagagcgtcgagctcaatcagatctcggtagaggccacgaagccgaaggcgcgggccacggggcctcgcgtccgagcccggccgcagccggtcgagccgggatcgggcgggggcgacatcgtctcgggcggcccagtcggtccgggcgccgacagcgccgccaccagcggcggaggaggcggtccgagcggggtggtcggctacaccgccaagatcagccctaccgccaccaagaccaacacgccgctgatcgagacgccgcaatcggtgagcgtcgtcacccgcgagcagctgaacgaccgcaacgtgcagtcgctcaacgaggccctggcctacacgccgggcgcggccaccaacgtgttcggcttcgacccgcgcttcgatgccttctacatccgcggcttcgaggtgacatacaacggcatcttccgggacgggctgcggcaatcggcggtcggcttcgcggtgccgcgcatcgagccgtacggagcggaggccgtaacgatcctgcgcggcccggcctccggactctacggcctcggctcgcccggcggtatcgtcgacgtgacgacgaagcggccgagcttcacccggttcggcgaggtctggctccaggccggcagcttcgagcgcttccagggcaatttcgacatcggtggtcctgtggagggtaccgacaacacccttgcctaccggctgaccggcgtggtgcgccaatcagacaccttcctgcccggccccggcgtcaccgacgaccgcgtctacatcgcgccggccttcacctggaaaccgtcggccgacaccaccttcacggtgctcagcgagttccagcgcaacaacgtgccgggcaacgcgaccttcttcacctttccgaaatcgggcttcctcgtttcccgggtctactcgggagacggcgcgctcaacaactatcagaccgaccagtaccgcatcggctacgccttcgagcacaagttcacgcccgatctgatcttccgtcagaatttccgctactacggcatcaacgccgattttccctacgtccaagtggacaacgtggagggtctgcaagcgcagcgctcgaccggcttgctgcgccagtccctctattcctactcgatcgacaaccagatcgaggggcatgtccgcaccgggccggtcgcccacacgatcgtggcgggtctcgactacaatcacttcagctggttcaacaaagctggcttcggcctcgcgccggacctcgacctgaccacgctgaactacggccgccagttcatcccgcgcccggcctatgaccgcttctcgcgccagtcgcaggaccagatcggcctctacctgcaggagcaggccaagtgggaccgcttcgtccttaccctcacggggcggcacgactgggtcttctccgacaccaccggcaacacgcgcggcacgccgaccacgcccgtggaccagaccgacaccgccttcacctaccgggtcggcctcaactacgagctggcgccgggcctcgtgccctacgcgagctacgccaccaccttcacgccccaggtcggcaccagcacggcgaccggcaacgcctttcgcccggcgactggtgaccagctggaggcgggggtgaagctcctcgtgcccggcaccaatatccaggcgggcatcgcgggctttgagatcaaccagtcgagcatcctgcgcccggatccggggagcattgccaaccaagtggcgaccggcgcggtgcgctcgcgcggcttcgagatggaggctatcgccaatctcgcgccgggcacgaacctgaccctgtcttacacccatctcgacttccgcttcctgcagcagacctctctgctggtgccgggtcgggttctcgacggcaacaggctctccggcataccgggcgacagcttcgcgggcttcctgacctatctcttcccacccgcttcgcccctgcgtggcctgacgctcggcggcggcatccggttcgcgacgaacagcttcgccgacgacgagaatacacagcgcaacccgaccgtcacgctgttcgacgcgctcgtcgcctacgacttctcggccatcgacccgcgttacaaggggttcaacgcccaggtgaacgtgcagaacctcttcgaccgagactacaagaactgcttcgccggcctctgctatcgcggcgcacccgccaccgtgatcggcagcctgatctatcgctggtag

SEQ ID NO: 7327 - DNA, 984 bp, Methylobacterium sp.
atgacggtgggcatccgcgatgtggcccgcgcggcgggcgtctcgaccgcgacggtctcgcgggcgctcggccgcggcccggtgagcgacgccctgcgcgagcaggtcgaggcggcggtgcgcgccaccggttaccggccgaacctctcggcccggcgcctgcgctcgcaatcggcccagaccatcggcctgatcgtcgccgacatccgcaatcccttcttcaccgcggtcagccgggcggtggaggacgcggccttcgccaagggcatgcgggtgatcctctgcaacaccgacgaggatcccgcgcgcgaggcgatgtacctgcgtctgatggaggaggagcgcgtcaccggcgtgatcttcgcgccgacgggcgccgccgccgatgcgctgcgcgcggagccccccgcctttccggtcgtgctgatcgaccgcgccgggccgcccggcgcccacgacagcgtggtgctcgacaaccctgcggcgggcgggggcctcgtggaccacctcgtcgaccggggcttcgcgcggatcggcggcctgttcggctcgacgagttcgaccgcccgcgagcgccgggccggctacgaggcggcgatggcccggcatggcctggaaccgcacgtccgcgccgtggcgccgaatgccgcggccgccgaggccgccgccgcccgctggctcgccgagcccgaccgcccagaggcgctggtgctctcgaacggcctgatcctgatgggcgcgctgcgcgccgcgcgcacgctgggcctgcgcgtgcccggcgacatcgccctggcgggcttcgacaacgagccctggacggacctcgtcgagccgggcctcaccgtggtcgagcagccggtggacgagatcggcgcccaggcgatgcggctgctcttcgagcggatcgcccagcccgaccagccggtgcgcaaggtggtgctgagcggccggaccgtgctgcgcggctcgacccggcgcgggtga

SEQ ID NO: 7328 - DNA, 705 bp, Methylobacterium sp.
atgcttgagattcgcgatctcgtctgcggctacggccacgtcactgccctcaaggggctcacgatcgaggtgcgcgaggggcagctcgtcgcgctggtcggcgcgaacggagcgggcaagtccacgacgctccgggcgatctcggggctggtctcgccgcgttccggcacgatccgcttcgagggccgcgacatcgcgggcgccgagccccgccgcatcctggccgagggcatcgcccactgcccggagggacggcgcgtctttccgcagatgagcgtcgccgagaacctcgccatgggggcgtatctgcgccgcgaccgggcgggcatcgtggcagatctggagcggatctacggggagttcccgcggctcgccgagcgccgcgatcaggccgccggcacgctgtcgggcggcgagcagcagatgctggcgatcggccgcgcgctgatgggccggcccaagctcgtgctcttcgacgagccctccctcggcctcgccccgaacatcgtcgagcggatgtttgcggtgatccgcgcgatctgcgacgccggcaccacggtgctgctcgtcgagcagaacgccttcgcggcgctcgaattgtgcgaccacgcctacctgctcgagaccgggcgcaccgtgctcgaagggtcgggacaggccctcatcgccgacccgcacgtgcgggaagcctatctgggtggctga

SEQ ID NO: 7329 - DNA, 723 bp, Methylobacterium sp.
atgcttgaggtctccggactgtcggccggctacggccagatcgaggttctgcacggcctcgacttcgcggtaccgaagggtcaggtggtcgcgctgatcggctcgaacggggccggcaagaccaccacgatgcgggccctctcgggcatgatccggccgcgggcgggctcgatccgcctgaacgggcgcgagatcggcgggctcgagagctacgacgtcgcccgcttcgggctggcccactcgccggaggggcgccgggtcttcccgacgctctcggtggaggacaacctgacgctcggcgcctttccgcggctcaccggtgcgcggccgaagggggacgtcgcggccgaccgcgaccgggccttcgagctgttcccgcggctcaaggagcggcgcacgcagctcgccggcaccctgtccggcggcgagcagcagatgctcgccatgggacgcgccctgatgctgcgcccggagatcctgctcctcgacgagccctcgatggggctggccccgaagctcgtcgaggaggtgttccggatcatccggcagctcaaggccgatcaggtgacgatgctcttggtcgagcagtttgccatggcggcgctgggcgtcgccgaccacgcctacgtgctggagaacggacgcatccgcttccagggaccggcgcagcagctgcgcagcgaccccgcggtgcgcgccgcgtatctcggcggcggccattga

SEQ ID NO: 7330 - DNA, 1266 bp, Methylobacterium sp.
atggcagagctggacatcgtcgtcgtcggaggcggcatggtcggcctcgcctcggccctcgcgctcggcgagcgcggcctctcggtggcgcttgtcgatcccggcgaggcgcgggcgcgcacctcctacggcaatgcgggcgtgctgagccgcggctcgatcttcccgatggccggccccgccctctggccgaagctgccggcctacctgcgcaacgccgacagcgccctgcggctccggcacgcccacctgttccgggtggtgccctggggcctgcacttcctggccgcggcgcgggaatcgcgctggcggcgggcggccgccgcgctcctgccgctcaccaccgccgcctacccggcccacgagcgcctcgcggagcgggccgggacacgcgcgcgcctgcgccgctccggctggctgaagctctaccgcacggaggccgccttcgcgggcgcggcgctggagcgggcgatcctcgccgagcacggcgtcgccctggaggttctcgacggcgctgccttgcgcgacctcgaacccgccctggtgcgccccttcgcgcgggcgatgctgctccccgagaccgccgcgctcagcgagcccggcgccctggtggaggcctgcgagcggctcttcgccgagaccggcgggcagtacctgcggggtaccgtcaccgggctgattccggaggccgggggctggcgggtggcgcatgcgggcggcgaggtccgggcgcggcaggtcgtggtggcggccggtgccgcctcggcggagatcctgcggccgctcggctaccgcttcgccttcgcggccgagcgcggctaccaccggcactacgccctgcacccggacagcccgccgctgacgcggccggtgctcgacaccggcgccggctcgatcatcgcgccgatgggggaggggcgggtgcgggtgctctcgggcgtcgagctgaacgcccgccacgccgcgccggaccaccggcagatcgaggcggcggcgcgggaggcgacaggcaccctgcgcctcggcggcccgctggacaaccagccctggatgggctcgcgcccctcgacgccggacggcatgccggtgatcggccgggcgccgcgccatcccggcctgatcctcgccttcggccacggccatatcggcctctcgaccgggccggtcaccggagagctcgtggccgacctcgtcaccggcgccgagcccgcggtgccgctcgcgcccttcacgcccgagcgcctgctgcgctggccgcgtccgtga

SEQ ID NO: 7331 - DNA, 654 bp, Methylobacterium sp.
atgtccgagacccagctccgcccgcatgaccgcctcgtcgaggacctcgtcgcccgcctcgaaccggtccatcccctcccctccccgggccggcgcgcgctggcctggaccggcgccgccctcgcgctcggcctcgcgctcttcggcgtgctggaactggagggcctgcgcgggccgcgaccggccgagacgccgttcgtcctgctcggcgcggtgctgacggcgctcgccgccgccttcgccgccttcgccaccagcgtgccggggcgctcggcgcgctgggcgctgctgccgctggcgcccgccgccctctggatcggcgcgagcgggccgggctgcctgcgggcgctcgcgggccccggcatcgaggcaccgcacgcgctgcccggctgcttcacctttctgctcggcgtgtcgctgccgctctcggtgctgctggtgctgatgctgcgccgggcctgccccctgcgcccgaacctcacggcggcgctgggcgggctcgcggtcgcggccgccgcggcggccctgctcatgcccttccacccgcaggagacgaccgcgaccgacctcctcgtccacgccgcgacggtgctcggcgtgatcgggctcaacggcatggcgggcggccgcctgctcgatcggagccggggctga

SEQ ID NO: 7332 - DNA, 231 bp, Methylobacterium sp.
atgcccgtgcccaatccgagcgccgtcctgctcgaactcgcgaacgagatcgtcgagctgcgcctgcaactcgccgaggtgcaggatcagtgcgtggagatggccgtcgattccggcgagcttcaggccgagctcgtggcactccgcgcggagctcacggtcgtgcggcgcgagcgcgacgggtttcgtgagcatcttcgtcgttgcggcgccgaccgggtcgcggcctga

SEQ ID NO: 7333 - DNA, 225 bp, Methylobacterium sp.
atggtgttggagcatcagggcgatcacgcctcccggtacggagcgatccgctcgattgccgccaagatcgactgctcgggcgagacgctgcggaatcgggtccgccgggcagagcgggagcaaggtcagcgggctggtccgacgacggacgagcgcgagcagatcgaggcgctggagcgggagaaccgtgagctccggcaagccaacgagatcctgagaaaagca

SEQ ID NO: 7334 - DNA, 1368 bp, Methylobacterium sp.
atgaccgagttcgtccaccccgtccgggtcgagccctccgtgctggcggcccgcctctccgacgagcgggcgccggacatcgtcgaggcgctgaacgccgaggcgcccgaggtcgccgccgcgatcctgctcggcctgtcgatcgagcgggccgtcgaggtgctggaccagcccgagctcgcctgcgcggccgacatcatcgagatgctgccccgcgaccgggtcgccgcctacctcacgggcatgtcggccgaccgggtgacggacgtgttccgggaaatcgaggagcccggtcgctcggacctgcgcgcccggctcgacgccgagacccgcggcgccgtcgaccggctgagcgcctacggcgaggagacggtgggctcgctgatgacgaccgagttcgtcaccgttccgggaacctggacggtggcgcagaccctcgcccatatccggcaggtcgagcgcacgcgcgagaccatctacgcgatcttcgtgctcgacccgcgcacccgcgcgctcaccaaggcggtgccgctccgccgcctcatcgcgggcgagccggaggacagcgtgctctcggtcgcgccggagcggcgcccgctcagcgtgacgcccaccgcgagccgcgaggaggccgcgcggctgatctccaagtacgacctgctggcgctgccggtcgtcgacgcggtcggccacgtcatcggcatcgtgacggtcgacgacatcatcgacgcgatggtcgccaagcagacccaggacgtgcagcgcttcggcggcatggaggcgctgcccgagccctacatggagatcggcttcctcacgatgatccggaagcgggcgggctggctctgcgccctgttcctctccgagatgctcaccgcctcggccatgcaggggttcgagggcgagctggagcgggcgctggtgctgacgctgttcatcccgctcatcatgagctcgggcggcaattccggctcgcaggccacctcgctgctgatccgggcgctggcgctgcaccagatccgcctgcgcgactggtggcgggtggcgctgcgcgagctcccgaccggactggtgctcggcgcgatcctgggcacgatcgcggtcgcccgcatcgcgatctggcaggaggccgggttctacgattacggcccgcactggatcctggtggcggcgaccgtgggcgcggcgctcgtcggcatcgtcacgttcggctcgctcgcgggctcgatgctgcccttcctgctccagcgcgtcggcttcgatccggccaccgcctcggcgcccttcgtggcgaccctcgtcgatgtcaccgggctggtgatctacttctcggtggcgctggtgatcctgcgcgggacgctgctgtag

SEQ ID NO: 7335 - DNA, 1098 bp, Methylobacterium sp.
atgacgagacccgatcccacaccgttcctgaaggtccagggcctcgcgaagagctacggcgcattccaggccctggacgggatcgacctcgcgatcccgcgtggagccttcgtctgcttcctcggcccctccggctgcggcaagaccacgctcctgcgcatcatcgcgggcctcgaccgtcagaaccggggccgcatcgagatgggcggcgtcgacgtctcgacggcgccgccggccgagcgggacttcggcatcgtcttccagtcctacgccctgttccccaacctcacggtcgcggacaacgtcgcctacgggctcgtcaaccgccggatgaagcgcgaccggatccgggcgcgcgtcaccgaactcctcgccctcgtcggcctgccggaccaagcgacgaagtatccggtccagctctcgggcggccaacagcagcgcatcgccctcgcccgcgcgctcgccaccgcgccctccctgctgctcctcgacgagccgctctcggcgctcgacgccaaggtccgcatccgcctgcgggaagagatccgcgctctccagaaacggctcggcatcaccacgatcatggtcacccacgatcaggaggaggctctggccatggccgaccgcgtcgtggtgatgaaccacggccggatcgagcaggtcggcacgcccgaggagatctaccgcagcccggcgaccgccttcgtcgccgacttcatcggggcgatgaccttcctggacgcgacggtcgcgccgtcgcaggcgctgcgggtcggcaccgtcgatctcgtctgcgaggacgggcgcggcttcgtgccgggcagcccggtgcgcctcggcgtccggccggaggagatccgggtcgggggcgtcgccgcgggcgacgtcaacgcgatcgaggtgcgggtgaagagcctcgaattcctcggctccttctaccgggcgcggctggagccgagccgcgacctcggcggcagcctcgtcgccgacctgtcggccaacctgttcggcgacctgcggctcgcggaggggcagtacctctacgtggcgctgccgccgcgggcgctgcgcgccttcccgcaggtcgccgcggcctga

SEQ ID NO: 7336 - DNA, 1104 bp, Methylobacterium sp.
gtgaccccccggcccaccccggcggtccgcctcgacggggtggtcaagcgcttcggcacggtgaccgcgctggaggagacctggctgcgggtcgagcagggcgagttcctgacgctgctcggaccttcgggctgcggcaagaccaccctgctcaacctgatggcgggcttccttgaggcggatgcgggcgagatcttcatcggggacgacctcgtcaccgccaccccgccctacgagcgcgagatcggcatcgtcttccagaactacgccctgttcccgcacatgagcgtcgcgaagaacgtgggctacggcctgcgcatgcgtgggctgccgaagcgggagatcaccgagcgggtggcgcaggccctcgccctggtgaagctcacaggcttcgccgaccgctcgccccgccagctctccggcggccagcagcagcgcgtggcgctcgcccgcgccctcgtcatccgcccgaaggtgctgctgctcgacgagccgttctcagcgctggacaagaacctgcgcggggcgatgcaggtcgagttgaaggagatccagcgccggctcggggtgacgacggtcttcgtcacgcacgaccagggcgaggcgctgagcatgtcggaccgcatcgtcgtgatgtcggcgggccgtgtccggcaagtcggcacgccggatcaggtctatcgtcacccgcaggatcgcttcgtggcggggttcatcggcgatgtgaaccgcctgccgggccgtatcgaattccgcacaggcgagcgcgccacggtcgcgatcggcgacctgcgccgcgaggtcgaggcggaagccctgcgcgactgcgcggcgggcgccgcggtggacgtgttcgtgcgcccggatcacctcggcgtccgtcctgccggcgaggccgggaccctgccggcgcaggtggcggccctcgtctaccagggctcgcacatcgacctgcacgccgacctccaccccgatctcgccggcagcgggcgcgtggtggtgcggctgccggggcacggcgcgctcgccacctacgcccccggaaccccggtgggcctcctcgtgccgcagggcggcctcgtcgccttcccgcccgagccgtga

SEQ ID NO: 7337 - DNA, 357 bp, Methylobacterium sp.
atgaacgctccaccctcggatcgcgcgaggctgctccggcagcggcagacgaatgccgagagtcagctctggcgcgtcctgcgcaaccgtgcgctgaacggctggaagttccggcgccagtgcccgatcgaccgctacgtcgccgatttcgcctgcgtcgaggcgaagctcgtcgtcgaggtcgatggggctacccacgggaccgcggcggaacttgccggcgatcgcatccgcacggacgccttggtccgcagcgggttcgaggttctgcggatcacgaatgccgagatccgcgccgacatcgacggcgtccgtgagacgattctcgcggccctggagcgccgggtcacgatctga

SEQ ID NO: 7338 - DNA, 771 bp, Methylobacterium sp.
atgaagctgcagaacaagcgggccctggtgacgggcgccgattccggcatcggccgtgcaaccgcggagctgctggcccgcgagggggccgacgtcgcgatcacctacaacaccgacgcggacggcatccaggagacccgagcgcgcgtcgaggcagcggggcggaaggcgctcgtgctccagctcgatgtcggcgacccggcatcggtgcgggcggcctacgacacgatcgcgagccgcttcggcgtgctcgacatcctggtcgccaatgcgggccaggcgatgagcggcatggcggtggccgacatggaggacgcgcgcctcgagcagatcctccgggtgaacctgatgggcccgctcttcaccgtgcggcccttcatccacctgcggcgcacggcgggtgggcgcggcaaggtcgtgttcgtctcctcggtcgcacagcacctgccgacgcccgagagcgcaccctacggcatgtcgaaggcgggcctcggctccctctgccgcagtctggcgcgagaactcgccgaggaccggatcaacgtgaacaacgtggcccccggcctcatcgagacgccgatgaccgccgaccgcttcgagaaccccgacaagctggagaaatcccttgaacggatcccgtggcaccgggccggccagcccgaggagatcgcgcaggcgatcctttatctcgtctcggacgaggcggactacgtcacgggtcataccctggtggtcgatggcggcctcaccatgcagtggggcggcgcctga

SEQ ID NO: 7339 - DNA, 726 bp, Methylobacterium sp.
atgcgcatcctcctgattaacccgaacaccaccgcctccgtgacggacctcgtcgccggccacgtgcgccggatcgccccggaggcgaccttcgtgccggtgacgggccggttcggcgcccgctacatcgcgacccgggccgcggtggcggtggcgggccacgccgccctcgacgcgctcgccgcgcatgtcgcgggctgcgatgcggtctatctggcctgtttcggcgatcccggcctgccggcgctgcaggaggtctcgccggtgcccgtcgtcggcatggccgaggcggcctgcgaggccgccgccgcggacgggcggcgtttcggcatcgtcacgggcggggtgaactggccggcgatgctcgccgagttcgtgacgctccaggggctcggcgggcagctcgccgggatccgcgccgtggcgccgaccgggggcgagatcgcgcgcgatcctgaccgcgccctcgcccagctcgccgccgcctgccgggcctgcgccgaggcggacggggccgaggcggtgatcctcggcggggcgggcctcgcgggcttggccgagcgcgtccagccgcaggtgccctgcccggtgatctgctccgtcgaggccgggacccgggccgtgctggcggcggccgggagcgccgctcgccgcagcgcggcggatcccgttccgagcctcggcctcgcgcccccgctcgaacgtctgctgcttcaggccccgtga

SEQ ID NO: 7340 - DNA, 864 bp, Methylobacterium sp.
atgtccgcccccgcgcgccccgagatcgtccgcgagcgggcggggccgccgggcggcacggtggtcgagaagccgctctcgacgctggagctgctctacaaccagggctggctgcgcaaggtcctgatcctggcggtccttgccctgatctgggagtcctacgggcgctacctcgacaacgacctgctgttcccgaccttcacggcgacgctcggggccttcttccgcggcgtggcggacggcaccctgccgctgcgggcctggggctcggtgaagatcctgctcgtcggctacggcatcggcatcgtgctggccaccgtgctcaccggcatcgccatcgcctcgcggatcggcaccgacttcctcgagaccatgacgtcgatgctgaacccgctcccggccatcgcgctcctgccgctggcgctgatctggttcggactcggcaacggcagcctcgtcttcgtgctggtccactcggtcacctgggcgatcgcgctgaacacccattcgggcttcctctcggtcagccggaccctgaagatggtggggcgcaattacgggctcggcggggccggcctgatccgcaagatcctgatcccggcggccttcccgtcgatcctcaccggcctgaaggtcggctgggccttcgcgtggcgcaccctgatcgcggcggaactcgtcttcggcgtgtcctcgggatcgggcgggctcggctggttcatcttcgagaacaagaacatgctcgacatcccgaacgtgttcgcgggcctcctcaccgtgatcctgatcggcctcgtggtggagaacctgatcttccagacgatcgagcgccacaccatccagcgctggggcatgcaggcctga

SEQ ID NO: 7341 - DNA, 873 bp, Methylobacterium sp.
atgaatcagcacgtcctgccgccgatccgcccggaatacgaccgggcgctcgcgcccttcgtggaagcgcccgtcgcacgggcgctgccgttcgccacgcggctctggcagcagggctggctgcgcaagggcctgatcctggcggcgctcgccctcgcctgggaggcggcggcggcctggcagaacaacgacctgctgctgcccggcttccgcgcgaccctgtcggcgctcgccgaggggctcgccagcggcgagcttctcgaacggatgcgaatctcgcttcaggtgctcgcgcagggctacctgatcggcgtcctgctcgccttcggattgacgacgctcgcggtctcgacacagaccggacgcgatctgctctccaccctgacggcgatgttcaacccgctgcccgcgatcgcgcttctgccgctggccctgctctggttcggcctcggctctgcgagcctcaccttcgtgctggtccattccgtgctgtggccggtcgccctcaacacctatgcgggcttccagggggtgcccgagacgcttcggatggccggccgcaactacggtctgcgggggctgccgtacgtctggcagatcctgatcccggccgcgcttccggcgatcctgtcgggcctgaagatcggctgggccttcgcgtggcgcaccctgatcgccgcggagctcgtcttcggcgcggcctccggcaagggcgggctcggctggtacatcttccagaaccgcaacgagctctacaccgaccgcgtcttcgcgggcctgctcctcgtcatcgccatcggcctcgtcgtcgagaacctcgtcttcgcgaccctggagcgcctgacggtgcggcgctggggcatggtccgctga

SEQ ID NO: 7342 - DNA, 1233 bp, Methylobacterium sp.
atgtcgacactcgcgaacaccggctgggccgtcttccgcaacggcgatttccgcctgttcggcgcggcccgcttcctcaccggtctcgcctaccagatgcaggcggtggcgatcggctggttcgtctacgacttgaccaagtccgccttggcgctgggcctcgtcggtctcgcgggcttcctgccggcgatgctggccgcgctgatcaccggccacgtcgccgacacctacgaccggcggctcgtggcggcgatcagcttcggcgtccaggcggccacgagcttcgggctgctcgcctacgcgctctccggagcccaggcggtctggccggtctacgcgctggtgatcctcgtcggcaccggccgggccttcgccaatccggccctccaggcgctcctgccgacgctggtctcccgcgagctgttcggcggcggcatcgcctggaacgcctcgctctggcagacctcctccgtgctgggcccggcggcgggcggcctgctctacgcggccggtcccgcggtggtcttcggcggggcaggggccagcttcacgctcgccgccctgctggtcgccgcgatccgcttccggcccgcgcccgtctccgagcggccgccggtgagctgggccacgctctcggccggactcgcctatatccgctcgcagcccgtggtgctcggcgcgatcagcctcgacctcttcgccgtgctgttcgggggcgccaccgcgctcctgccgatcttcgccgcggaggtgctgcatgtcggtcccctcgggctcggcgcgctgcgcagcatgccggcggcgggcgccgtcgcgatggcgatctggctcgcctaccgtccgctccgccgccacgcgggcatccggatgcttcgggcggtcgccgtgttcggcctcgccatcgtggtgttcggcctctcgacctcgctgccgctctcgatgctctgcctgttcgtgacgggcgcggccgacatgatcagcgtctacgtccgccagagcttcgtccagggcgagacgccggacgccatgcggggccgggtcgctgcggtgaacagcgtcttcatcggcgcctcgaacgagctcggcgagttcgagtccggcctcctcgcggccgcgctcggcgccgtgccggccgtagtggcaggcggcgcgatgacggtgctgatcgcggtggcctggggccggctgttcccggccctgcgcgaccgggaccggctgctcagggaggcgtga

SEQ ID NO: 7343 - DNA, 621 bp, Methylobacterium sp.
atggccgtgtctttcgaaaacagtcagaccttcgcggtcggccgcggccctgttgcggtgacgagcgcggacctgaacggggacgggcacgcagatctcgtcagcgccagcttccgtgacaacgcgatctcggtcctcttgggcaacggtgacggcaccttccaggtgcaaaaaactctcgcggtcggcccctttccgcgcaaggtcacgggtgtggatctgaacggcgatggccgcatcgacctcgtcagcaccaactcgggtgacggcacggtctcgatccttgtgggcaacggcgacggcaccttccaggcccagcagaccctcgcggtcggcagcgatccgcgcgcggtcacgagcgcggacctgaacggggacgggcacaccgacctcttgggcggcaactacggtgactacggcgacagctcggtctcggtgcttataggcaacggcaacggcaccttcgagcaggcctcgggcgaccgcatcagcctgggcggccagacctacacgctgagcagggctcagaacggagacgccgtgctgctgctctcgggcggcggcagcgtggaactgactggcatcaaggccgagcaggtcaacacaggattcttcggctga

SEQ ID NO: 7344 - DNA, 1158 bp, Methylobacterium sp.
atgaccggcacgacctccccccgccccgtccagggcaagaccgtccgctacgccttcgtcggcctgggcgacatcacccaggaggcgatgctgcccggggtccgccacaccggcaattcggaggtcaccgccctcgtcaccggcaatcccgagaaggcgcgccgggtcggcgagcaatacggcgtcaccgacacctacggctacgatgagttcggcgcgctgctggcctcggggaccatcgacgcgatctacctcgccaccccgaactggcgccacgccgagttcgcgattcccgccctcaaggccggcatccacgtgctggtggagaagccgctcgagatctcgagcgaaaaatgccgggagatcatggcggcgcgggccgcctcgtcggccaagctgatggtcgcctaccggctgcatttcgagccggcgacgctcgccaccatcgatctgatccgttcaggagatctcgggcagatcctgaccttcacctcgaccttcacgcagatggtctcgcccgagaaccatcgggcgaagagcggcgtcgcggccggcccgatcttcgacatgggcccgtatacgatcaacgccgcccgctacctgttcggcgacgagccgaccgaggtggtctcggccgtcggcgtgcgccaccctgaggccgggttcggcgacttcgacgacaccgtcgcggtcaccctgcgcttccccggcaaccgcctcgcgcagttcgtgctgtcctattacggcaacgtgctcgacacctacgcggtcgtcggcaccaagggcagcgtcgaggtcaatccggcctacatgtacggcaagccgctggaacggacggtgaccatcggcgacgagaagcaccacgacagcttcaagaacaccgaccatttcggcggcgagctgaagtacttctcggattgcatcctgaacggcaccgaccccgagcccgatgccgaggagggctacgccgacctgcgggtgatcgaggggatcctgaaggctctggagagcggcggcccggtgcgactcgagccgttcacgcgcacgaagcgcatcaacctctcgggacagctccagcaattgccggcacaggctccgcccgatctcgttgacgcgtccaaccccggccggggcaaggacaagtctccgctgaactga

SEQ ID NO: 7345 - DNA, 273 bp, Methylobacterium sp.
atgatggaacgcgtgtcacgcgaggatacgaaacccgacccggacgattcggacccgccgttcgcgccgggcagcggccccgcggtggcacctccgccagagggatcggcggacagggaggagaccgacgcgatcaccttcgagcagatccgcgagcgcgcctacgagctctgggagcgcaaccaccggccggacggcttcgagattcagttctggcttctcgccgagcgcgagctgaaggccgagcgcgagcgccgccggggcggcccatga

SEQ ID NO: 7346 - DNA, 1692 bp, Methylobacterium sp.
atgaacctgctctcgcgcgtgagaatcttgcacaagatcgcggcagtcattgccttgatcggcctcatcgtcggtgcctgcatctggcacgcgagcgcgcgcatgggtgcgatcggcgagagctacgaccgcttcatcgcgcacgacgcgcgggcggcggcgaatgcgcggcggatcaaccggcacatctacgagatgtactacgcggtctaccgcacgatcgcggagaccgaggccgaccagatccggcaggcgtcggcgcagttcgaggcgtcggcgccgggcctgcgccagctcttcgccgagatcacggccgacatgcccaccttcgcggggcggatcgaggaggtccgcgccagggcggagagcttcatgtccagcgtctcggaggcgcgctcgctcggcgaggcgaacctcaatgcggaggcgctggcgctcgtgcaccgggacgtcgacccgagcttcacggcgctcaccggcagtgcctcgaagctcggcgccgacatcgcggccagcatggaggccggcgcgcagagccttgcccgggagagcgcgtcgacgcgcctcggcctctggctcttcagcgggctcgggctcctggccggcatggtcgcggcggccctggtggcaatcctcggcatcagccggccgctcggccgcctcgtcgcggtgctgcagcggatggcccgcggcgagatcgaggcggagatcgcggaggcgcggcgcggggacgagatcggcgcggtgggccgcgccgtcgagggcatcaaggcgatggtggcgcagaaggccgccgagcaggccgagatccggcgcatcgcggacgccgcggccgccgaggagcgccgccgcaccatggtggaactcgccgacggcttcgagcgcgcggtcggcggcatcgtcggcacggtctcgtcgtcggccaccgagctgcaggccaccgcccagaccatgagcgcgacggccgccgagacggccgggcggtcgatgacggccgcgaccgcggccgaggaggcctccaccaacgtgaacacggtggcggcagcggccgaggagctcggcgcctcggtcggcgagatcggccggcaggtcgacggctcggccgatctcgcccggcgggccgtcggcgaggccgatcaggccgccgccctggtgcaggccctgaacggctcggtcgcgcgcatcggcgacgtggtggcgctgatctcgcagatcgcgggccagaccaacctgctggcgctcaacgccacgatcgaggcggcccgcgcgggggaggccggccgcggcttcgcggtggtggccgccgaggtgaaggaactcgccaaccagaccgcccgggcgaccgacgagatcacccagcagatcggccggatccagggggcgaccggcgaggcggtcggcgccatcggggccatcacggggcggatccgcgagatctcgggcgtggcgacctcgatcgcggcggcggtggaggagcagggcgcggcgacccaggagatcgtgcgcaacgtctcgcaagcctcggcgggcacgggcgcggtgacgcgcaacatcgcgggcgtggcgggtgccgccgaggagacgggagcctccgcggcccaggtgctcgccgcggcctccgaactgtcgcgccagtccgagcacctcaacgccgaggtcgggcgcttcctcgccaccgtcagggctgcgtga

SEQ ID NO: 7347 - DNA, 771 bp, Methylobacterium sp.
atgggcttgacggacgcgctgttgcaggtcgacggcgtcacgctgcagtacaagacgccgcatcacctgatcacggcgacctaccgggtcggtttcgatgtcctgccgggcgaccggttcgtgctgctggggccgtcgggctgcgggaagtccaccctgctgaaggcggtcggcggctacatgaccccgaccgagggcgagatccgcctcaagggccggcccgtcacggggccgggccccgaccggatgatggtgttccaggagttcgaccagctcctgccctggaagacggttcgccagaacgtcgtcttcgccctcgaagcctcgggccgcctcaccgggcgggccgccgaggagcgggcgatggcctatatcgacaaggtcaacctcaccaaattcgccgacagctacccgcacatgctgtctggcggcatgaagcagcgcgtcgcgatcgcccgcggcatggcgatggagcccgacatcctgctgatggacgagcccttcgcggcgctcgacgcgctcacccggcgcaggatgcaggacgagctcctgatgctgtgggaagagacccgcttcaccgtcctgttcgtcacccactcgatccccgaggcgatcaagatcggctcgcgcatcctcctgctctcgccccatccgggcgaggtgaaggccgagctcaacagcgccggctcccccggcgagcaggcccagctcgagagccgcatccagcagatgctgttctccgaggagatcgaggaggcggagaatgtctag

SEQ ID NO: 7348 - DNA, 798 bp, Methylobacterium sp.
atgggccggacggacccgctcctgcagatcgcgggcgtcagcctggagtaccgcacgccggagcgcgtggtgcgggccacccatcggatcgatctcgacatctacgcggccgaccgcttcgtgctgctcggcccctcgggctgtggcaagtccaccctgctcaaggccgttgccgggtttcacgaacccgtcgagggcgagatccggctcgacggcggggtggtgcggggtccggggccggaccgcatcgtcgtcttccaagagttcgaccagctgccgccgtggaagaccgtgctgcagaacgtcgccttccccctccgggccgccgggctcgcggggcggcgcgaggccgaggcgcgggcgcgccactacatcgacaaggtcgggctctcccgcttcgccgagagctacccgcaccagctctccggaggcatgaagcagcgcgtcgccatcgcccgcgccctcgccacgcagccgaaggtgctcctgatggacgagcccttcgcggcactggacgcgctgacccggcgcaagatgcaggaagaactgctcgcgctgtgggaggaggtgcgcttcacgcttctcttcgtcacccactccatcgaggaggctctggtggtgggcagccgcgtggcgctgctctcgccccatcccggccgcgtccgcagcgaggtcaattcccatgacttcagcttgggcgatatcggcagccgcgacttccaggccgccgtccagcgcctgcacgggcgcctgttcgaggtcagccccgaatccgagaccccgtcggctccgcaatga

SEQ ID NO: 7349 - DNA, 699 bp, Methylobacterium sp.
atgagcggggaggcccacggggccgcgttcggggccgcatccgaggccatccgcggcggcctgcgcgtgatcgccctggcggtgcagaagggcggcaccggcaagaccacgctcgccgcctcgctcgcggtcgcggcggcccaggccggcgagcgggtgacggccttcgatctcgacccgcagggctcgctcgccggctggggcgcgatgcggccgaagggcaacccggtgatcgaccggatccggccctgggagatcggccagatggcggagatcctcggccagctcgccgcggatggcgggacgctcgcgatcctcgacaccgccggctccaccgcgggcgacgcggcgctggcgctcaggctcgccgacctcgtgctgatcccgatccgcccctcgcgcctcgacctgatggccgcccagccgacgatccgggccatggcgacgcaggggatgcgcgagcgcgtcggcctcgtgctcaaccagtgcccgcccccgccctcgccgcgggcggccctctacgcgcggcaactggcggggctcggcgtgctggccgagccgacgatgatccagcgcgtcgaccatcaggacgccctggccctaggcgccggcgtcaccgagcacgcccccgccggccccgcggccgaggagatccgggcgctctgggcctgggcggcccgccggatcgggcgcgcctga

SEQ ID NO: 7350 - DNA, 1131 bp, Methylobacterium sp.
atgaccgggatgagagcaacacttctggcgggcctcgcgctcggcctcctgaccgccggctcggcgcaggcgcagctcaagattgccgtgggcgcgccgatcaccggcaacagcgccgccttcggggcgcagctcaagaacggcaccgcccaggcggtcgaggacatcaacaaggccggcggcgtcaaagggcagaagctcgaactctccgtcggcgacgacgcctccgacccgaagcagggcgtatcggtcgccaacaagttcgcctcggacggagtgaagttcgtggtcggccacttcaactcgggcgtctcgatcccggcctccgacgtctatgccgatgccggcatcgtcgaggtcacgccggcctccaccaacgtgaagttcaccgagcgcggcctctggaacaccttccgcacctgcggccgcgacgaccagcagggcgcggtcgcgggcgcgtacctgacccagaacttcaagggcaagaaggtcgcgatcatccacgacaagaccccctacggaaaggggctcgccgacgagacgctgaaggccttcaaggccaagggcggcaaggaagcgctctacgagggcatcaatccgggtgagaaggactactcggcgctggtctcgaagctgaagcagaacggcgtcgacgtcgtctatttcggcggctactacaccgaagcgggcctgatcatccgccagatgcgcgaccagggcctgaaggcgcccctgatgggcggtgatggcatggtggacaaggaactcgtcgccatcgccggtccgggtgccgagggcacgctcaccaccttcccgccggacgcccgtaagaatccgaacgcgaaggacgtggtcgcgggcttcaaggccaagggcatcgatccggaggcctacaccctctacgcctacgccgccgtgcagatctacaagcaggccgtcgagggcgcgggctcggccgattcgaagaaggtcgccgccttcatgcgcgagggcaagccgttccagacggtcctcggcccgatcgccttcgacaagaagggcgacatcaccaagcccgactacgtgatgtacacctggaagaagaacgacaagggcgtggtcgactacgccggcaacgaggtgacgcagtaa

SEQ ID NO: 7351 - DNA, 1458 bp, Methylobacterium sp.
atgcccgcgtctgaaaattctcctgatctcctcgtctgcctgcacttcctgggcggctccgcccggacctgggagccggtcgcgcgccggctcgccggcacgatgcgctgcgtcgccctcgacctcccgggcttcggcgcggccgcggcgacgatgggctacgatgtcgccgcgatggccgaccacgtcgccgccgcgatccgggacctgcgcccggtccgcttcgcgctcgcagggcacagcatgggcgccaaggtcgcgctcgttctggcccggcgcgccgaggacggcgacccggacctcgcgggcttgagccacctcgtcctcgtggccggctcgccgcccagcccggaaccgatcgcggaggagcggcgccggacgatgctcgcgtggatcggggcggattccgagacgcgggcgcgcgaggcccgcgccttcatccggcagaatgtcggcgcgccgctcgcgcccgaggacgaagatgttgcggccgccgacgtgctgcgggccgcgcccgcggcgtggcgcgcctggcttgaatccggcgcgaacgaggattgggccgcccgcatcggggtcctgcgcacccccgcgctgatcctggcggggagcaaggacgccgatctcggccctgcgggacaggccgccctgacggcgccgcacctcgcccatgcgcggaccgagatcctcgacggagccggccacctgctgccgctggagcgtccggataccgtcgcggcggcggtgacccgccacctgtccgccccaccgcctgccgacgccgagccggcacgcattcccgaagcctacgcggcgctgatcgcctcggagcgggtcaatctgcgcctgcgggcggccctcgcggagcgggcccgggcggacgatccggcctacgcgccggccgcgctcgaccccgtcgagctggcgctgctgcgcgccgtggtggcccgcgtgctgcccgatgccggcttcgacatcgccgcccggctcgacgcgcgtctggcgagcggcgcgggcgacggctggcgcttcgcacgcctcccgccggatgcccaagcctaccgcgccggcctgcgcagcctggacgcagccgcgcgtgcagacggcccgcccttcctggcgcgcgatggggaggctcaggacgcgctgctgcgggcggctcaggcgggtcggctcgcggtgcccgaagcggcccggcctcgcctcgacgcggagcagatggtgctgtggttcgaggacctgcgcgccgacgcggtgcgcgcctatctcgcccaccctgcaacgctcgcccgcctcggcttctccgggatcggcgcgggcggcaccggcacccccgatgcggacggcctcgcccgcggtctgccgggcttcgttcggaccgggcggaacgagcccgaaccctgggagccggaacccgtgcgaccggatgggcgcgacggtggggaggcggcacgatga

SEQ ID NO: 7352 - DNA, 840 bp, Methylobacterium sp.
atgcgcctcctgctcttcctgctcgccgccgcggccatcctctacgcggtgggagtcggagccctggccctgatccagcggcggctgatctatcccggcgcctatgcggacgctgtccacccgaacgagcgcgtcgtgccgcccggaaccgccgcgatccgcgtcgggaccgcggatggggagcggctctacgccctgtggcgggcaccgcgcccgggctgcggcgtggtggtgagcttccacggcaacgcctcgatgccggaataccacgcggagcgcttcgccgcggatccctggcgggccgccggctggggcgtgctggccccggcctatcgcggctatccgggctcgaccggcgcaccctccgaggacgggctgatcgtggacgggctcgcggctgtggccgaggcgcgcgcacgggcgcccggcagcccgatcctgctgcacggccactcgctcggtgcggcggtggcggtcgcggtcgcggcgcggctgccccgggccgaggctcccgccggcctctaccttgaggcgccgttcgactcgatggtctcggccgcccgcgtccacttcccggcggcgccgggctggctcctgcgcgacacctaccggtcggaccggcgcatcgccgggctgcccggcccgatcctgatcgtccacggcacggacgacccggtcgtgccggccgcgctcggccgccgtctggcggaggccggccaggcccggttcgcggcgatcccgggcgaccatgtcagcatcctgggcgcgcgcgacgcggaggccgccgccctcttcggtgcgcgcgcgtgtcccgatgccgcggcggtcgaggcccgctga

SEQ ID NO: 7353 - DNA, 732 bp, Methylobacterium sp.
atgaccaacttgcgccaagtcaagaagctcgtcgcgccgctcctcgcacgaaatcctgacctgatcctgtctgattacaggacatggggctacgaactctgcttgttaccggtcgatcatgtgctgagacatgtctggatcaagcgcgcctcgatgtcgccgagcttcagtgtccaattccacgtgacggagatgtttcggcccgaaccctgcgagcgcttcaccttcggttggtgcttcgatctggtcgggcgttcaccgctcacacacccgcccgggaccggcgggaactgggtgtgggctgacccgaccatggcggcggacttcgtggttcagattgaggagcaggtcctgtcgatgctgcgcccgctcgacaccgtcgagaaattcgtcgcctacgcgcgccaacatcgggagtggtcctggtgcggcgacttcagccgcgcgctgacggaaatggttctgggcaatctggatgaggcccgaaccatatgggccgccgaggcaaagcattttgtcccaagcaagagacccgagggtggtgccgacgactacccgacattcgaccgcttatgcgcgctgtccgccgcattgctggcggacgatcgtgtggaacttgcgcggctgcttcatgcctgggaagccgaatgggtcgccgtacgcaagctttcggcccattggcgcccaacgccctttcctctggagcgaggcctcaaaccagttcgtgggtag

SEQ ID NO: 7354 - DNA, 990 bp, Methylobacterium sp.
atggccaccctcaccctcgcggaggccgaggcgctggccgcggaggcgctgacccgctgcggcaccgcggagcccgccgcccgcagcgtcgcccgcgccctcgtcgccgccgaagcggacggcctcaggggccacggcctctcgcgcgtcgccccctacggggcgcaggtgcgggccggcaaggtggtgggggacgcggcgccccgggccgagcgcccgcgcccgggactgctggcggtcgacgccgcccacggcttcgcctacccggcgatcgacctcgcgctcgcggaactgccggggatggcccgcggacagggaatcgcggcggccggcatccggcgctcgcaccattgcggcgcggcaggccgcccggtcgaggcgctggccgagcagggctgcgtcgcgctcctcttcgccaacacgcccgccgcgatggcgccctggggcgggcaccgcgcggtgttcggcaccaacccgctcgccttcgcctgcccgctgccgggccgcgcgccgatcgtggtcgatctcgccctctcgaaggtcgcccgcgccaacatcgtcggcgcggccaggcgcggcgaggcggtccccgagggctgggccctcgacgcagacgggcgcccgaccaccgacgcgaaggccgcgctcgcgggcacgatggtgccgctcggcgacgccaagggcacggccctcgccctgatggtggagctgctcgccgccggcctcgtcggggcgcgctttgccggggaagcctcctcgttcctcgacgccgcgggcgacccgccgggcaccggccagctcatcctggccatcgacgccgccgcgctgagcccggacgcgccggagcgcttcgccgccctcgcccggtcgatcgaggggcaggacggcgcccgcctgcccggcagccgccggctcgggctgcgccgccgggcggccgaggcgggcctcgacctgcccgacgcgctggtggcggagatccgggcgctctga

SEQ ID NO: 7355 - DNA, 381 bp, Methylobacterium sp.
gtgagcgcgctccagggcatcctgttcgaggaggagtcgatctggctcttcgggctcgtgaccgttctgatgggtggatgggccgcctggatggcggcccgggcgatcgcgcgggcgtggcgaccgtttccctacgccgccctggcgcttctcctcgtggcggcggccgtgcgcttcatccatttcgcgctgttcggcgggaccctgctgtcggcgcagtactatctcgtcgatgccgccgtggtgatgctgatcggcgcggccggctaccgctacacccgcacccgccagatgacgacgcagtaccgctggctctacgagcggacttcgccgctgacctggcgcgagcgcccttccggagcgccgccggggcggtcatga

SEQ ID NO: 7356 - DNA, 798 bp, Methylobacterium sp.
gtgagcgtcgccggcatcaacgtcctggtcgaggagacccgagcgcgccaggcgcaggccgggcagccgctcctcgcggtcgagaacgtctcgacctattacggcagcgtcgcggccctgaagggcgtcgacctcacggtcggccggggcgagatcgtcacgctgatcggcgccaacggggccggcaagtcgaccctgatgatgacgatcttcggcgccccccgggcgcgctcggggacgatccgctacgcgggccaggacatcacccggctgccgacccacgagatcgcccggctcggcctcgcccagtccccggaaggccgtcgcgtcttcccgcgcatgagcgtgttcgagaacctgcagatgggcgcgagcctgcacggggggcgcttcctcgcagaggatctggagcgggtctgcgcgctgttcccgcgcctcaaggagcgcttgcagcagcgggccggcaccatgtcgggcggcgagcagcagatgctggcgatcggacgcgccctgatgagccggccgacgctccttctcctcgacgagccctcgctcggcctcgcgccgctggtggtgaagggcatcttcgacgcgatccgcgacctcaaccggcaggacgggatgaccatcttcctcgtcgagcagaacgcctaccacgccctgaagctggcgcatcgcggctacgtgctggtcaacggccgcgtgaccatgagcggctcgggccgccagcttctcgacgatccggccgtgaaggcggcctatctggagggcggccacggcgccgcggccacggcgtga

SEQ ID NO: 7357 - DNA, 906 bp, Methylobacterium sp.
atgagcgcgctcgtctcgagccccccgaagaccgccgcccggatcgacgcctccgccgaggcggtgctctcggtcgcccatctcaccatgcggttcggcggcctcatcgccgtcaacgacctctcgttcgaggcgcgcgtgggcgagatcaccgccctgatcggcccgaacggcgccggcaagacaacggtgttcaactgtatcaccggcttctacaagccgaccgaggggatgctgcggctggcgcagccggacggcacggtccatctgctggagcggctgccgaacttcgcggtgaaccgcacggcccgcgtcgcgcgcaccttccagaacatccgcctgttccccggcatgaccgtgctggagaacctgctggtcgcccagcacaacccgctgatgcgcgcctccggcttcacgatcggcggcctgctcgggctgccggcctaccgggcggccgagcgcgccgcgatcgagaaggccaaggactggctcgcccggatcgacctcctggcccgggccgacgagccggccggcgcgctgccctatggggcgcagcgccgcctggagatcgcgcgcgccatgtgcacggacccggtcctgctctgcctcgacgagcccgcggccggcctcaacccgcgcgagagcgcggagctcaacgacctcctgcgcctgatccgcgaccggcacgccacctcggtgctgctgatcgagcacgacatgtcggtggtgatgcagatctccgaccacgtcgtggtgctcgattacggcgtgaagatcgccgacggcacgccggaggaggtgcgggccgatccccgggtgatcgccgcgtatctcggcgtcgaggacgaggaggtcgaggcggtcgaggccgaggtgggcatcgcgcatccgggagccggacagtga

SEQ ID NO: 7358 - DNA, 1380 bp, Methylobacterium sp.
atggcccaggcccgcgctcccggcctgccggacgtcctccgcgatgccgggctctatgccctcgtcgccttcgtgctctgcgtgccggtggtcagctaccgcaccgaggccgggccggccgggctcgaactccttccacgctggccgctcgtcgcactcctctgcgcgggcatcttcgtgcttcgcctcatccagcgcctcgtgctcgcgcgccgcgacgcgcggcgcgcgctcaccccagcgccgtcccaggcgacggaatccgtccatgccgagcctgcggccggccagaagatctccggcctcgccctctgggccttcctcggcctcgccctgaccctgccggccgtcgcggcgctggcgagcggcggcctggggcccgcgcgctactggatcgacctcggcatcctgatcctcacctacgtgatgctcggctgggggctgaacatcgtcgtcggcctcgcgggcctgctcgatctcggctacgtcgccttctacgcggtcggtgcctacacctacgcgttgctggcgacgaccttcggcctctccttctgggtctgcctgccgctcgcgggcctgttcgccggcctctggggcatggtgctgggcttccccgtgctgcgcctgcgcggcgactacctcgccatcgtgacgctggccttcggcgagatcatccggctcgtcctgatcaactggaccgacctgaccgggggcgctgccggcatctcgtcgatcccgcgggcgaccttcttcggcattcccttcacggcggacgaggatgggttcgcggcccgcttcgggctcgaattcgactcgatgtaccgggtggtcttcctctactacctgatcctcgtgctggcgctcgtcaccaacctcgtgaccctgcggttgcgccgcctgccgatcgggcgcgcctgggaggccttgcgcgaggacgagatcgcctgccgctcgctcggcatcgacaccacggccaccaagctcacggccttcgcgctcggcgccgccttcgggggcttcgccggctcgttcttcgccgtgcgccagggcttcatcagccccgagagcttcaacttcctggagagcgccatcatcctggcgatcgtggtgctgggcggcatgggcagccagatcggcgtggccatcgccgcggtcgcgatggtgggcggaccggaactgctgcgcaatctcggcttcctccgcgcggtcttcggcgagggcttcgacccgaacgagtaccgcctgctgctcttcggcctcgccatggtgaccatgatggtctggcgcccccgcggcctgatctccgagcggcagccctcggtctcgctgggcaaggcgcggggcatctcgggcgcccatgtcagcgaggggcacggttag

SEQ ID NO: 7359 - DNA, 918 bp, Methylobacterium sp.
atggaagtcttcctgcagcagctgatcaacggcctgactctcgggtcgatctacggcctgatcgcgatcggctacacgatggtgttcggcatcatcggcatggtgaacttcgcccacggcgacgtcttcatggtctccagtttcatcgcgctgatcgtcttcctgatcctgaccgcgtggctcgggatcagctcgatcgcgctggcgctgctgatcgtgctggtcgtcagcatggtgctgaccggcctctggggctgggcgatcgagaggatggcctaccggcccttgcgcggctcgttccgtctcgcaccgctgatctcggccatcggcgtctcgatcttcctgtcgaacttcgtgcaggtggcacaaggagcgcgcaacaagtcgacgccgccgctgctctcgggcggcatcaccctgatggaatcggagagctactccgtcttcctctcctacaagcagtgcctgatcatggcggtgaccgccgtgctgctgacgggcttctggtacctcgtgcagcgcacgcccttcggccgggcccagcgcgcctgcgagcaggaccgcaagatggccgcgctcctggggatcgatgtcgaccgcaccatctcgctgaccttcgtgctgggcgcggcgctcgcggccgtcgcgggcgtgctctacctgctctactacggcaccgtctcgttctcggacggcttcgtacccggcgtgaaggccttcacggcggccgtcctcggcggcatcggctccctgccgggcgccgtgctgggcgggctcatcatcggcctgatcgaggtgttctggtcggcctatttctccatcgagtacaaggacgtggcggccttctcgatcctcgccatcgtgctgatcttcatgccctcggggatcctcggccgcgccgaggtcgagaaggtctga

SEQ ID NO: 7360 - DNA, 555 bp, Methylobacterium sp.
atgtcgggcggtcacggggcggtcgagggttcgaacaagcgggtggcgctgctgatctcggtgctggcgctgttcctcgccttcagcgagacgctgggcaaggcggcgcagaccgaggcgatcggtgcgaatatcgaggccgccaaccagtgggccttcttccaggcccgcaccatccgcagcacggtgctgaagaccgccgacgagatggtcgccctgaccccgccgggaccgaaccaggaggcggtgcaggccaagcgcgccgagtgggccaagaccatggcgcgctgggactcggagccggcgaccggcgagggccgcaaggaactcgccgacaaggccaaggcgaaccaggagaagcgcgacctctcgctgcaccgctaccaccattacgagctggcctcggcggccttccagatcggcatcgtgctggcctcggcccaggtcatcaccgggatcgtggcgctcgccgtcgcgggcggcctgctcggtgcggccggggcggtgatgctgggtttcggcttcctggcgccgcacgcgctgcatctgttctga

SEQ ID NO: 7361 - DNA, 1236 bp, Methylobacterium sp.
gtggtcaacgaggggtcgcgcgtgagcaacaagctgactgccaagcaggtcgataccatccgagcgcctggcatctacgaggacggacaaggcctacgactggtcatagggcaaggaggcagcaagagctggatcttccggtaccaacttaacggcaagcgccgccagatggggctcggatcattccctatcgtcagcctcaaagcagcccgagacgcagctgtcgcgtacagggcacagattgctcagaaggttgatccgcttgacgctaagcgcgcagccgaggcgacccagcagcagcccgagcgccatgtatcaaccttccgtgaatgtgccgaggagtacatcgaggaacacaagccaggctggaagaatctcaagcacgctgaccagtgggtcagcacgctgaagacgtacgtctatccgcatatcggcgacaggccggtgagcgacatagacaccgcggccgtccgggcaatcctgaagcccatctggcacaagacgccggagacagcctcaagggtacggggccgaatcgagctgatcctggacgctgcgaaagcgaacgaccaccgcagcggcgagaacccagccagatggcgcgggcacctggacaagctgctcccggcgcgcagcaaagtccgtaaggtcgtcaaccagcccgccatgccgcgcgaggatgttccagccttcatggttgcgctggctgcccacaggggagcagcggcgagagcgctacagctcacggttctcactgcctgccgcagcggcgagatcctgaatgcagcctggtcggaggtcgacctgcctgggcgcgtctggacgatcccagagaagcgcatgaagggtgggagagcccatcgcgtgcccctcaacgacaccatgatggcgattctccaggctcaactcggccatgatcgacagtgggtgttccccggcaggaagtacggccggccgctttgcaacatggcgatgctcaaggtcatgcgggacatgggtcttggtcactacgtcccgcacggcttccggtcgacatttcgcgactgggcggcagagtgcaccagctttccgcgagaggtgtgtgagatggccctcgcccacgcgatcgagaacagcgttgaagctgcctaccgccgcggcgacctgttcgagaagcggcgggggttgatggaagcctgggcggcctatgcattgccggacctgcggcagggcccgatccagcaaatttctgcatag

SEQ ID NO: 7362 - DNA, 870 bp, Methylobacterium sp.
gtgcacgcggagcaccgagcgacttggaagaacgagaagcacgcggcgcagtggatcagcacccttaatcgctacgctgtcccgcacctcggcaaccgtccggttgatcagatcggcacccccgacgtgctgcgcgtcctggcaccgatctggctgacgaagccggagaccgcgcggcgggtgcggcagcgcattgggaccgtgctcgattgggcaaaggcagccggtcaccgcagcggtgacaacccggtcgagggagtggccaaggggctgccgaagcagggtgagcgcaacgagcatcacgcagcgctgccgtacgcggaggtacccgcctttgttgctcgcctccgaaccggcgaggctggcgaggtcgcgcgcttggctttcgagttcctgattctcactgccgcccgcaccggtgaggtgttgggggctgaatggcgcgagatcgacgaggctcaggcgctctgggtggtgccggcaaagcgcatgaaggctgggcgcgaacatcgcgtgccgctgagtgagcgcgcccaggaggtcctgatgcgagccagagccctgagcggtagcagcaccctcatctttccaggacgatccggtgccaatcccctatcaaacatggttttcctcatgactctgcgccgcatggaagtggcgacgacggcgcacgggtttcgctcatcgttccgcgactgggcggccgaagcgacaaaccttccccgtgaggtggcggagatggccctggcacatgccatcgagaaccgagtggaggcagcctaccgccggggtgacctgctggcgaagcggcgggagatgatggagatttggtctatatacctttcatccggccgaaatcgtaagtcgtag

SEQ ID NO: 7363 - DNA, 1188 bp, Methylobacterium sp.
gtgcagggcaaactgacagccctcggcgtggcgaagctgaagacgccgggcatgtacggcgacggcggtggcctgtggctgcaggtcaccggcaagggcgcgaagagctggatcttccgcttcaccctgcgcggcaagtctcgagagatgggcctcggcccggtcagcaccttcaccttggccgaagcccgtgagaaggcactcgcctgtcggaagctgacctacgaaggcctcgacccgatcgaggcccggcgcgcccagcaggacgaggcacgcctcgaggctgccagggcgatgacgttccggcagtgcgccacagcctacatcgagagccacaaggccggctggcgtaacgcgaagcatgcggcgcagtggacggcgacgctggacgcctacgcctatccggcgttcggcgatctgccggtgcaggcgatcgataccggcttcgtcatgcgggccctggagccgatctggaccacgaagcctgagaccgccacgcgggtgcgcggccggatcgaatcgatcctcgattgggcgacgactcacggctaccggcgcggcgagaacccggcccgctggaagggccatctctcgaacctcctgccgaagcgctcgcgcgtgcggaaggttgagcaccacgccgccctcccatattctcaggttgcagccttcatggctgacctcgccacccgcgaggccgtagccgctcgcgcgcttgagttcgccatcctcacggccgcccgcacgggcgaggtgatcggcgcccgctggtcagagatcgacctcgacgccgccgagtggaccgtgccggccgagcgcatgaaggccggggttgagcaccgcgtgccactgtccgagccggccctgacgatcctgcggcgtctggctgagaccagcacgggcgagttcgtgttccccggcggcaggcgcggccagccgctcagcaacatgggcatgctgatgatgctgcgcaggatgggccgcgaggatctgaccgtgcacggcttccgctcgaccttccgcgactgggctagtgagacgacgcacttcccgtccgaggtggtcgaaatggcgctcgcccacacgatcgagagcaaggtcgaggcggcctaccggcgcggcgatctgttccggaaacgtcgcgagctgatggacgcttgggcagcatttgcgagattgaagtgctga

SEQ ID NO: 7364 - DNA, 1185 bp, Methylobacterium sp.
atgacccccgcctcccgctccaccacccgcctgatcctcgtgctggcggtggcgggctttgccagcaccttcgcgggccgctcggtggagcccctcgtcggcgtgctggcccgcgacctcgccagcgatccgcacagcgtcgccctgctctcgaccgcgttcgcgctgccctacgcgctgatccagccggtgctcggaccgatcggcgacgcgctcggcaaggagcgggtgatgacggcctgcctcgtcgtgctggcgggcgcgctcgcggcctgcgcgctggtctcgcagatcgacctgctgttcggcctgcgcatgctggcgggcgcggcggccgggggcgtggtgccgctggcgctggcgctgctgggcgaccgggtgccgatggagcggcgccaggtcgcgatcgggcgcttcctcgtggcgatcgtgctgggtcagctctcgggctcgaccttcgcgggcctgctggaggccgagatcggctggcgcggcgtcttcgccacgacggctctgggggcggtcgccgcggtctgcgcgaccgggttcggcttcgagcggggtctggcgggcgccgcgcgccggcccgatttcggcacggcgctcaagcgctaccgcgcgatcatcgccaacccgcgggcgcgcatcctgttctcggcggtcttcatcgaggccatcgcggtgttcggcatcttcccgcacctcgcgccgctgatcgaggcgcgcggcgagggcggcccgcgcgaggccgggctcgtgctcgcgggcttcgcggtgggcagcctgatctactcggccctggtcggcctgctggtgcgcttcctcggcctgcgcatgctggcggcgggcggggcgatctgcgccgccgcgctcgtcacgatcggctttgccggcacgtggcaggccgactgcgccgcgatgctggcgatggggctcggcttctacatgctgcacaacaccttccaggtgcaggtgaccgaggtggcgccgcaggcccgggcctcggcggtggcgctccacgccttctcgttcttctgcgggcaggcgctcggcgtcgcgctgatcggcggcgcgctccagaccatcggccagatctgggcgctcgccgcctgcgcgggcgccatcctgctgctgggcctcgcgaccgcgcacctcctggccaagcccgcgccgcgcacggcctga

SEQ ID NO: 7365 - DNA, 1266 bp, Methylobacterium sp.
atgcacgttctggttctcggcggcggcgtggtcggcgtcacctcggcctggtaccttgccagggccggccacgaggtcacggttgtggaccgccagcccggagcggggctggagaccagcttcgccaatgccggacaggtctcgcccggctactcggccccgtgggccgcgcccggcatcccgatcaaggcgctcaagtggctgatgatgcgccaccgcccgctcgtgctatggccgcgcctggagccgcgcctctacggctggctcgcccgcatgctcgccaattgcacggaggaggcctaccaccgcaacaagggccgcatggtgcgtctggccgagtacagccgcgacgccctgcgcgacctgcgccgggagaccggcattgcctacgaccatcgcgagaaaggcacgctccagctcttccgcacgcagaagcagctcgatcacgttcccgacgacacccgggttctcgatgcctacggcgtgccctacgcggtgctcgaccccgccggctgcatcgcggccgagcccgcgctcgcccacatgtcggggcgtttcgtgggcggcctgcgcctgcccgacgacgagaccggcgacgcgcacatcttcacgcagcgtctcgccgccctctgcgaagggcacggcgtccgcttccgctacgacaccgcggtcgcaggcctgcgccgggaggccgctgccgtcaccggcgtcgtcacaggcacgggcgaggtgctcacggcggatgcctatgtggcggcgctgggcagctacacgccggccctgctccgcccgctcgggatcgatcttccggtctatcccgtgaagggctactcgctgacccttcccgtggcgaatcccggggccgccccggtctcgaccgtgatggacgagacctacaaggtggcgatcacgcggctcggcgaccgcatccgggtcggcggcacggccgagctcgctggattcagccacgcattgcgcggcccgcggcgggagacgctggcgcgctcgctcgccgacctgttcccgaacggcggcgaccctacgcaggcacggttctggacgggcctgcgccccatgacgccggacggaacgcccatcgtcggccgaacggccttcccgaacctcttcaccaataccggccacggcacgctgggctggaccatggcctgcggctccggccgcctgctcgccgacctgatgtcgggctgctcccccgagatcgccgccgacgatctcgcgatcggccggtaccgcagagcggcatga

SEQ ID NO: 7366 - DNA, 1257 bp, Methylobacterium sp.
atgcgcgcgatcgcggtcgacccggacttctgcgagcacctgttcgcggagctcctcgccttcagccgcgacgcgccgggcgtgacccgggccgcctacggcgcgggcgaggagcgcgcccacgccctgatgcgggcgaccgggctgtcgctggggctcgagcccgagacggacgccgccggcaacctcttcctgacgatgccgggccgcgacccggcacgcgccgcctggatggtcggctcgcatgtcgacaccgtgccgcacggcggcaattacgacggcgcggccggggtgatcggcggtctcgcggcgctggcggcgctccgccgggccggcatcgtgccgccgcgcccggtgacggtcgcggtgttccgcgccgaggagagcgtgtggtttccggcctcctatgtcggcagccgcgccgccttcggcctgctgccccccgaggccctcgacctgccccgcgccgattccggccggagcctcggggcccacatggccgaactcggcctgcggcccgaggcggtggcgcggggcgaggcgctgctccggcccgagcgcatccacggcttcgtggagatgcatatcgagcaggggccggtgctggaggccgagggcatcccggtgggcttcgtgaccgcgatcagcgggagcttccgctaccgcaaggccctctgcctcgggcgctacggccattcgggcgccgtggcgcggtccgagcgcagcgacgccgtcttcgccctcgccgacctgatcgccggcctcgacgcgctgtggggccggctcgaggcggaggaccgccccgcgacgatcaccctgggcgaggtcgcgaccgacccggcccagcacgccttcgccaagatccccggggaggtccgcttctgcctcgacgtgcgcagcaccgagcccgcggtgctcgaccggatcgaggcggatctggccggcctcgtcgccgggatcgaggcggcgcggggcgtgcgcttcgcgctgggcgagcgcaccggcagcacgccggcccggatgagccccggcctggtcgaggcgctcgccggccatgcccggcggctcgccctgccgttccgcacgatgccgagcggggccggccacgacaccgccgtgctcgccggccggggcgtgccgagcacgatgatcttcgtccgcaaccagaacggcagccacaaccccgacgaggcgatgcggatcgaggatctctgcgccgccgcgaccctggtggcccacctcgtcgccgaggcgtga

SEQ ID NO: 7367 - DNA, 1251 bp, Methylobacterium sp.
gtgagccggcaggacgcaatcgcggcccgcatcctcgacgaggtggcggagctctcccgcgacacggccggcgtcacccgcgaggcctacgggccgggcgaggagcgggccatgcaggcgatcgagcggcacgccgacgggctcggcctcgtccacgagcgcgaccgcttccagaacctctggctgcgcctgcccgaggatgcccgcaccgcgccgccggtggtgatcggctcgcatctcgattcggtgccccagggcggcaatttcgacgggctcgcgggcgtgctcgccggcctcctcgtgctggaccgcctgcgcgggcgtgccggcaccgccccgccgctgcgcgtcctggcgctgcgcggcgaggagagcgcgtggtacggcaaggcctatacgggctcgctcgccctcctcggacgcctgccggcgagcgccctggcgctgcgccaccgctcgggaaccggcaccctcggcgaggcgatggcgcgctcgggcgtcgatgtcgacgcggtctcccgcggcgaagccctgctcgcgccgggcgagatcgccgcctatctcgaactccacatcgagcagggccccgtgatggtggcgcgggggtggccgtcggccgtcgtcacgggcatccgcggcaacatccgccacacccgcatccgctgcctcggcgaggccgggcattccggcgcggtgccgcgctggctgcgccgcgacgccgtgctggcggtggccgagctcctctccggcatggacgagcactggcgcgtcctgctccagatgggcgtcgacctcgtgatgacggcgggcatctgcaccacggcggccgagtcccacgcggtctccgtcatcccgggcgaggtcgccttcagcttcgagatccgcagccaggaccccgagacgctggagcgcttctacgggctgttccaggaatcctgccggcagatcgcggcggcccgcggcgtcagcttcgcgttcgacgcgcccctgcacacggcgcccgcggcgatggacgagggctggatcggccggatcgaggcggcgggccgtgcgcgcggcacgccggtcgagcgcatcccgagcggggccggccacgacgccgcggtctttgcgggcgccggcatccccgcgggcatggtcttcgtgcgcaacgccaacggctcgcacaacccgcacgaggcgatggagcgcggcgacctgctcgacggcgtcgcgctcctgctgggtgcactcaccggggaatcgggctga

SEQ ID NO: 7368 - DNA, 1638 bp, Methylobacterium sp.
atgagcatgaccgagcccgtcgtccgcatcgagaacctgacgctcgccctgccgaagggggccgaccggccgcacgcggtcgaggggctctccctcgacctgatgccgggcaagatcctctgcgtcgtcggcgagtcgggctcgggcaagtcgatgagcgcctacgcgctgaccggtctgctgccccgcgcgctcaaggtcgcgggcgggcgcatcaccttcgagggccgcgacctcctcgggctcgacgagcgcgcgtggcgggagctgcgcggccggcgcatcgccatgatcttccaggagccgatgacggcgctcaacccggtgatgcgcatcggcgaccagatcgccgagatgttcgaggcgcacggcctcctcacgcccgccgagcggcgcgcccgcgcggtggcgctcgcccgcgaggtcggcctgcccgaccctgagcagatcgtgcgggcctatccccaccagctctcgggcgggcagcgccagcgggcgatgatcgcgatggcgctggcgctggagccctcggtgctggtcgccgacgagccgacgacggcgctcgacgtcaccacgcaggcgcagatcctcaagctgatccgcgagctgcagcagcggcgcggcatgagcgtcctgttcatcacccacgatttcggcgtggtggccgacatcgccgaccacgtcgcggtgctccagcgcggcaagctggtggaggccgggcccgcgcgcactgtcctggagaacccgcaggcgccctacacgcgggcgctgctcgccgcggtgccgagcctgacgccgccggagcgcccgtccgtcgccgcgaacccggtcgcgctctcggtcgccggcctcggcaagacctacacgacccgcggcggcctcttcggaaagccgcgggtcgtcgccgccgtgaaggaggtcgcgttcgacctgcgccggggcgagacccttggcatcgtcggcgagtcgggctcgggcaagtccaccacggcgcggctcgcgatccgcctcgtcgagccggaccgcggcacggtgcggctcggcaccctcgacttcacggcgctgggacctgcggcgctccgcgccgagcggcggcgaatccagatgatcttccaggaccccttcgcctcgctgaacccgcgccgcacggtggagcagatcatcaccgccggccccatcgcgcacggcacgcccgcccggcaggcgcgggcgcgagcccgggaactcctcgagctcgtcggcctgcagccgagcgccgccgagcgctacccgaacgccttctcgggcggccagcgccagcgcatcggcatcgcacgcgctctggcgatggagccggacgtgctggtggccgacgaggcggtctcggccctcgacgtctcggtgcaggcgcaggtcctgcggcttctggaggatctgaagcagcgcctcgggatcgcgatgctgttcatcacccacgacctgcgcgtggccgcgacgatctgcgaccgcatcgccgtgatgcatcgcggggccatcgtggaggagggccccacggccgcgctgttcgccgctcccgagcacccgtatacgcgaagcctgctcgccgccgcaccgggcagcgggagcgtgctcgcccgggcgcagacggccttggcctga

SEQ ID NO: 7369 - DNA, 1599 bp, Methylobacterium sp.
gtggccgtcgccgtccgcgacctgcgcctcgccctgccgctcggcggcgatcggccgaacgccgtcgatggcgtgtccttcgacctcatggcgggcgagatcctctgcctcgtgggcgaatcgggctccggcaagtcgatgtgcgcccatgccctgatgggcctcctgccgaaggcggtgacggtcgcgagcggcagcatccgcctcggcgacacagagctcctggcgcaggacgcggccggctggcgcgacacgagggggcgacgcatcgccatggtgttccaggagccgatgaccgcgctcaacccgctgatgcgcatcggcgaccagatggcggagatgttcgaggcgcacggactgctggccccgcaggagcgtcgggcccgggccgtgacgctcgcccgcgaggtcggtcttcccgatccagagggcatcgtgcgctcctatccccaccaactctcgggtggacagcgccagcgcgcgatgatcgccatggcgctcgcgctggagcccgccatcctcgtggccgacgagccgaccaccgccctcgacgtgaccacgcaggcccagatcctgaagctgattcgcgacctgcagcgtcggcgcaacatggcggtcctcttcatcacccacgatttcggcgtggtcgccgacatcgccgaccgcgtactggtcctgcgccagggccgggtcgtggaggagggcccggccgccgctctcctcgggggcccgcgcgaggcctatacgcaggcgctgctggccgccgtgccggccatgaacccgccggcccggaccgctcccgagggaccgaagaccatcgaggtggccggcctgagcaagacctacgtcaccggtggcggctggtggcgcaagccccggacggttgccgcggcgcgcgacgtctccttcgcgctccgccgcggcgagaccctcggcctcgtgggtgaatccggctcgggcaagtcgtcggtcgcgcgcctcgtgatgcggctgatcgagcccgacctcggcagcgtgcgcctcggcgacaccgatctgacccagctgcgcggagaggcgctgcggggggcccgcagccgtatccagatggtgttccaggaccccttcgcctcgctgaacccgcgccgcaccgtcgggcagatcatcaccgacgggcctgtcgcccacggtgtctccctctccgacgcgcgggagcgggccgtgcgtcttctcggcctcgtcggcctcgatgtgcgggccctcgaacgcttcccgcacgagttctcgggcggacagcgacaacggatcggcattgcccgggcgctcgccctcgaacccgaggtactggtggccgacgaggccgtctccgccctcgacgtctcggtccaggctcaggttctggcgctgctggaggatctcaaggtccggttcggcctctcgatgctgttcatcacccacgacctgcgggtcgcggctcagatctgcgaccgaatcgcggtgatgcgccggggcgagatcgtcgagttgaagacggccgccgatctcttcgcgagacccgagcactcctatacccgcgatctgctcaccgcggtgcccggccgtgcccgggaggccgcatga

SEQ ID NO: 7370 - DNA, 915 bp, Methylobacterium sp.
atggcccaaacaggctcggcgcccacgcgccgcggcgtggccggctggctcggtgccggcctcgccctcgcggcgtccgccccgctgcgggcggcgggcgcgcaggatcctgcggcgcgcctcgcggcgctggccgcgcgggtcggcgggcgcgtcggcgtcgtgctgcgcgacacgggaacaggcgagaccctgctgtcgctgcgcgcgcaggagcgcttcccgctctgcagcaccttcaaggtgctcgccgccgccgcgatcctggcgcgggtggagcgggacggggagcggctggagcgcgcgctgccgctcggacccgacgacctgcagagctacgcgcccgtcgcgcgcaaaagagtcgaggcggccggcggcaggaccgcgatgacccttgaggaggcctgtgccgcggcgctcgtctggagcgacaacacggccgcgaacctgctgctcgacgcgctcggcggcccggacgcgctcaccgccttcctgcgggcgcagggcgacgccaccacccgcctcgaccgccgcgagcccgagctcaacaccgcgcttccgggcgacccgcgcgacaccaccacccccgccgcgatggccgcgaccctcgaccggctgctgctgggccccggcctcgcccccgcctcccggacccggctggagggctggatggtcggctgccgcaccggcctgaagcgcctgcgcgccggtctgcccgccgactgggggatcggcgaccgcaccggcaccggcgacaacggcaccgccaacaccgtcgcgctgctgcacccgccggggcgtgcgccgctcgtcgccacggtctacatcaccggcgcagaagggccggtcgaggcgcgcgacgcagcccatgccgagatcggccggatcgtcacggcgcgcgtcgcaggattctga

SEQ ID NO: 7371 - DNA, 759 bp, Methylobacterium sp.
atgacgacctcgatcggagccgtcgcggccggctggacggtggcggagcccgctgcaggtgccggagtcaccatctggctcgtcgatctcgccctgtcgtcgccggccctgacggcttgcgacgcggtgctgtcggcggacgagcgcgcccgggccaaccggtttctaaggaccgaggatcgcgaccgctaccgcgccagccacgcggccctccggctggttctcggtcgcgccctcggcgccgacccgcgcaatctcgccttcgcggccgggccgaacggcaaaccggagctcgcgggcgcggtgcgggaggcgcccggcttcaacctctcgcactcgggtcggcttgcgctcatcggcctctcggcgtgccgtcccatcggggtcgacgtcgagatgatcaggccgctgcccgacgcgctccgcatcgcccgcggtcatttctcagccgacgaggccgaggccttggcggcagcgcccgagcgcgagcgcgtcgcaatcttcttcggtctgtggacgcgcaaggaggctgtggtgaaggcgctcggcgccgggcttgccctgcctctcgaccacttcagcgtgacgcttccgcccgccgcgccgcgcctgctgcggatggcggacggcctcggtggctggacgctcatcgacctcgaactcgggcccggctacgcggcgaccgcggctgtcgcagaagacgatgttccggtcgttctgcgagcacttccagcaggttggccaagccatctcctgtga

SEQ ID NO: 7372 - DNA, 762 bp, Methylobacterium sp.
atgatgctcccggctccccgatacgccgccctgttcggcgcgatggtcctcgccctggcgggggcctgcagcgcgccgacccgtgccgagcctgcccggggcgagccgctgcgggcggtggtcgagctgttcaccagccagggctgcgccgtctgtcggggcgccgacccggtcttccgggagctcgccggccggcccggcatcgtcgccctgaccctgcccgtgacctactgggactatctcggctggaaggacacgctggcgcagaagcccttcacagagcgccagcacgcctatgcgggcctgcacggcatccggcaggtcttcacgccgcaggccatcgtcaacggcgccgcatcggtggtggcctccgaccggaccgggctggagcgcatcctcggacgggaggcggcccagcccggcgggttgccggtgccggtgcgcggcgaggagcgcggcgaccgcatcgtgatcgacgtcggcgccggcggccagcggggcgaggtctggctcctgtccgtgctgcggcgccgccccgtggcgatcgagcgcggggagaaccggggccgcacggcgacctacctcaacgtggtgcgcggcatgcagcggatcgggacctggagcggtcagccggtccattacgaggtgccgctcccgaccgcccatgtcgccgacgccgattcctgggtcgtcgtgctgcagggggcgagcaacggcaagccgggccggatctggggcgccgccaaggggcccgggctgtag

SEQ ID NO: 7373 - DNA, 969 bp, Methylobacterium sp.
gtgagggcgccccgcctcgtcctgccgcgcggcaatttctcggacattcgcgccgcggcgccggccgtacccgtcagcccgcgagcggaggcggatccgcaggcacgctggcgcgacctcgtcgaccggcgcctgccggaggccgcccgcgcccgcccggactggccggtgcgtctcgaccacggcttcgcccgcatcctgctcgacaacgcctgcggcggcccttggcgcgagagcgtgcgcccgcccgcctgggccaacatgccgccggagcgcctcgcactggcgatcgagctcggcgaggccctgctcgcgggccgcgccgagctcgacctcctgaaccgccgctcgctgctctggcgcggcaagcgccgggcaccgccggcacccgacgaactggtcgcgccgggcggcctcctgctgcggcgctggcggcggagcgacgacgggccgttcgcgaatctcaacgcggatccggccgtgatggcccatttcccgagcctgcgcagccgggccgagagcctgaacgaggcccgcgccttcgaccgccgcttcgaggcggacgggttcggcccctgggcggtcgaggaggccggccgcttcgtcggcttcgtcggcgcgctgcggatgatgcggccgatgcccttccggggcggcgagcggccgggcgagggcgtcgagatcggctggcggctcgcccgcgatgcctggggccgcggcatcgccacgcgcgcggcccgcgccacgctcgccgacctgttcgggcgctgcggcgtgcccgcggtcgtcgcttacacggcggagggcaacggcgcctcgcggcgggtgatggagcgcttgggcatgcgcccggacgccaccttcgcccacccggcgatcccggcggatcatccgctgagccgccatatcctgtaccgcatggacgcgcgggatctccgcgaacgggacctgcccggaggaagcgcatga

SEQ ID NO: 7374 - DNA, 1620 bp, Methylobacterium sp.
atgaaccgggtccgctccgccctcgcggcgctcgcgatgctgacggtggcggcgctgccggcctccgccgcgcccctcgaccgggcggcgctggcggcggatctctgcggcgacgcggccgcccaagcgcgcggggcggagggcgtggtgcgcgccgccgccgacgcctcggccgaggatctgagagcggccggccagctgctggcggccctcgcggagcgacgccttgcctgtgggagtgcgggcgccctgctgctcgacggcgcgggcgctccggtcgggcgcgacgcgctcacgggcgcgacgcgccccgccgccgaggcgcgcgcgccggtgctcggcctgcgccagcgcgctctcgtggagaccgcacgcgccgccgtcgcgctcctcacggccgagagcgccgccgcgcgcgccgccgggctcgccaccctggagcggcgcgccggcgcggtcccggatacggtcctggcgcgggcgcgggacgccgagagcgatcctggcttgagggcctcgatcgcgggcgcggcccaggccgccgccctgtcgtcggccgatccggagaagcgccgcgccgcgatcgcggcggtggcggccgccccctcgggcgcagccctctcgcggctccgggccctgcggagcgagcccgccgccgcgtccgacccggccttcgcctgggcgctcgatgccggcatcgcctcggtcgagcgggcggtgcggatcggggactgcctcgcgatcctctacaacggcctgagcttcgccagcatcctgttcatggctgcggtcggcctcgcgatcatcttcggcctgatgggggtgatcaacctcgcgcagggcgagttcatcatgctgggcgcctacgccaccttcggcgtgcaggaggccttccgacacctcgctccgggcttgctcgacctctacctcatcgcggcgatcccggtggccttcggggcgacggcgcttgtcggcatcgcggtcgaagccctcatcctgcgccacctctaccggcgcccgctgatgagcctgctcgccacctgggcggtcagcctgtttctggtgaacctcgtgcgggtcgcggtcggcacccagaacctgcaattcgccatgccgccctacgtcagcgggggcgtgccgctctacgccgacttcgtcgtcacctggaaccggctcttcgccatcctgttcgcggccgcgaccctcgcgctgaccctcctcgtcctgcgccggacgccgctgggcctcgacatccgcgccgtgacgcagaaccgcgacatggcggcctgcctgggactgcccacccgccaggtcgaccgcctcgccttcggcctgggctccggcctcgccggcctcgcgggcgtggcgctctgcccgatctacagcgtgaatcccggtatgggctccggcttcgtcatcgacgccttcatggtggtggtgctcggcggcgtcggcagcctcgcgggcacgctggtggccgccctcgggatcggcggcgccaacgtgctgatcgagccgctctcgggtgcggtcgccgcgaaggtcatcgtgctcgtcggcatcatcctgttcctgcagcgccggccggaaggcctgttcgcggcgaggcggcggcgatga

SEQ ID NO: 7375 - DNA, 1587 bp, Methylobacterium sp.
atgatccgtattctgatctttctgaccttactcggcctatccgcgcctgtccttgcgcaggacgccccgccggccgatgcctacacgcggctcgcgagcgacagctacggtgacatcgaggccggcatcgcggggcttgccgcgagcggggatccgcgtgcgggcgcggtgctcggcgccctcgcggagggcaggcttctctaccgacccgccgacaagacgcttttcatcaagcagggcaacgacttggtggacgctcgcacgggccgggccgcccaggccgagggactgaagccggtgcgcgccaacaacaagatccgccgcgcgctcgaggctgcgcagggtcagctcaacctcacgagccccgatccggccaagcgccgggaggccgccgaggcggtgttcaaggcgcgcgatcccgtcggtctacccgcggttgagcgtgcgctaaccgcggaatcccacccggacgtgaagcgggttctcgcagccgcccgcgccgccgtgctcctcgcccggcccgagacgccggagaacgagcggctcgccgcgctgccgtcgatccaggcccggggcgacggcgacgccatcgcgatcctgaggaacgtcgcggcgaacgacccgagcgagacggtgaaggccgcggccgcccgcggcatccaggcggtcgagacccggctcgccgtggcggcggccgcccagaacgtctggtacggcatctcgctcggctccgtgctgctgctcgccgcgatcggcctcgccatcaccttcggggtgatgggcatcatcaacatggcgcacggcgagatggtgatgctgggcgcctacacgacctacctcgtgcaggacgcgatccgtgcccacgcgccgggcctgttcgactggtcgctcgccatcagcatcccctgcgccttcctcgtggcgggcgcggtcggcgtcgcgatcgagcgcggcatcatccgcttcctctacgggcgcccgctcgagaccctgctcgccaccttcggcgtcagcctgatcctgcagcagagcgtgcgctcgatcttcggccccaccaaccgcgaggtcggctcgccgggtttcatgtcgggcgccttcgacgtcgccggcctctccatcacctggggccggatgtggatcgtgctgttcgcgctcggcgtcttccttgggctgctcttcgtgctgcgcaagacgtcgttcggcctgaagacccgcgccgtcacccagaaccgccggatggccgccgccatgggcatccgcacgccctgggtcgacgcgatgacgttcggcctcggctccggcatcgccggcatcgcgggcgtggcgctctcgcagatcgacaacgtctcgccgaacctcggccagggctacatcatcgactcgttcctcgtggtggtgttcggcggcgtcggcaacctctggggcacgctggtggcggcgctgacgctcggtgtcgccaacaagctgttcgagccgtatttcggcgcggtgctcgcgaagatcgcgctcctcgtcttcatcatcctcttcatccagaagcgcccgcgcggcctgttcgcgctcaagggccgggcggtggagtcctga

SEQ ID NO: 7376 - DNA, 1098 bp, Methylobacterium sp.
atgagcggcgcggtgcagacagggctcgccgcccccgcccgcccccggcgcgcgccgcgcgatcccctggtcacggtcctcgtgggcctgtgtctcgccgcggcgctggggctcgttctgggccggcccgccccctacctcgtcaacgcggtgggccagctcgccgccttcgcgatcctggcggtctccctcgatctgatctggggctatctcggcattctcaccctcgggcacgggctgttcttcgcgatcggcggctacgtctgcgccatgcatctcctggcgcacgggaccgtcgtgacgggcacgctgccggatttcgtgcagttcatgggctggaagggcctgccggcctactgggccggcctggagcacgcgccctacgcgctcctgctggcgctcgggctcgccggactcgtcgccttcctgttcgggctcgtcgcgttccgctcgcgcgtcaacggcgtctacttctcgatcatcagccaggcgctcgtctacgtcgcgatgctgctgatgtaccgcaacgacaccgggctcggcggcaacaacggcatgacgggcttcccgctgctgttcggctggccgatgggctcggccggtgcggtcaccggcctcgcggtggcggcgctgcttgtcctggcggcggtgcttgcggggacgcgcctcctcgtcggcagcgcggtcgggcgccggatgctcgcctgccgcgacgacgagacccgactgcgcaccctcggctacgcgaccacgcggctgaagctccagatctggtgcctctcggcgatgatcgccgcgctcgccggcatcctctacgtgccgcaggtcggcatcatcaacccgcgggtgctcgcgcccgacctctcgatcgagatcgccgtctgggtggcgatcggcgggatgggccggctcggcggcgcggtgatcggcgccgtcctcgtcaacgccctgaagttctggctcagcgccgcgatgccggaggcgtggcccttcctcctctcgggcctcgtcctcctcgtcgtgctggtcctgccgaacgggctcctcgacatcgctggcctgcgcatgcggccgacctgggcgcgaggcgcccgatga

SEQ ID NO: 7377 - DNA, 1149 bp, Methylobacterium sp.
atgacccgcacgcgcctcatcgacccgaagggctggatcttcctcggcgcgctcgccgccttctgcctcgtggtgccgctcctcaacctcggggtcgccgagggctcggggctgcacctgccgacctaccttgtctcgctcttcggcaagtacctggccttcgcgctgctcgcgctgagcctcgacctcgtctggggctattgcggcatcctctcgctcggccacggcgccttcttcgggctcggcggctacgcgatgggtatgtacctgatgcgccagatcggcccgcgcggcgtctacggcaacccggtcctgccggacttcatggtgttcctgaactacaaggaactgccctggtactggctcggcttcgacaccttcgccttcgcggccctgatggtgctggcggtgccggggcttctcgccttcgtgttcggctggctcgccttccgctcgcgggtgacgggcgtctacctgtcgatcatcacgcaggcgatgaccttcgcgctgatgctggccttcttccgcaacgacatggggctcggcggcaacaacgggctcaccgacttcaaggacatcctgggcttccccgtccaggcgcagggcacgcgcgtggcgctcttcgtcgccaccgggatcgcgctggcgctcggctatctggtggcgcgcttcatgacggtctcggcctacggcaagatcctgatcgcggtgcgcgacgcggaatcgcgcacgcgcttcctcggctaccggccggagcactacaagacgctggccttcacggtctcggccatgatggcgggcgtggccggcgccctctacgtgccgcaggtcggcatcatcaatccgggcgagttcgcccccaccaactcgatcgaggcggtgatctgggtcgcggtcggcgggcgcggcacgctggtcggcgcggcgctcggcgcggtcatcgtcaactacgccaagacggtgctcaccggcgcgatgcccgacgcgtggctcttcgcgctcggcgccctcttcgtggtggtgaccctgttcatgccgaagggcatcgtcggcagcctgatcgagcgcttcggcagcccgcgggcgcgggccaagctgccgcccgagcccgagatcgcgccgaaactcgccgaagaggggcagggctga

SEQ ID NO: 7378 - DNA, 1227 bp, Methylobacterium sp.
atggcgcatcttacgcggcgcggcttcatcggatctgcggcgctgcttgcagcccccgcgatcgtgcggcccgccttcgcggccgacaccgtgaagctcggctgcctgttctcctcgtcgggcacgatggccaacatcgagggccggctgaaccacgtcgtccgcatggccgccgacgagatcaacggccgcggcggcgtcaacgggcgccgcatcgaggtgctgacctcggatcccgcctccgactggccgctctacgcgcagatcggccggcagatgctgcagcaggagcgggtggcggccctgttcggctgctggacctccgtgtcgcgcaagtccgtcctgccggtggtcgagcagaacgacgggctgctgttctaccccctgcatttcgagggggacgagaactcgaagaacgtcgtctacgtgaactcgccgcccgccagctcggtgctgccggcggtcgactacctgatgggtccggacggcgtgggcgccaagcgcttcttcatgatcggctcggactacgtctggccgcgcacgatcaacaagcagcttaagggctactggaagagcaagggcatcctcgagagcgcgtggcgcgaggaatacgtgcccttcggcttctcgaacttccagacgctcgtgaaccaagtgcgcagcttcgccagccagccgggcggccagccgatcgtcgtgctcaccgtcgtcggctcgtccatcccggacttcctgcgcgagttcgccaaccagggcatcgccgccaccgacgtgccgatcctcggcctcgacatggtggaggccgatctcgaagggctcgatacgggaaagctcgtcggccacctcaattgctgggcctatctccaggccgccaagggcgagcggaaccagaccttcctcaccgactgggccgcctacgtaaaggcgaagagcgtcccgttcagcgccgacaccgtgatcgacccgatggtctcggcctatgacagcgtccatctctgggcgctggctgccgcaaaggccggctccttcgcggtgccggaggtgcgcaaagccttcgcgggactcagcttcgccgacccttccggctacaccctgaccatgacgggggagaacacctacgtctcccgcggcgtcttcatcggctcggtcaacgagcggcgcggcttcgacgtgctctggcaatcgcccgacgccccgaagccggtcccgttcagcccctatggctga

SEQ ID NO: 7379 - DNA, 1242 bp, Methylobacterium sp.
atggcgctggcctccctgagcgtcggcaccgcacgcgcgcaggagaccatcaaggtcggcatcctgcactcgctctcgggcacgatggccatttccgagacgacgctgaaggacgcgatgctgatgctcatcgcggagcagaacaagcggggcggcctcctcggcaagaagctggagccggtcgtggtcgatccggcctcgaactggccgctcttcgccgagaaggcgcgcgaactgatcgcgaaggacaaggtctcggccgtgttcggttgctggaccagcgtgtcgcgcaagtccgtgctgccggtgttcaaggagctcaattcgatcctgttctatcccgtccagtacgagggcgaggagagcgagcggaacgtgttctacaccggcgctgcgccgaatcagcaggcgatcccggcggtcgactacctgatgaaggaggagaaggtcgagcgctgggtgctggagggcaccgactacgtctacccgcgcaccaccaacaagatcctcgaggcctacctcaaggccaagggcgtgaagcccgaggacatctcgatcaactacacccccttcggccagtccgactggcagacgcgcgtcgccgccatcaagagcttcggctcggccggcaagaagacggcggtcgtgtcgacgatcaacggcgacgccaacgtgccgttctacaaggagctcgccaaccagggcatcaaggcgaccgacatcccggtcgtggccttctcggtcggcgaggaggagctggccggcatcgacaccaagccgctcgtcggccatctcgcggcgtggaactacttcgagtcgatcgacacgccggagaacaaggccttcatccagcaatggcaggcctacaagaagaacccgaaggccgtcaccaacgatccgatggaggcccactatatcggcttcaacatgtgggtgaaggccgtcgagaaggccggtacggtcgatcccgacaaggtcatcgccgcgctgccgggcaccgagcagaagaacctcaccggcggcacctcgacgatgctgccgaaccaccacatcacgaagccggtctatatcggcgagatcaaggacgacggccagttcgacgtggtcaacaagaccgagggcctgatcccgggcgaggcgtggtcgaagcagctcgaaggctcgaaggacctcgaggccgattgggtcaatctcaactgcggcaactacaacaccaagaccaagaagtgcggcggcgcctga

SEQ ID NO: 7380 - DNA, 1623 bp, Methylobacterium sp.
ttgtccggcctgagcggcggcttcgcgatcatcaaggtcgatcaggtctcggcgatcggcgcggcgctggcccgccaggtcgaggccgtgacactgctgggcgacctcgctcgcctcagccagcagcttcgggccctaacggcgctgcagcactacagcccgagcgagacgcagcgcagcgcctatgagcgggaagccgaggagggccgcgtcgccttctcgaaggcctggggcgactacgcgaccctgatcgagggcgcgcgcgagacccagctcgccgaaaccctgcgtaacgcgtggcagcacttcctggcgatcgaagaggagatcctcatcctcgaccgggccggcctgaacgagaccggaacagctgtgctgcagggtgacatgctctcggaggccgccaacttctacaccgcggtgcgggccgtgcaggcctatcgtcaacaggaggtcgagatcgccacggccgccgcccaggagatccgcgcctcggcccgcttctggatcgtctcggccttggcctgtctgctgacgctctgcacgctggccggctggcttctgacgatgacgatctcccgcccgatcgggcgcatgaccggcgtgatgggccggctcgcggatgacgacatcggcgtcgaggtccccgatcagcgccgctccgacgagatcggcctgatggcggccgcggttcaagtcttcaaggacaacatgatccgcaacaaggctctcgaggccgaagtggccgcccagcgcgccggggcggaggcgcagcgccggatcgccatgcgcgagttggcggacgcattcgaccagtcggtcggcgggatcgtcacggccgtctcctcggcggccgttcagatgcagacgaccgcccgccaactctcggtgtcggccgaggccacctcggtgcgcgccgtggcggtctccgcggcggccgaggaagcctccgtcaacatccattcgatcgcgggcgctgccgaggaactcgatgcctcggtgacggagataggcgttcaagtcgagcgctcctcggcgatgtcgcaggccgccgttcgggagaccgagggaatgactgcgctggtgcgcgagctgacgggcgtggccgccagcatcggcgacgtcgtcgacaccatcgccggccttgcgggccagaccaacctgctggcgctcaacgccacgatcgaagcggcgcgggccggggaagccggccgcggcttcgcggtcgtggccacggaggtcaaggaactcgccaaccaaacctcccgttcggccagcgagatcacggccaaaatcgaggcgatccagtcctcgactggacggaccgccacggccatcgatggcatctccgcctcgatccgctcgatcaacgagacggcgaccgccatcgcgtcggccatcgaggagcagggggcggcgacgcgcgagatcgttcaggccattgcccaggcctcgagcggcaccggcgaggtgaccgccaatatctccggcgtggcgagcaacgtcgaggaaaccgggaccggcgccgcgcaggttctgtgcgcctcgggcgaacttgcccagcaatccgatctgctgcgccgacaggtgcagtcgttcctcgacaccgtccgtgccgcctga

SEQ ID NO: 7381 - DNA, 720 bp, Methylobacterium sp.
gtgccctccctccgctccgtctgcttcaacgcctactgggcggcctggaccgccctgttcctcgcgccgctgctcgccttcgcggcgagcggcgcgcccgcccggccgatccgggcggcgacccggctctgggcacgcggcatcctgttcgggctccggggcatcgtcgggctgcgctacgtcgaggagggccgcgagcgcatcccggccgggccctgcctgatcgtggccaaccaccagtcggcctgggagaccctggccttcctgatcctggtgccggacgtggcgatcatcgccaagcgcgagctcgtggcgatcccggtggtcggctggttcctgcgccgctcgccgatgatcatcatcgaccgggccaacggaacccaggcgctgcgcaccatgatcgacgagagccgcgcggcggtggcggcgggccgctcggtgctgatcttccccgagggcacccgcagcgccttcggggcgccggtgcagttcaagcgcggggccgagctgctctacggcaagctcggcctgccggtgctgccggtggcggtcaattccgggctgtactggccgagcgggtcgcgcagccggcccggcaccgtggtggtgagctacctcgcgccgctggcggcgggcctctcggccgccgccttcatggaggggacggagcgcgcgatcgagcgggagctcgaccgctggcgcccggtcgtggcggcctga

SEQ ID NO: 7382 - DNA, 1599 bp, Methylobacterium sp.
atgggcgtgaacagcatgaggcacttggcgctgaggttcgctctggcgacagccatgactggggtgctctctattcagacggcatcgtctgcatccgccaagacgctccgagcggtcatgagttccgatcttcggattctcgatccgatcatgacgacggcctacattacccgtaatcatggatacatgatctacgacacgcttctttcgatggactcgtcgttcagcgtgcggcctcagatggccgattacacgatctcagacgacaacatgtcgtacacgttcaagctgcgcgagggcttgaaatggcacgatggtcagcctgtaaccgccgaggattgcatcgcctcgctcaaacgctgggctgccagagatgcgatggggcaactcctctacaagcatgtcgccgaagtgaaggcgtccgacgatagaaccttcacattgcgcctcagcgataaatattcgcaagttctagagtcgatcgcgaagccttcgatcgtcgtgcctttcatgatgcccaagcgtctcgcggatacgccagcggacaagcctattcccgagcagatcggatccggtccgttcaagttcgtcgcatcggagttcaagccgggggttcaggcagtctacgttaagaacaccgactatgtccctcgcgccgagccgcagagctgggccgcaggcggaaaagtcgtcaaggtcgatcgcgtcgagtgggtggcgatgcccgatccgcagacggccatcaacgctcttctctccggtgaagtcgatttcgtggaagcgcctccggtggatctgctgccgatcgtcgcttccgagcccaacatcatcatcgaaggactgaacccgctgggtgcgcaggtcttcggccggatgaacttcctcaatccgcctttcaataatcccaagctgcgacgtgccgcgatgttggccttcgatcagcgggacttcatgaatgccctggcgggcgaccccgcctacttcaagctctgcgccgccatgttcgcctgcggcacaccgctggagacgccggtgggcggcgagatgctcaccagcggcggcaatctcgcagaggcgcgagaacttctgaaagaggcgggttataagggcgaacccgtcgtcattctccagaccaccgacgtctcgtatcttcgcagttcgccggtggtggctgccgaggcactcaagaaagtcggcttcaacgtcgacagtcaggcgatggattggcagaccgtcacctcgcgccggacgagccagaagcccgtctcggaaggcggctggagcttgttcttcacgacccaggtcatcgcggacgtgatgaatccgctcgggaacacgatggtttcgggcgaagggaagaagggctggttcgggtggccggatgtgccggagttgaaccagctgaaactggattacagcagggcaaagaccgccgaggatcgcaagcagatcgccaccaagatccagaagctggcttatgacaatgtggtctacattccggtaggacaatattacaatcagtcggtatatagcaaaaatttgaagggagtcagcaaaggtccggcggctccgtatttttggaacatcgaaaaggattga

SEQ ID NO: 7383 - DNA, 906 bp, Methylobacterium sp.
atgttcgccccctcccccacgatgctgctggagacaaggggttcgcccgcgcggcaggcgacgctcgccgccgccttcgagcgcctgggaccagggctgcataccgggcgccgggcgaaggtgcgggtctcgccggccgcggccgggagcggcatcctgttccggcggaggttcgaggacgggcggtcggccgacgtgccggccctctggcgctaccgtgaatcgcagcccctgtgcacggccctgcgctcgcccgagggcgtgctggtgcgcaccgtcgagcacctgctggcagcgctcagcgcccaccgcatcgacaacgcgctggtcgagatcgacgccgaggagctgccgatcttcgacgggagtgccctgccctggtgcgcgggcatccgcgaggccggccgcgtcgagcaggatgccccgcgccgggccgtgcgggtcctgcgcccggtggaggtgcgggcgggtgagcgctgcctgcgcgtcgagccctgcgacgtcctgcgcatctcggcgcatctcgcccttgcgcacttcccggcgatggactggaccggcccggtcgatccggagaccttcgaccacgatctcgcgccgtcgcgcagcttcggccggttgaagtgggcggtgccgctgaagatctacagcgccctgaccggcaaaccggtactgcgcggcgccaacctccacaccacggccggcatcctgggcagccgcgtcgtcggcggcatgcgcgtgccggacgagccggtgcgccaccgcgcgctggacctcgtcggtgacctcgcgctgatcggtcacccgctcctcgggcacgtcacggccgcgcatacggggcacgagctgaaccacgcgctcgtggcgcggctgatggcggaggcggacgcctgggagctgctctga

SEQ ID NO: 7384 - DNA, 1176 bp, Methylobacterium sp.
atgaacgctgccgcgagggtgccgcacccgctgcttctcgggtgcggcctgatgctggtcgcgttcaacctgcgcccggcgctgaccacggtcgggccgctgctcgccgcgatccgcggggagacggggctcggcgccgcgggtgcctccgtgctcaccaccctgccggtgctgttcctcggcctcgcctgcgtgctcgctcccgcgatcgggcggcgcctgggaccggaccgcggcatcctgctggccaccgcggtcgtcgccgcggggctggcgctgcgggcgctcggcggcctcgggacgctctttgccggggcctgcatcgccgcgctgggcatcgggctcgcgaacgtgctgatcccgggcctcgtcaaacgcgagttcccggggcgcgccggcctgatgaccggcctctacacgatgacgctctgcctcggcgccgccgcgggtgccggcctcaccgtgccgctccagggcctgttcggcggggactggtcgctggcgctcgccgcctgggcggcgccggccctgctcgccgcgctcgcctgggcgccgctggcccgaccggccacccccgttcctgccgcgctgccccgccggtcgatctggcgcgagcccctcgcctggcaggtcacgggcttcatgggcctgcaatcctccctcgcctacatcctgttcggctgggtgccgctggtgctgcacgaccggggcctcagcaccgtcgatgccgggttcgtcgcggccctgatgagcgtcgggcaggcgccggccgccctgctgctgcccaccctcgccgcgaagctcagggaccagcgtggggcggcactcggcatcgtggggctcaccgtggcctgctatctcgcggtcgtgcacgggcccgtcgcgctgctggtcccggcgacgctcgccctcggcttcgggatcggcggctgcttcgggctggggctcaccatcatcgtgctgcgcgcgcgcgacacgcagggcgcggccgcgctctcggccatggcgcagggcgtcggctacaccatcgcctcgctcgggcccctcggtttcggcctcgcccacgaggccttcggcggctgggccgcctcgtcgctgctcttctgtgccctggcggcgggtgccgccgtctgcgcgctcggggccggccgcgcccggcaggtcggcttcgcgtga

SEQ ID NO: 7385 - DNA, 1203 bp, Methylobacterium sp.
atgcgcgcgctcgtcctcgccgctctgatcggcctgtccggcctgcagaccgcggccgcagcgccggaccgcgccgccctgtgcgcggcgcaaggtggcgcggcgcaagcgcgcccggagagcggcgcggcggacggcgtgccggcttccctcgtcggtcggctcgcccggggcttcaacctgaccggctggatcgagggggacgacccgagagcgcccgaccccgccctcctgcggcgcctgctcgcccgcggcctgacccatgtgcgcctgcccttcgacggcgagcatctgatgccggccatcggtacggcgggccgggccgagcgcctcgcccgcctcgacgcggccctgcggcagctcctcgatgccggcttcacggtcagcctcgacatgcatccgggcgaccgcttcggcgccctgcaccgcgccgagcccgagcgggcgctggcgatgctcgacgcggcctgggcggtcctggcgcggcgctacgccagcctcgccccggaccgcctcctgttcgaggtgctgaacgagccgccgaacgcgcaggcctgggccggccaactgccgcgcgccgtcgccgccctgcgggtccacgcgccgacccggatcctcgtcgtgtcgcccggcgggccgcagcgggtcgaggcgctggcggcgctggcgccgctcgacgacccgcgcctcgtctacgccgtccacttctacgacccgatggccttcacccaccagggcaacgactggggcggcgcggacgaccccctgcgcttcctcggcggcctgcccttcccggccgccgccggcgacccggcggtccgggccgtcacggaccggctcgcgcgcgagggccggcgcgcggcggcggccgagctcgccgggcagatccggcagccctggacggcggaggcgatcgaccgccagttcgcgccggtcggcgactggatcgcgcgccaccgccgccccgtgatcgtcaacgagttcggagccctcgacaccgccgccgtacccgaccgcgcccgctggctcgccgccgtgcggggggcggccgagcggcgctgcatcggctggacccactgggactacgcggacgccttcggcttcgtcgaccgccgcgacggcaccgagcgcccggtggcgcccctcctcgacgccctcatcccgccgaaggccgcgcccggttccgcaaccgggcgcgactga

SEQ ID NO: 7386 - DNA, 336 bp, Methylobacterium sp.
ggcaagcgcgtcgtcatcgcgctgcagtacatccacggcatcggccccaagaaggccgaggagatcaccggcaaggtcggcatcccggccgagcgccgcgtgaaccagctcaccgacgccgaggtgctccagatccgcgagacgatcgaccgcgactacatcgtcgagggcgatctgcgccgcgaagtctcgatgaacatcaagcgcctgatggacctggcctgctaccgcggcctccgtcaccgcaagcagctgcccgtccgcggccagcgcacccacaccaacgcccgcacccgcaagggcaaggcgaagccgatcgccggcaagaagaagtaa

SEQ ID NO: 7387 - DNA, 1029 bp, Methylobacterium sp.
atgacggcacggagcatcatccggctcgtcggcacggtcgcggccctgtgcggagcgctcggcgccgcccgggccgaggtctcgaccgtccggctcgccaagcagttcggcatctcctacctgccgctgacgctgatggaggaggagggcctgctggagaagcaggccaaggcccgcggcctcgacgtgaaggccgagtggctgcgcttcaccggcggctcggggatgaacgaggccctgctctcggggaacctcgatctggcggccggcggcgtcggcccgttcctgacgatctggggccgcacgcagaccaacatcagggtcaagggcgtggcggccctgaacgcgatgccgctctggctggtcacggtcaatccggacgtcaagtcgatcaaggatttcggcccgaaggacaagatcgcgctgccgaccgccaagacctcgatccaggcgatcaccctgcagatggccgccgagcaggccttcggcgccggccagcagggcaagctcgacccgctcaccgtctcgatgggccatcccgacgcgcagaccgcgatgatgggcgggcgctccgagatcacggcgcatttcggcgcgccgcccttccaggagatggaactgaaggacccgcgcgcccgcaaggtgctcgacagctacgacgtgatgggcggggcgcacaccttcaacctcgtctgggcctcgagccgcttcgtcacggccaatcccaaggtgacggaggccttcctggccgcgctggaggacagcctgaggctgatccgcgacgatccggagcgggccgccgcgctctggatcaaggcggagggctcgaagctctcgcaaggcgaggccgtggcgatcatccgcgcgccgcagaacgaatggaccacggcgcccaagcgcatgctggactacctcgcctacatgaaccgggccgggctggtctcggccaaggcgggcgccgagagcgagctgttcttccccgcgcccgaggcggcgaaggccggcggcccgaaggaggccgcgcggtga

SEQ ID NO: 7388 - DNA, 1032 bp, Methylobacterium sp.
atgcgtctgcgactcagcctgttctcccgtccccggatcgccgccatgctcggcggcctgacgctcatcggggcggcgttgagcccggttgcggccggggaaggccagttgcgcatcgccaagcaattcggcgtggtctacctgctcttgaacgtcgccgaggaccagaagctgatcgagaagcacggcaaggccgcggggctcgacatcaacgtcgagtatctgcagctctcgggcggctcggccgtcaacgacgcgctgctgtccggcaatatcgaggtggcgagcgccggcgtcgggccgctgttcacgctctgggaccgcacccgcgggcggcagaacgtccggggcgtcgcctcgctcgggaacttcccctactacctcgtgagcaatcgccccgaggtgaagacgatcgccgacttcaccgacaaggaccggatcgcgctgcccgcggtcggcgtctcggtgcaggcgcgcatcctgcaatgggcctcggccaagctgtggggcgacaaggatttcgccaagctcgatccgatcagcgtcgcggttccgcatccggaggccgcggccgccatcatcaagggcggaacggagatcacgggccatttcggcaacccgcccttccaggagcaggagcttgccgagaatcccaaggcgcgcgtcgtcctgagttcctacgacgtccagggcggcccggcctcctccaccgtgctctacgccgccgagcgattccagaaggacagcccgaagacctacctggccttcgtcgatgcactcgacgaggccgcgaagttcatcgccgccaatccggagaaggccgccgacatctacctcaaggcgaacaacagccgcatcgaccgcgacttgctgctgaaggtgatcaagaaccccgaggtcacgttcaaggtcgagccgcagaacaccctcggcctgggccagttcatgcaccgcgtcggtgcgatcaagaaccagcccaagtccctggaagactatttcttcgtcaatccgcgcatcgcggcgggcagctga

SEQ ID NO: 7389 - DNA, 1149 bp, Methylobacterium sp.
atgccagcattccggaccggtcagcgtctcaaccgccgggtggcccttgcggccctcgcgctcgcggcgctgccgctcgggcccctctccggctccctcttcggctccttgcccgcccgcgcccgcgagatgccggagaccgcggcgggtcaggcggcgcgcaagccgaacgtcgtggtcctggcgaccggcggcaccatcgcgggcgcgggggcggatgcggccaacagcgcgacctaccaggccgccaaggtgccggtggacaagctgatcgccgccgtgccggcgatgagcaccgtcgccaacgtgcgcggcgagcaggtcttccagatcgcctccgagagcttcaccgacgcgcaactcgtgcagctcggcaagcgcgtctcggcgctgctgaagcaggacgacgtcgacggggtggtgatcacgcacggcaccgacacgctggaggagacggcgctcttcctcgacctcgtcgtcaagagcgacaaaccgatcgtcgtcgtcggctccatgcggccctcgaccgcgctctcggcggacggcgccctcaacctcctcgacgcggtcacggtcgcgggctcgaaggaggccgtcggcaagggcgtcatggtcacgatgaacgaccagatccaggccggtcgcgacgtcaccaagcgcgtcaacgtggtgccgagcgccttccagagccagtggggcccgctcggcatggtggtcgagggcaagacctacttcttccgctcctcggtgaagcggcacggcaagagctccgagttcgacatcgaccagatcgacagcctgccgctggtggccatcgtctacggctcgggcaccatgtatccgggcgcctacacggcggcggtcgcggcgggcgccaaggccatcgtcaacgcgggcaccggcaacggctcggtcgcgggctacctcgtggacacgctgaaggacatccggtccaagggcacgctgatcgtgcgctcgtcgcgtgtcggcgacggcatcgtgctgcgcaacgccgagcagcccgacgataaatacgactgggtggtggcccacgacctcaacccgcagaaggccaagatcctcaccgcggtcgcgctgacgaagacgaacgacaccaaggagctgcagcgcatcttctgggagtattga

SEQ ID NO: 7390 - DNA, 312 bp, Methylobacterium sp.
atggaacccatgaagccgatgaaaccgatggcgcccatgaagcccatgaagcccatggagccgatgaagggcaccgatccgtggtggccggaggatctcggcagtccggcgagcagcggtgctcagaacgggctgcgctacgcgttcttccccgacaagcaccgcctgctcgtcgagcgcgacggccgcaccaccacctacgacagcggcgatcaccagatcagcggcgtgcagcagcagagcggcggctccgtgagcttcgcgagccagaacggcgcggtggacctcgcctccctgaagcagatcgactga

SEQ ID NO: 7391 - DNA, 399 bp, Methylobacterium sp.
atggacgccacccgcctcagctacagcatcgaccacgtccacctgcgcagccgcgatccggtggcggcggcgggcttctacgtcacggtcttcggggcgcgcgaggacgggcgcatcggcgacccggtgagccgggtggtgctcgatctcggcggcctgcgggtcttcatcgagcaggcccccgccgacatcgcccccgccgcggtgccgccgcatagcggcatcgagcatatcgggctgcgggtggccgacatcgacgcggcgctcgcggatctggaggcgcgcggcatcccattggcgatcccgctcacgcaggtgaacccggcattgcgcaccgccttcctcgacgggccggacggggtgctgatcgagctcctggagcgcggcggcaaggcctga

SEQ ID NO: 7392 - DNA, 606 bp, Methylobacterium sp.
atgaacgagcctgctcagccgggcggagaaccgatcgaggcgcgcctgcgccgggccctggggacccggtcgatcgtgctcgtcggtctgatgggcgcgggcaagagcaccgtcggccggcggctggcccagcgcctcggcctgatcttcaaggacgccgaccacgagattgaggccgcggccggcctcaccatcccggacatcttcgcgatctacggcgagccgagttttcgcgatggcgaggagcgggtgatcgcgcgcctgctgcgcgcgggccccctcgtgctcgccaccgggggcggcgccttcatgcgcgacgcgacgcgggcgcgcgtcggcgagtccggcgtctcggtctggctgaaggccgagctcgacgtgctgatgcgccgggtgcgcaagcgcggcaaccgcccgctcctcgagaccgaggatcccgaggcgacgatgcgcgccctgatggaggcgcgccacccggtctacgccgaggccgacgtggaggtgctctcccgcgacgtctcccacgaccgggtggtggacgacgtgctcgaagccctcgtggcccatctcgacccatcggcgccgccagcggtcgccgcgcagtag

SEQ ID NO: 7393 - DNA, 1305 bp, Methylobacterium sp.
gtgaacggccggcgcgtcctggcgctcgcgctgccgatgacgctcgccaacatcacgacgccgatgctcggcttcgtcggcgccaccgtgatcgggcggctcggggatgcggcggcgctcggcgcgatcgcgctgggggcggtgatcttcgacgcgatcttctggtccttcggcgccctgcgcatggcgaccgccggactgaccgcccaggctgtgggcgcccgggacgccgcggaggttgaccggacgctcgcccgctcgctcgcggccggtctgctcgccggcctcgccctcgtgctgctccagctaccgctggcctggctcgccttcgcgatcagcggcgcgagcgaggccgtgcgggcggggctcgcgacctacttccacatccggatcttctcggcgcccttcgtgctggcgaacttcgcggtgctgggctcggtgctggggcggggccgcacggatctcggtctgctgctgcaggtggcgattaacggcgtgaacatcgccctgacgcttctgctggtgctgggtttcggactcggcatcgcgggggccgcgctggcgacgctctgcgcggaggcctgcgggctggcgctcggccttctcgtgctgcggcgcctcggcgcccgcccgttccaggtgccgctctccgagatccgcgatccggccgcgctccgccgcacgctcgcggtgaacgtcgacgtggtgatccgcacgctggcgctggtcgccggcatcgtactgttctcggcgctgggcgcgcgccagggggacgccacgctcgccgccaacgcggtgctgtggaatctcttcctgatcggcggcttcttcctcgacggcttcgccaccgccgcggaggccctgtgcgggcaggccatcggcgcccgggacgaggcggatttccgccgggcctcgtcgttgagcctgcgctggtgcctcggcttcggcgtcggggtcagcctgatcgcgctcgggctcggccacgccttcgtcgacttcgtgacgacgagcgccgaggtgcgggaggtcgcctaccgctatctgccgctggccgcgctcgcgcccttcgtggcggcgctgcccttcgcctatgacggcatctatatcggcgcgacctggacgcgggcgatgcgcaacctgatgctcggcgcgctcgcggcctactgcgcgacgctcgccctcgtgcaggggctcggcctcggcaatacgggcctctggctcgccttcctgagcttcctcgccgcccgcgggatcggacaggcgctggcctatccgggcctcgcccgccggacgttcccggcctga

SEQ ID NO: 7394 - DNA, 948 bp, Methylobacterium sp.
atgttgatcaagcagagccgcggctgggagatccccgagagccgcgccacgcccgaatcggtcttcctgaaccgccgcgccctgctcggcggcgcggcggggctcgcggccggcgcgatgctcgccggccgccccggcctcgcggccgagggtgccccctatccggcgccgcgcaacgaggcctacgcgctcgaccgcgcggtgacgccggagcgctacagcggcgactacaacaacttctacgagttcggcacctcgaagagcgtgatgccggcggccgaggcgctgaggaccagcccctggacggtcaaggtcgacggcctcgtggagaagcccttcgagatcggcgtcgacgatctcgtgcggaagctcgggctggaggagcggctctaccgccaccgctgcgtcgaggcgtggtcgatggccgtgccctggacgggcttccccctgtcgaagctcgtggcgctcgccaagccggcttcgggcgcgcagtacgtgcgcttcgagaccttcctcgacaaggcgatggcgccgggccagcgcgcgttcttctatccgtggccctatgtcgaggggctgacgctggcggaagccggccacgacctcgccttcgtggtcacgggcatctacggcaagccgctgccgaagcagttcggtgccccgatccggatcgcgctaccgtggaagtacggcttcaagtcgatcaagtcgatcacgaaggtctcgttcgtggccgagcggccgaagaccttctgggagggcctgcaggcctccgagtacggcttctgggcgaacgtgaacccggccgtgccgcatccgcgctggagccaggccagcgagcgcgtgctcggcaccgaccagcgcgtgccgacgctgatctacaacggctacggcgagcaggtcgcgggcctctacaaggggctggagaaggagcggctgttcgtgtga

SEQ ID NO: 7395 - DNA, 573 bp, Methylobacterium sp.
atgacccggcccgatctcgcccccggtgcgccgctcacccccgatgccgagatgcgcgacatgctgctcggtgcgatcccggcgctcagggccttcgccttctcgctgacctacgacctcgatcgcagcgacgacctcgtgcaggacacgctggtgcgcgcctggatcaaggccgacagcttccgccgcggcacgagcctgacggcgtggctgttcaccatcctgcgcaacctgttctactccgagcagcgcaagcgcaagcgcgaggtcgaggatgtcgacggcagcctcgccgcccgcctcggcagcctgcccgagcaggagatccgggtcgagatggaggcgtttcgcggcgccctcgaacgcctgcccctggcgcagcgcgaggcgctgatcctcgtgggcgcccagaacttcacctacgaggaggccgcggagatctgcggcgtgccggcggggaccatgaagagccgggtcagccgggcgcggctgcgcctgatcgagctgctcggcatggacgggacgggcgacatcggcaccgatgcccagacccgcgcggctctgggcgattag

SEQ ID NO: 7396 - DNA, 189 bp, Methylobacterium sp.
gtgcgggaggaagaagaccaggtgcgcaaggcgcccacgcacgagatcggtcaggctctcgatgcgctctcggtcgatgacttggccgagcggatcgacctgctgcgccgcgagatcgcgcggttggagacggcccgcgccgccaaggagagcgcccgcggcgccgcggacgcgttcttcaagcgctga

SEQ ID NO: 7397 - DNA, 351 bp, Methylobacterium sp.
atggccgacgcggcgcgtcaactggatcagactggtgaagccgacgtggtgcgtcggctgatcgcgcgcccgatccgcctcgaacacacccggcatctcgccgaggtcgtcgcgcctgaacccgcggcggaagagaccgaggacgccccgtcaccgaacgaggcccgcgacgtcgcttcgctcgaggccgaactggcgctgctcaaagccgtgctcgatgcggagcgtcgtgaggccgcgagcctgcgcgcccgcctctccgatcccgccacggccgatgcggccgacggcgtggccgtgcgcgagcgctgggccgccctggtcgacgacctgctgctgcgcctgcgctga

SEQ ID NO: 7398 - DNA, 798 bp, Methylobacterium sp.
atggtctcggtcgacctcggggccgcggccgcggaccgcgtccagcttgccgccggcctcgccgagcgcttcaggtcgaggctgaccggcgtcgccgcgcgccccgtccccagcctgatgccggtcggcgacatgctggaggtcgagcgcgtctatgaggacgaggagcgccgggcgaaggaggaactcgacgaggcgggagccgtgttcgagcgcgaggccggcgccgccccgaagacggcctggttctcggccctggcggagccccttgcctacttggtcgagcaggcgcgtaccgccgacctcgtggtcgtcggccggcagggcccggcggatggcgacaccggcctcatggcggttccaacgggcgcgctcctgatggaggtcggccggcccgtgctcgtggtgccgcccggcatcgagcgcctcgccgccaagcgcatcgtggtggcctggaaggacacccgcgaggcgcgtcgcgccatccacgacgccctgccggtcctgggccatcccgagcgggcctgcgtcgtggccgtggggcccgatgcgcaccatgcgggcgcggagggcgcggccgagtacctggccgggcacggcatcaaggccaccacccacctgctcccgagctcggccatcggcccggccgacgagctgctgcgcttcacccagcgcgaggatgccgacctcatcgtcatgggcgcctatggccacagtcgcctgcgcgaatggatcttcggcggggcaacccgcgacatcctgcagacaacgcccgtctgctgcttgatgagccactga

SEQ ID NO: 7399 - DNA, 900 bp, Methylobacterium sp.
atgcccgcacgcacgtctccgccgctcccctggctcgaccgggccggccgcctctcggccctgaagctcctctgcttcctgctggtgctggcgcccggcctctacctcgcgcaaggctatgcccgcgacgcgctcggggcgaagccgatcaccgcgctgatccacggcacgggcgagtgggcgatgcggctgctgctcgccacgctggcggtgagcccgctgcgccggatcgccgactggccgcggctgatcaacctgcggcgcatgctcgggctctccgcgctcgcctacgcgctcgcccacctcgtcctctacgtggtcgaccagaacgtcgatctggcgaaggtggtctccgagatcgccttgcgcatctacctgacgatcggcttcgtggcgctggccggcctcgtggcgctcggctggacctcgaccgacggcgcgatccgccgcatggggcccgcctggaaccgcctgcaccggatcgtctacccgatcgcggcgctggggctgctgcattattttctccagtcgaagatcgacgtcaccgacccggtcttctggaccggcctgttcgggctgctgatgggctggcgcatgatgcaccggctctccgtgccgacgcggccctggtcgctcctcctcctggcgctcggcaccgccctgctgaccgcgctcgtggaggccgcgtggtacgggctgaagagcggcgtcccggccgacctcgtgctcggcgccaacctcgatttctccggcccgatccggccggcctggtgggtgctcggcatcgggctgctgctgccgctcgtcagcgccgtgcgcggcaggccggagagccgcaaggtcgcggcgcgcccggcgcccggccttgtcccggcccgcgcgatgccgcagaagccgtga

SEQ ID NO: 7400 - DNA, 1257 bp, Methylobacterium sp.
ttgaccgtgagcgacgcgcggcagcacgcccgcgccgcccggcggctggtccagtccgccaacggcggccgccttctcgccctgcggatcgtcatcgtgctcgtgctgctgatggcggcacaggcctatgacggctcgctgcaccagctcagccactgggtcatcctggcgctctacgcgggcagctccgtctggttcgcgctggccgagcggggcggggggcggcgggccgacagctacgcctgggccggcacgctgctgaacgcggggctcgccgtctacgtcatcgtcgagcacctgctggcgggcgccgattccgagggcgcggccgacgcggtgagccgcctgcccgccttcctgctcctgctgcagacggcgctcagcgtgcgcgtctggcacacggcgctctacgccggcatcgtggcgaccgtctggggcgtcgcgctgctgatggcggccacgcacccgaccggcatgctcggcccccatgtcgatctgtccgagcaggtgccggcgctgctcaccttcacggccgcgagcctcgtggtgatcgacggtacctcgcgcctgcgcggcgcggtggccgaggccctgcgcctggagcacgagcgcacgctgctcgcccgcttcgtgcccgaggacgtcgccgaggacctcgcccgcgaggggggcctgggcgcggtgcgccggcgccacgcctgcctgatgatcctcgacatcaggggcttctcgcggctcagcgccgagcacccgcccgagaccatggtggaggcgctgctcgccttccgggcgctcgcccagggggcgatcgccgagcacggcggcctcgtcgacaagtatgtgggcgacgcggtgctggcccagttcgtgatgggcccgcccgaggagcaggcccgcggcgcgctggcctgtgcccgcgccgtccggacgcgggtcgcggcgctcaaccgggcgcgggcgcaagcgggccgcttccccctgcgggtcgccgtggcgctgcacgcgggcgaactcctcgtcggcatcttcgacgacggggtgcgggcggagtacacggtcctgggcccggccatgaacacgctggcgcggctggaatcgcgcaccaaggcggccaacctcgacatcgcggcctccggcgagttcctgcgcctgaccggcccgatcctgcccgagaacctcaccgtcgcgcccgtcgaggacggcggcaacccgatcctgttcgcggtaggcgaggggcgccaccgcatcccggcctga

SEQ ID NO: 7401 - DNA, 345 bp, Methylobacterium sp.
atgaggacgattctggcggcgacggtcgcggccctgaccctaatcaccccggtgggtctcgcctccgcccagccctacggctacggcgaccgcgattatcgcgaccgcggggattaccgggaccgcgactaccgcgaccggggcgattatcgccgtggccgcgacgacgattacgaccgcccctcgcgcggcggccgcaaccgtggcgactacgccttcgacgagcgcgagtacctgcgctgcaacccggacgtccgccgggccatcgtgaacggccagatgacgtcgggcctggcgcattaccgcaccttcggccagcgcgagggccggcgcctcagctgctga

SEQ ID NO: 7402 - DNA, 492 bp, Methylobacterium sp.
atgggtccgacacgccgtgagctgtggctgctgaccctcctgcccctgggcccggcctgcgccgcgggcgctgccgacgccccggccgaagaccccgccgcgatcctggcgctgcgcggctacgacgcggtgagctacttcctgcccggcggcccgcgggccggtgacgcgcgattcgagctgtcctggggcggacgggcgtggcgcttcgcgagcgcgggcaaccgcgccgccttcgcggccgggccggaggcctacgcgccgcgcctcgacggccacgacccggtcggcgtgctcgacgggcgcctcgtcgacaccgacccgctggtcttcgcgctgctcgggggccggctctacctgttccgcgacgcggagcgccgggcgcggctcgtcgcggatccgggcctcgccgaccgggccgaggcgtgctggccggatctcgcgcggctcatcgagccgctgccgcgctcgtcgccgcgctcgttgccctga

SEQ ID NO: 7403 - DNA, 981 bp, Methylobacterium sp.
atgaccgaactcgcgctcgaccccaccgagacccgccagccccgcacggccgcgcagggcaagccgcccggccgcccgctccggcgcatcgcgctcgcctccgccctcggcgtcgccggcctcggcgccttcgcggccgcctccgccttcctgtccgacctgaccgggtcgcggagcaccgcaaggccgccggccgtcgccaagcagagcgccgccgactggccggacctgatgaaggatggcctgcccgcgctcgccaccggcagcctgcccgaggcgggcgcgccccggcagatcgccctgccggcggccgatgcggcgtccacccggatcaccgcgggaccggccgccgagccggtgccggccgccgcgccgaagccgctggccgccgtcgagccggccgtcgccctcccggcgagcacgccggccgccgcgaccgaagccaccatgcccgtggtctccaagcccgcggtccccaagcccgccgcgcccgagcgggccgcggccaagcccgcgccgacgatcgagaacgctccggtcatcgcccccgcgcggcaggcgggcgtcctgccgccgccgaaccgcaccgcgccgacggtcgccgcgcgcccggccgagaccgtgcgcgcccgcaccgccagcaccagcttcgcggccctgccgcccgcgccggacaaggccgcagccgagaagcccgcggcgcgcgcggtcccggccgagagccgcaaggatccggcgaagcccgccgaggcgaaggcggaggcggccgagcaagcgaagaagaagcccgagaagaccgtcgcggcgcgcaagccccagcccaccgccgtcgcgtcggcggggccggcggccccggccgagcccgaggagacggaggtgttcggcatcaaggtgccgacgctcgccgccacgggccgcaggatcggcgcgagcgtcgaggcgctgggcgacgccgtgaagggcctgccggacaagttctga

SEQ ID NO: 7404 - DNA, 201 bp, Methylobacterium sp.
atgagcgagccgccggacgacaacctcgaccactacgcgctgggcttctacgccctgggcaagggcgtggcacgggccgaatgcccctacgccgccgggacgcgggcggaagccgactggcatgcgggctacgacgcggccgcgcgcggcgattcggagccggcccccgaggccccgcggggggcgcaatcgcccatgtga

SEQ ID NO: 7405 - DNA, 1164 bp, Methylobacterium sp.
atgctgcggcgtctggtggccgtcgtattccttggcctcaccgtctctgccgctgcggaggagccgctccgcttcgaggtcgatccggcctggcccaagcggctgccgaacgactggatcatggggcaggccgcgggcgtcgcggtcgacgcgcaggacaatgtctgggtggtccagcggccccgcacgctcaccgacgacgagaaggccgcgagcctcgatccgccccgcacccggtgctgcaagccggccccgccggtcctcgtcttcgaccaggccgggaccctgatccggtcctggggcggccccggcgagggctaccagtggccccagaacgagcacggcatccacatcgaccacaagggcttcgtctggctcgccggcaacggcgacaccgatgggcagatcctcaaattcacccccgacggccgcttcgtcctccagatcggcaagcagggcccgcagacggacagccgggacacgacccgcctcggcaagccggccggcatgatggtcgacccggaggcgaacgagctctacgtggccgacggctactacaaccaccgcgtcatcgtgttcgatgccgagaccggcgccttcaagcggatgtggggcgcctacggacggccgccgaccgacgagaagctcggtccctacgacccggcggcggagcccgcggcgcagttccgcaacccggtccactgcgtgcagatcgcccgcgacgggctcgtctacgtctgcgaccgcaccaacaaccggatccaggtgttcgccaaggacggcagcttcgtgaaggagatgttcgtcgagcggaacacgcgcgccaacggcgccgtctgggagctcgccctctggccggacgagcgccagagctacctgctcaacgcggacggcgccaacaacgaggtccgcacgctcagccgcgacaccggcgagatcctcggccgcttcgggcgcaacggccggatggcgggcgacttccactgggtccacaatctcgcggtcgactcgaagggcaacgtcttcaccaccgaggtcgacaccggcaagcgcgcgcagaagttcctgttccggggcgagatggtgctgcgcaagcgcgccgccctgccagagggcaccgccctaccgcagggccctgccctgtcggagggcgcaggccgatga

SEQ ID NO: 7406 - DNA, 462 bp, Methylobacterium sp.
atggcggccctgaagccgatcctcctcgtggaggacaacccgaacgacatcgagctcacgctcgccgcgctcgaatcgagccagctcgccaacgagatcgtcatctgccgcgacggcgccgaggcgctcgacttcatctaccggcgcggggcccacgagggccggcagcaccaggatccggccgtggtgctgctggacctgaagctgcccaaggtcgacggcctggaggtgctctccaaggtgaagggcgatcccgccacccgcggcatcccggtggtgatgctgacctcgtcgcgggaggagacggacgtcgtgcgctcctacaatctcggcgtgaacgccttcgtggtgaagcccgtcgccttcgacgagttcttcgccgcgatcaaggagatcggcgtgttctgggcgctcctgaacgagccgccgccgcaccggggaggctggccatcgaacgcctga

SEQ ID NO: 7407 - DNA, 207 bp, Methylobacterium sp.
atgcgcaggtacctcgtcaccttccacagggtcgtcttggacgacaccggccacgatcgccgcacgctgcagcggcaggtcgtcgtcaccgccctctcggacgccaccgccatcgaggtcgccaaggcgatgttctgcgaggccgccggcatcggcgactggcgactgcgtgccgatgcctgcgaggtcaccgaactcgtcgcatga

SEQ ID NO: 7408 - DNA, 585 bp, Methylobacterium sp.
atgatccgtcgcgtcctgccgctgctgccggccctcgtcctgctcgctcccggggcggcgctcgcccatccgggccacggcgaggcggtgggcttcgcgcacggcttcgcgcacccggtcggcgggctcgaccacgtgctcgccatggtggcggtgggcctcctcgcggcgctccgcggcggggcggcccgctggggcctgccgatcgccttcatggccatgatggcggcgggcgccgggctcggcgtgttcgggatcgcgctgcccttcgcggaggccggcatcgcgctctccctcgtcgccttcggcctcgccatcgtcttcgcgggccgcctgccgctgccggcgctgatcggcctcgtcggcgtcttcgcggtgttccatggctacgcccacggcgccgagatgcccgagaccgcctcgggcctcgcctacggggctggcttcctcgccgcgaccgcgctcctccacgcggcgggcctcggtctcggcttcctcgtcagcgccgagcgccgccgcgccgcgccggccatgggcgccgccgtggcgctctcggggctcacgctgctcgcgggcgcgttctga

SEQ ID NO: 7409 - DNA, 297 bp, Methylobacterium sp.
atgctcgcacccgctctcgcctcgccgatcacctcggcccggatccgcgccggccgcgggctgctcagatggacgcaaggcgttctggcgagccgcgccgcggtctcggtcgtcaccctgaccatgatcgagagcgagcaggtgcggccccgcagccggacgctggaggcgatccgccgggtgctggaaggggagggcatccgcttcatcggcgacgcggatgcgggctacggcgtgctgctgcgaccgcacgccgagaccgggccgacgtcgagttccggggaggcggggctttga

SEQ ID NO: 7410 - DNA, 285 bp, Methylobacterium sp.
atgaagcccgttctgctcgtcgacgattccccgacgatcctggccagcatgtccgacatcctcagccgctcgggctacgcggtcgagcgggcgccgcacgcggaggccgcgctcgacaaggtccgcgccggcctcgcgccgggcctcgtcatcaccgattaccacatgccgggcatggacggggtccggctcatcggcgagctgcgcaagctcgccgccctccgcttcaccccgatgctggtcctgacgaccgagtcgcagcaggagaagcgcgacgcggcccgg

SEQ ID NO: 7411 - DNA, 312 bp, Methylobacterium sp.
atgacgacaggaaagatcgcgagcgccaccgcgcccgcgggcgagaacggcgagatcggcctcgcccggggcgagcgcctcgccctccggatgtggcgcgacgagccgccgaacgccgacaaaccgacctctgtctcggcccacgagaccgtcggctacgtgctgaaaggccgcgccgagctggttctggcgggcgagagcgtgctgctggagcccggcgattcctggttggtgccggccgggatcgagcacacctatcgtattctcgagaccttcacggccatcgaggcgaccgccccgccggccgtgtaa

SEQ ID NO: 7412 - DNA, 270 bp, Methylobacterium sp.
atggcacgcgcgcgcaccgcgctcctcgccgccgccctcgtggtaggcgcacccgcggcggccctcgccttcgggggcaacagcgacgccggcagcgggctctcgccctacgccgccctcaacggcaacgatcgctcggcgggcgtgaacaacggcaattaccgtccgccgcgcttcgacccctacgtgcagacctacggctacgaggatgagccgcgggtctaccggcgcgccccgacccggcggcccgcctacggctacccctactga

SEQ ID NO: 7413 - DNA, 162 bp, Methylobacterium sp.
atggatctcggaccccatgcgggcttcatcctcgcctcctacgccttcaccgcgctggtgatgggcgcgctcgtgctcaatgccgtgcgcgaccggcgggcgcagacccgggccctgcgtggtttcggggcgctccgcggctccggggaggagcgccggtga

SEQ ID NO: 7414 - DNA, 1722 bp, Methylobacterium sp.
atggacgtcgccgcgccgctgcgcatcctgcacctcgaggacagcgacctcgacgccgagctgatcgaggccgagctcgaccggctcgggccggccgtgcggatcgtgcgcgtgatgagccgcgaggccttcgccgccgaggcggtgccgggccggcacgacctgatcctggccgactacgtgctgccgaccttcgacggcatcagcgcgctcgggctcgccagcgggcagtgcccggacatccccttcgtcttctgctcgggcacgctcggcgaggaggtcgcggtcgaggcgctcaagaacggcgccaccgactacgtgaccaagcagcgcatcgaccgcctgccccgcaccatcgtgcgggcgctcgccgaggcgcgcatccggtccgagaagcgcgcggcggaggccgccctgcaggcgctcaaccggacgctggaggcgcgcgtcgccgagcggacccgcgaactcgccgaggccaacgccgcgctggaggcgcagatcgaggagcgcgagcgcgtcgaggaggccctgcggctggcccagcgcctcgaggcggtcgggcaattgaccagcggcgtggcgcacgacttcaacaacctgctcaccgtcatcgccggcaatatcgagttcctggagcgcgccgtcaccgacgagcgctcgaaacggcgcctcgacatgatgcggggcgccgccgcgcgcggcgccaacctgacggcccagctcctcgccttctcccgccgccagcggctggaaccgacgccggtcagcctgaaccgcaccgtcgcgtcgatgcacgacctgctcaccagctccatcggcggggcggtgcggatcgagatcgcgctgcacgaggggctctggccggcgctggtcgacgccacccaggtcgagctcgtcatcctgaacctcgccatcaacgcccgcgacgcgatggcggtgggcggccgcctcaccatcgagaccgccaacatgacggtgcgggcgccgccgacgcggcccgagcacccgcaaccgggcgcgtacgtcatggtctcggtgagcgatacgggcacgggcatgccgccggaggtgctggcgcgcgtgttcgaaccgttcttcaccaccaaggcggtcggcaagggttccggcctcgggctcgcccaggtctacggcttcgtgaagcagtccggcggcggcatccggatcgacacggttccgggcgagggcacctcgatcaaggtgtacctgccgcgcgccgacgaggcgggcgcggccgcgcccgtcccggacgcggcgatcgactgcgcccgcgcgcacccgcccggcgcgcagcccgcgctcctcgtcgtcgacgacgacggcggggtgcgcgaggtgaccgcgacgcggctcgtcgaggcgggctaccacgtgcgcgaggcggcctcgggcctgcaggccctggcggcgctcgaagcggacccgtgcgtcgatctcgtcgtgctcgacttcgcgatgcccgggatgaacggggccgaggtcgcgatcgagctccgcaagcgctggccgcacgtccctgtcctgttcgtcaccggctacgccgacaccgcggcgctgcgccaggcgggagccgtgggcgccgagggcatcgtgcagaagccgttccgggacggcgagctggagcgcaaggtcgccgcgaccctcgcggcccacccggtgccgcgcctgcggctggtctcgcagcgggaccggagcgcgtag

SEQ ID NO: 7415 - DNA, 510 bp, Methylobacterium sp.
atgagttacgagagagcggttctggcgggcggctgcttctggggcatgcaggacctgatccggcgccaggaaggcatcgtcacgacccgggtcggctacaccggcggcgacgtgccgaacgcgacctaccgcaaccacggcacgcatgccgaggccatcgagatcacctacgatccgacccgcacgagctaccgccgcatcttggaattcttcttccagatccacgatccgacgaccccgaaccggcagggcaacgaccgtggcctgagctaccgctcggcgatctactacgtcgacgcggcacagcacaggatcgccgaggacaccgtcgcggacgtgaacgcgtccggcctctggcccggacgggccgtcaccgaggtggaacccgccggcccgttctgggaggccgagccggagcaccaggattacctggagcgacaccccaacggctacacctgccacttcgtccgcccgaactggcggctgccggcccgctccgcagcggagtag

SEQ ID NO: 7416 - DNA, 354 bp, Methylobacterium sp.
atgaaccgagccgccgcgctcagcgtcgacgatcccgtccgggattgccccgtcccccccgagaccctcggccggatcgcccgcgccgagcccgaatccctcgacgagatcgtcgagggcatcccggaggccgtgcgggcgcgcctcgcggtctatctgtacggccgcagccacacccacgagctcggcatccgcatcgccgcgacctgcgagggcaccacgctccggcgtgcggcgggcctcgtcggcaatatgctgcacgacctctcgcgccggccctacgcgccgccgagccacgggctgcggagcgcggcccggatcagcctcggcggtccggccgcgcgccgggcctga

SEQ ID NO: 7417 - DNA, 150 bp, Methylobacterium sp.
atgaacatcgagcgccagcgcgagatcgccagcaagggcggccgtagcgtgcccgcggagaagcgctccttctcccaggaccgtgagctggcctcgtcggccggtcgcaagggtggccagtccactggaaccggtcgcgccggcgagtga

SEQ ID NO: 7418 - DNA, 231 bp, Methylobacterium sp.
atgatgacgaaggaccagctcgccgccgagctgaagcgcatcgccacgtcgcagatcagcgacatcacccgtgcggtcaaggaaggccagaagtcgatcgccctgaacgaggtgcgcgacatggcccaccgcctcaacctcctggccgacgccttccacccccgcgccgtccagtcccagctccatccccagccgggcgagcctgccgccgagacgccgcaggccgcctga

SEQ ID NO: 7419 - DNA, 570 bp, Methylobacterium sp.
atgaacgctgccccgctcgaacccgccgccttcgcggcacccgccgtgctgctctccggaccggtcgatcacgacatgtaccgggacttccgccggcagctcgccgccgcggcggagcgcgacctcgtcgtggtcgagctctcgacgctcggcggcgatcccgaggtcgcccgcatgatgggcgaggacatccgcttccacagcgcgctcgcgccggggcgccgcttcgtcttcctgggcaaggccgcgatctactcggccggcaccaccttcatgagcttcttcgcgcggcagaaccgctaccttacccgcggcacgcggctgatggtgcacgagcgcaagctcaacaagcaggtgaagctcaacggccccctcaccacctgcgtcgccgccgtgaaggcggcgctccacgagatcgagacctcgatcgcgatccagaacgagggcttcgccaacctcgtggcgggctcgcgggtgagcctggaggaggtgctgcggcgcgcgcccgagaactggtacgtcgaggccgaggaggcgcagcggctcgggctgatcgaggcggtgctgtag

SEQ ID NO: 7420 - DNA, 603 bp, Methylobacterium sp.
atgcgataccttctcgccggcctcgtcgccggtcttctcaccgccttctcccccctcctctcgggaccggctgaggcggacgacacgttcgcccgcctgcgcggaaccgtcgagacgcgcaccaacggcaccctcgtggtgcgcccctacgcgggcgggacagtgaccaccgcgctgaacccgaagacgcgcatcatgatcgccgaccgcggcaacctgcgcgacatcaagcccgagagctacgtcagcgtgctctctgcgccgggcgagaacgcgaccggggtcgtgatctactcgccgtcggagcgcggcttcgaggccggccgccagtcctgggacgcgaagcccggcgcgacgctgaccgctggctggatcatcgcgcgcgacggtcgcgatcccgtcaggattcgcctgggccatccgggtgcggaagagcagttcgccctgccggtcgccacgccgacgacgcggatcgcccccggtgagaagtctctcctggtgcccggcgcccacgtcgtcgtctttgcccgcaccgacgcgagcggtgtcgtcaatgccgacacgatcgtggtcggtcgccagggcgttcggcccgcgctgtag

SEQ ID NO: 7421 - DNA, 885 bp, Methylobacterium sp.
atgaccgagatccgcccgcgccgcagcgtcctctccatgccgggctcgaacgcccgcgccctggagaaggccggcggcctgccctgcgacgtcgtgctgatcgacctggaggacgcggtggcccccgaggccaaggcggaggcccgcgcccgggtcgccgccgcagtctcggacaggcgcttcggccaccgcgaggtggtggtgcggatcaacccgctcgacggcgaccacggcgaggacgatctcgcggcgctcgcgcccgccgccccggacgggatcctggtgccgaaggtggcgggacccgaggcgctggtggcggtgggctcccgcctgcgccgcctgaaggcgccccccggcatccggatctgggcgatgatcgagagcccgctcgcgatcctcaacctcgccgacatcgcgagcgcggcccgcgacgtggacgtgcggctcgccggcctcatcgtcggcccgaacgacctcgccaaggcggcgcgggtgcgcctcggcccgggccgggccgcgctgatgccctggctgatgggcgtggtcgcggccgcccgggcctacgagatcgacgcgatcgatggcatctacaacaccttcacggacgcggagggcttcgcggccgagtgcgcccagggacgcgactgcggcttcgacggcaagatgctggtccatccgagccagatcgcggcggccaacgccgccttcggcccgacgcccgaggaggtcgcggaggccgaggcgctgatcgccgccttcgcggcgccggagaaccggggccgcggggcgatcgcgttccagggccgcatggtcgagcgcctgcacgccgaggaggcgcgccgcgtgctgaccctcgccgaggcgatcgcccggcagggggcatga

SEQ ID NO: 7422 - DNA, 876 bp, Methylobacterium sp.
atgattgccccggcgcgcgccctcgattccgatgcggtccaggccttcgtgctggtggccgatctcggcggcttcacgcgggccgcggaggcgctcgggacctcccaggccgcggtgagcctgcgcctgaagcggctcgaggagcggctcggccaccgcctgatcgagcgcacgccgcggcgggtccgcctgtccgaacgcggcgaggccttcctgcccgcggcgcgcgacctcctggccgcgcaggagcgggcgtggcagcaggtggtgccgacgccgccgcgtcggctgatcctcgggatcagcgatcacgtcgcgggaccggaactgccggtcctgatcgggcgcatcgccgcgcaggatccgggcctgctcatcgaggtgcggatcgcgggctcgcgcgacctcgtggccgcctatgcgcgcgccgagatcgacgccgccatcgtgcggagcgaggacggatcgccgcagcgcggcgaggggcgtctgctcgcccgcgagctcttcggctggttcgcggggcccggcttccggcaccggccgggcgaggcgctgcggctcgcgaccctggcgggctcctgcggcgtgcgcgagacggctttgcgctgcctcgacgcggccggcatcccctggacggaggtcttcgtcgggggcggtgtgctcgcggtcggcgccgcggtcagcgccgggctcggcgtcgcggcgctcgcccgccgggtcgccccgccgggctcggtcgaggtcggtgagcgcctcgggctgccgcccctgccgaccgccgacgtggtgctgcacgcccgcacccgggagccgcgcgcaggcgcagccctgcgcctcgtcggcgcagccttccgcgcggccgcgaccgtttga

SEQ ID NO: 7423 - DNA, 495 bp, Methylobacterium sp.
atggaccgaccgagcctctacgacgacgacatcgtggcctgggccgaggagcaggccgccgctctgcgcgccctcggcgcgcggggcgaattgtcgaacgcggtcgattgggagaacgtcgccgaggagatcgagagcgtgggtcggtctcacatccgggcggtcgagggcctgctgatccagacgctcgcccacctgctgaagcgggtctccgcgccgctcgcgccagcgagcacgcactggcgcgaggagatcgtgaccttccagaccacggcttggagtgcctacgagccgtcgatgcggcagaggctgaactgggccaggatctggaaggtggcgctgacagcggcggaagccggcctcggcgcctacggaaacgagctgcttccggggctgccgaaaacctgcccgatcgatccggacgatctcctcgccgaacatttcgatgtcgaccgcacgctccggacgctcgccgcctcggttgcaagccgctga

SEQ ID NO: 7424 - DNA, 282 bp, Methylobacterium sp.
gtgcgtaccctgcgtctcatcaccggcggctgcgtcgtcggcctcagcaccctgatcgtcggcttcgtcagcgccgaccgtctcagccatctggcgccgccgcccgtggtgcgcgccgccgtgccggaaccctcggccaccggctcgatcgccgtgccgaagccggccgcgccggtcgcgccccagaaggtcgcggcccccaaggtgccgagcggcttcgacaccgagcgcctcaacgccctgatgcgcggcgacccgatcctacctgccggccggcgctag

SEQ ID NO: 7425 - DNA, 1314 bp, Methylobacterium sp.
atggcttcgttctcggagagcgaccgcgggcggtcgaaggttgccacggtgctgcgcgtcaccagcggcaacttcctggagatgttcgacttcttcctgttcggcttctacgccacgcacatcgcgaaggcgttcttccccggcgggaacgcgtacgcctccctgatgctcaccttcgccaccttcggcgcgggcttcctgatgcggcctctcggggcgatcttcctgggcgcctatgtcgaccggatcgggcggcgccaggggctgatcgtcacgctgaccatcatggcggcgggcacgatcctgatcgccttcgtgccgggctaccagaccatcgggctcgccgccccggccctcgtgctgatcgggcgcctgctccagggcttctcggcgggcgtggagctcggcggcgtctcggtctacctcgccgagatggcgacgcccggccgcaagggcttctacgtctcctggcaatcgggcagccagcaggtcgccgtgatggccgccgcgatcatcggctacgcgctcaaccacagcctgacgccggggcagatgggcgactggggctggcgcatcccgttcttcatcggctgcgcgatcgtgccgttcctgttctacatccgccgctcgctggaggagacgcaggagttcctccaccgcaaggtccggccgagcacggccgagatcttcgcctcgctcggccagaactggaagatcgtcgtgctcggcatgctgctcgtggccatgaccacggtctcgttctacacgatcacggtctacaccccgaccttcggcaaggaggtcctgaagctctccgacaccgacagcctgctggtcaccttctgcaccgccctatcgaacctgttctggctgccggtgatgggcgcgctctccgaccggatcggccgcaagcccctgctgatcgtcttctcggcgctgacggtgctgaccgcctacccggcgctcgcctggctcgtcggccacgtctccttcggcaacatgctcgtcgtgctgctctggctgtccttcctgtacggcagctacaacggcgccatggtggtggcgctgaccgaggtggtgccggcccatgtccgcaccgccggcttctcgctcgcctactcgctcgccaccgccttcttcggcggcttcaccccgctgatctcgacctggctgatcgagcggaccggcgaccgggccgccccagggctctggatggccttcggcggtgcctgcggcctcctcgccaccctgatgatctaccgcgcatccgcgacgcgcgcccgcgcggccctcggggtcggcgcggccggctga

SEQ ID NO: 7426 - DNA, 288 bp, Methylobacterium sp.
atgaaggttgcggcggatctctgcatcgtgccgatgggcgtgggcccgtcggtctcgccctacgtgcgcgagatcaaggcgctcatcgaggccagcggcctcgaggcgacgatgcatcccaacggcaccaacatcgagggtgaactcagcgcgatctgcagccttgccgaggcttgcgaggcgcggctcgccgaattgggcgtgcagcgcaccttcttcacgctgatcttctcgacccggcgggacaaggagcagtcgatggcggacaagctcgacgccgtctcctga

SEQ ID NO: 7427 - DNA, 282 bp, Methylobacterium sp.
atggaagccaaagtcgttcgctggggcgacgatctcgccgtccggctcaccccggcggaggccgaggagctcggcatccgcgagggcgagacggtggagatcgtctccaagccggaaccgcagcaatgggccggccgccgctacctcgacggccagccggtctacacgctggaggagatggtcgccgagatgcgccgtctcgggccggatttcgcaccaccgaccgtcgattgggggccggatgtcggctcggagatcatcgatgacgatgatccccgctga

SEQ ID NO: 7428 - DNA, 717 bp, Methylobacterium sp.
atgagtgcggcatccgagtggcgcgcggcgcgcaacgtcaaggcgcgggcgcggctggagcgggccctgccgacggtcttcccggccccggtgctgcggcacgcgctgggccgcccgctgactccgccgaccccgcggctcgccgtcgagagctactggcgcgcccacgtgctgcgcgccgaccggctggcgcgggggctggccgcgcgctcgggcaccccggagggctgggtctggcgggcggggcccgaggccgccgccggcttccggatgccgcccgcccccttccgcgaggcggagcacgcccgcggccccggcgcctgctgcgtctgcggccagccggtctaccgcttcggctggcatcgcgacctctgggggacgggcacacccaaccgcaacgcccgctggcacgccgcctgcgtggcggcctggaagttctgggtggcgccgagtgatcaggtgaagctgctcaaggcccgccagcgccaccgctgcgcggcctccgccaagcgcctgctgcgcaccgccgaggtcgaccaccgggtgccgctctaccgggtctggcgcgagcaccgggagcggccctggcccgagcttctcggcttctggggcctgcccaacctgcaggtcgtcaaccgggcaagccacgcggccaagtgccacgaggaggcgaccgagcgggcgagcgtgcgccgcgccctcctgcctttgccctga

SEQ ID NO: 7429 - DNA, 621 bp, Methylobacterium sp.
atggacgagggacagggaagcggaccggatcgcgcggcgatccgcgcccattacggccagcccaccccgcgctcgcaggtcaagctgctcgaccggatcgacgggcacgcccgcgccttcatcgcgctctcgcccttctgcgtcgtcgcctcggcggacgcggcgggacgctgcgacgccacgccccgcggggacgcgccgggcttcgtcgcggtcgcggacgcgcacacgctgctcgtcccggaccggcccggcaaccgccgcgtcgacacgatgctgaacgtggccgagaacccccaggtcggcctgctgttcttcgtacccggtctccaggagaccctgcgggtcaacgggcgggcggagatcgtcaccgacccggaggtgctcgccccgctctccgcgcagggcaagatgccctgcgccgcgctgcgggtgcgcgtcgaggaggcgttcttccactgcggcaaggccgtgatccgctccgacctctggacgcgcggggccggcccgcggccggacttcccgacgctcgggcagatcttcgccgaccagatcgcgggcacggacgccgccgagaacgaccgctcgatcgaggacggctaccgcaacaggctgtactga

SEQ ID NO: 7430 - DNA, 990 bp, Methylobacterium sp.
ttggagagcgtgcgtgcggaaggcggggccgaggtccggctcgcggtcgagggacagcccgaggcgccggtgatccgcgtcgcggcggcgtcggggcgcggggcggccgtcgaggcggtgctcgcccgcgccgaggccctcaccgcgcaggatgcgggcgtgcggcgcatccgcgtcgaggccgccgacgcggtgacccgacatctgatcacgctcggcgccgcgcggcggggcgcggacggcgtcgagatcctgccggctctcctctggcaatgcgccgcccgctggctccccgagccccgcccgcccttcccggaggtccacacggtcacggaggggcgccgccacccgctgcggccggaggcgcctgcgggcacggtctatgcccgccgcattccctggctcggccgcaccctcaccttccgcaccctgtcggagcccggcgacgccgccctgttctcgcgctggatgaacgatccgcgcgtcgccgaggtctgggccgagaccgggagcctcgccgagcacgaggcctatctggcgcggctcggcgccgatccgcaccagctcacgctgttcggctgcctcgacggcgtgcccttcggctatttcgagctgtactgggcccgcgagagccggctcggggcccattacgaatcggagccctacgaccgcggctggcacgtggcgatcggcgaggccgacatccggggccgggcccatctctcggcctggctgccctccctgatgcactacctgttcctcgacgagccgcgcacgcggcggatcgtcggcgagccgcgggccgaccacgcgcagcaattgcgcaacctcgcgggctccggcttcgggccgctcgccacggtcgatttcccccacaagcgcgccgtcctcgtggcgctcacccgcgagcgcttcgtgcgcgaccgcctctgggtgccgggcgcggccgccgccgacgcccgcccgcgcccgccggacgtcgaggcctga

SEQ ID NO: 7431 - DNA, 702 bp, Methylobacterium sp.
gtgaggcgggtctcggcggcggtagcggccgccggcctcctcgtcggattcgggtgggcgctcggtcggggcctccaggaatccgcgatggacgcgcggcactacgggcagggccgccgcgtcgcggtccagcagcatctcgacgaggcgcccgcaaacttcgtgttcctagccggagacagccaggcagaattgcagagccccgcgcagcgcccctgcgggctcgaactcgtcaatggcggggtcagcggcgcgaacgctgcggcctatgccgattttctcgacggcctgcgctttccccatcgtgcccgtgccgccgtgctggcgatcgggacgaacgatctcatcgcgaagaaccatccgggtctgcccgcgcaggaggcgcagttcgaggccacgggcgagcggatcctgcgcacgctcatgcggcacgcggagaaggtcgtggtcgcggcggtgccgccgatcgggcgcgaactcgacgggcggctcgatgcgggctcggtcgccccctatacggcgcgcctgcgcgccgtctgcgcccgcctgggctgccgtgtcaccgatccctacgcggcgctgcgggacggggaaaccggtttcgccaagcccggcgcgatgggcaatgggctgcacgtcgcggcctatcgaccggccatgcgggcgctcgaagccgagatctgcgggccggtgggacagtga

SEQ ID NO: 7432 - DNA, 1290 bp, Methylobacterium sp.
atgccgacgatgccgcgttccgcacgcctgaccggactgcttctggccggactgctcctgcccctcgggcccgccggggcgcagcaggcgccgagcggcacgccgacgccgggcagcgcggacggctccgcgccgaagcccgcgggcgcgcccgcgcccgcccaggaccgcggctcggccctctacggccggcccgaggggggtgatgccgccaagctcgccccgatcgccgggccgccgctgccgacgccggccgcccgcctgcccctcgacaagctgaaggtgccggacggcttcaagatcgaggtctatgccagcgggctcgccaacgcccgctcgctggccgagggcgacaagggcaccctcttcgtgggcacgcgctccctcgaccgggtctacgccgtgcgcaccgtcgacgggaaacagcaggtcaaggtcatcgccagcggcctgcaccggccgaacggcgtcgtcttccacaagggcgcgctctacgtcgccgagctctcgaagatctggcgcttcgacgacatcgagaacaacctcgacacgcccccgaagcccgttctcgtcagcgacgacttcccgaaggacgaggcccatggctggaagttcatcgcgatcgggccggacgagaagctctacgtgccggtcggcgcgccgggcaacatcctgaacccgcccgacacccacgcccagatccgccggatggacctcgacggcaagaacgtcgaggtggtggcccgcggcgtgcgcaacacggtgggcttcgactggaacccgcggacgcagcagctcaccttcaccgacaacggccgcgactgggtctcggaggacatcccgaacgacgagctgaacgtgctctcggagccgggcaggcagcatttcggctacccgttctgccaccagggcaacttcaccgacccggaatacggctggggccgctcctgcgccgagttcacggcgccggcgggcctgctcgggccgcacaccgcggcgctcggcatgcgcttctacacgggcgcgcagttcccggcggcctacaaggacgcgatcttcatcgcccgccacggctcgtggaacaagacgcagaagctcggcggcgacgtggtggtggcgcgcctcggcgcggacggcaagatgacgggcctggagccgttcctgaccggcttcctgcaggacaaccgctacgtcggccgccccgtggacgtgctggtggcgcgtgacggcgcgctgctcgtctcggacgactacaacggcgcggtctaccgcatcagcgcggcgcgctga

SEQ ID NO: 7433 - DNA, 2256 bp, Methylobacterium sp.
gtgagccgagcgaacgacgtcgcccagcgcatcgatctgtcggcctgcgaccgcgagccgatccacgtcgtgggcagcgtccagccgcacggcttcctcctcgccctcgacgcgcggagcctcatcgtcgtccaggcgagcgcgaacgcgccggcggcggcctcggtcggtaccgccctggagagcgcctatccggacctcgcggcgctcgcgagccgctaccgcgacgcgggggatcaggaggacggcgcggcctacctgcgcaccgtcacgctgggcgcagggagcacgcgccaggcctacgaggtcgcggcccaccgggtcgacgacctcctcgtgctcgaactggaggagaccgacgacgcctcgggcgatgccgggctggacgcgctcacggcgcgcctgcgcgccttcgtgcagcgcctgcacgcggcgcgcagcgtcgaggatctctgcgggctgctcgcccgggacgtccgccacgtcacgggcttcgaccgggcgctggtctaccgcttcgaccgcgactggcacggcaccgtggtcgccgaggacggcaacggcgtgctgccctcctatctcgacctgcgcttcccggcctccgacatccccgcccaggcgcgcgagctctaccggcgcaaccgcctgcggatcatcccggatgcgggctacgcgccggtgccgatccgccccggcacgacgccagcgggccggcccctcgacctcagccagtcggtgctgcgctcggtctcgccggtccacgtcgcctacatgcgcaacatgggcacgatggcgtccatgtcggtctcgatcctcgtcgacggggcgctctgggggctggtctcctgccacaacgaggggccgaagcgcgtgccgctccaggcccgcaacgcctgcgacttcctcacccaggtcttcgccctgcagctctccgccaaggtgcgcggcgagcaggccgagcagcgcctcgcgctcggcgccgtgcaggcgcgcctcctcggctacatggcggaggaggacagcttcgtcgacgggctcctcaacaacccggacgacgtcctggcgctcgtgaacgcctcgggcgcggccgtcgtcaccgccgaccgctgccggctcctcggggcgacgccgccggagcgggcggtgcgggccctctacgactggctgtcggcccgcggggaggccgacgacgtcttcgtcaccgaggccctggccgaggccttcccgcgggccgagggcttcgcggatctcgcgagcggcctgctcgcgatctcggtctcgaagcgctacgcgagctacatcctctggttccggccggaggtggtgcgcacggtgaagtggggcggcaacccggtgaaggccgccagccccgaccccgagggcggcccggaccggctgcacccgcgcaaatccttcgagacctggaaggagacgctgaagggccgctcgctgccctggtcgctcccggaggtcgaggccgccaaggacctgcgcgcctcggtgctcggcatcgtgctgcgccgggccgaggaactcgccgcgatgagcgaggagctgcagcgctccaacaaggagctggaggcgttctcctactcggtcagccacgacctgcgcgcgcccttccggcacatcgtcggctacgcgaacctgctccggaaccgcgagggcccgagcctctcggacaaggggcggcactacgtcgagaccatcatcgaggccgcgttctcggcgggcaccctcgtggacaacctgctgagcttctcgcagatggggcggcacgccctgaacaaggtgccgggcgacatgggcgcgctcgtcgaggaggtccggcgcaaggtcctgcgcgacgtggatccggggcgggcggtgcgctgggagatcggcccgctcgggcgcgcctacgccgatccggcgatgctcaggctcgtcgtcgagaacctgctctcgaacgcggtgaaatacacccgcggcaggcccgaggcggtcatcgcggtcggccggctgcccccgcgggacggggagagcgtcttctacgtgcgcgacaacggcgtcggcttcgacatggcctatgtcgacaagctcttcggcgtgttccagcgcctgcaccgcgtcgaggagttcgagggcaccggcatcgggctcgccaacgtccggcgcatcgtcgagcgccacggcgggcgcacctgggcggagagcacgctcggggcgggcgcgaccttctacttcaccctgccggtccgcgaggaggcgcactga

SEQ ID NO: 7434 - DNA, 1542 bp, Methylobacterium sp.
atgcggcagggtttccggcaatcgatggcgtggctgcacgcgtggtccggcctcgtggtcggctgggtgctgttcgcggtcttcgtcaccggcacggcgagcttctacaggaccgagatctcgcagtggatgcgacccgaactcgccgcgaccgagaccgatccggaccgcgcggccgagctcggcgccgcctacctgcagcggcagatgccggacgcgatgggctggttcatcgcgctgccgacgcccgagaagcctgccatcgcggtgatgtggtggaagagcatggaggggccgttccaccaggccctgctcgatccggggacgggcgagccgacagtcgcgcgcggcacgaagggcggcgacttcctctaccgcttccactacgaactcagcatgccgccgacgctcgggcgctggatcgtcggggcctgcaccctggtgatgctggtggcgctggtctccggcatcgtcacccaccggcgcatcttcgccgacttcttcaccttccggcgggaccgctcggcccagcgcggctggctcgacgcccacaacgtcgcgggcgtgctcggcctgccgttccacctgatgatcgcctatacgggcctgaccctgctggcgacgctctacatgccctggggcgtgcgcaccgcctacaagggcgacgagatccgctacttcgtcgaggcgggcctgatgccggacctgcgctgggccgcgggcaagcccggcacgctcgcgccgctcggtcccatcgtcgcggcctcggtcgcccgcgggggcgaggcgcccgaggggctctcggtctggaaccccggcgacgccgccgcgacggtcgtggcgatcttcgaggagccgcacggcctctcccaccaccacccgcagatcgccttcgaaggccagaccggcgcggtgctgggccagaccggcgcggtcggggccgccaccggcaccgggacggtgatggcgggcctccatatgggccacttcgccggcccggccctgcgcgtcctgttcttcctctgcggcctgatgggcgcggcgacggtcgccaccggcctcgtgctctgggcggtggcgcgggcgccgaagggcgcggcggccgccggccccggcctgcggctggtgcgcgcgctcaatctcggcacgatcgcgggcctgccggcggggatcgccgcctacttcctggcgaaccgcctgctgccggtcggcctcaccgagcgcgcgtcctgggagatcggcgccttcttcgcggcctgggtactcgcagccctccacggcgccctgcggccgggaccgcgcgcctgggcgcaggcgctcgggctcgtcggtgcgctctacctcgcggtgccgccggtcgcggcgctgacgacggggctgtatcagcccggcggcgcgctgcgcttcctcggcttcgatctcacgatgctggtcctcgggctcggcttcgtcctcgcggcccgcaaggccgccgcccgcgcggaggcgccgctgcggcgcccggcccgcggcatgaccggtgaggagcctctccgcgcatga

SEQ ID NO: 7435 - DNA, 1116 bp, Methylobacterium sp.
atgagcgagcgcaccgagatcctcgtcttcgcccatgtcggcgacctgcacctgaccgacccgggagcccggaacgccgacgactaccaagccatcctcagcgagatcggcgagaccggcgggctcgatttcgtgttcctgccgggagacaatgccgatcacggccgggcggaggagtacgcgctcgtccgcgccgggctccgacgcctgcgcctgccggctcacgtcatcaccggcgaccacgacatggagggcggcagcctcgacgccttctatgccggactcggtgcgcagaggctgccctacggcgtcacggtctcgggcacgcgctgcctgttcctcgacatgtgcggtccgggcacgggcgggctcgacttccggctcgggtccgaacagatcgcctggctcgaacgagagctggccggggccgaggcggagggcgggatctgcgccctcttcatgcacagctacccggccgacctgaaggccgagggtgaggcatcacgggttgccgagctggtccaccgcgggccggtccgtctcgtcgagatgggccacacccactacaacgagctcgccaatgacggccgcaccgtctacgcggcctgccggtcgaccggacagatcgaggagggcccggtcggctacgccgtcgccgccctcgaccgcggcacggtcgcgtggcgcttcagggaggtcggccggtcttggcccttcgtgctgatcaccgctcccgccgaccggcggctggcccacgccgacgatcgcaccgtcgcgggcgacacggagatccgcgccgtcgtgctcgggtcggtagagatcgtcgagtgcgtctgccgcatcgacgacggtccctggcacccgatgcgccgcggcgcggatgaacgccgccaccgggcccgcctcgcttggccgtccggcgcgcggcggatcgcggtgcgcgcccgggaccgggcgggcggcctggacgaggatgtcgtcgaaccggcgagcgcgggcgcggcacccctgatatcgagggggatcggcagcgacgcggacgctgtcgggtcctggccggagaagggcctgctcggcagccagcttgggccgaaccggaacgggcgacagtggtag

SEQ ID NO: 7436 - DNA, 666 bp, Methylobacterium sp.
atgaacggcgcccaggatctcggcggcatgcacggcttcggccccgtgcggccggagcccgacgagccggtctttcatgccgattgggagcgccgcgtcttcgcgctggcgctcgccatgggcttcaccggcacgtggaacctcgacggctcgcgcgccgcccgcgagtcgctgccgccggccgagtacctcgcgtcgagctactacgcgatctggctgcgggcgctggaacgccaagtcgccgcccacggtctcgccagcccggaggagatggcgcgcggcgtctccgaggcgccggcccggccggtggcgcgggtgctgacggccgagatcctggggccgcgcttccgcgccggcttcccgagcgaccgtccggccccgggccccgcgcgcttcgccgtgggcgacgcggtgcgcgcccgcaacctccatccggtcggccacacgcgcctgccgcgctacgtccggggccgtcccggccgcgtcgagcgggtgcacggcgccttcgtgctgccggacacccacgcgaccggcgctggcgagaacccggcctggctctacaccgtggccttcgccgccgccgagctgtgggggccggacgccgatccgaaccagcgcgtgatggtcgagatgttcgagccctatctcgacgcggtcgccgcgtga

SEQ ID NO: 7437 - DNA, 321 bp, Methylobacterium sp.
gtgagcgcgccggagcccggccccttcgcggccccctgggaggcgcaggtcttcgccctggtggtgagcttgcgcgacgcgggcgtgttcacgtgggccgagtgggcggcggcgctcggccgggcgatccgccccggggacgacctggaggcggcggccgattacggccgctggctcgtcgcgctggaggcgttgctggccgagcgcggcatcgcggccccggagggcgtggacgcccgccgcgacgcgtggctgcgcgcggccgcggcgacgccgcacggccagccgatccgcctggagaacgacccgctgcgggcctga

SEQ ID NO: 7438 - DNA, 1335 bp, Methylobacterium sp.
atgacagcgaccacggatcagcccgtcggcgacgacatcctcggcatcggcttcggcccctccaacctcgccctggcgatcgcgctcgagaccgaggcgcggcacggccccgtccgtccctccgtgcgcttcctcgaacggcaggcgcgcttcggctggcaccgggccatgatgctgcccggcgccgacatgcagatcagcttcgtcaaggacctcgtctcgctgcgcgacccgacgaacccgttcagcttcctcaactacctgcaccggaagggccggctgaccgccttcctcaacctgaagacgttcaacccctcgcgggtcgagtacaacgactatctggcctgggcggccgagcacttcgccgacagcgtcgcctacggggagggcgtcgaggcggtgcacccggagatccgcgacgggcggctcgcggccttccgggtcgccgggcggacggcgtcgggcgcggtccggatgcggcgctgccgccacctcgtcgtcgcggcgggcggcgatccgtggatcccggagcccttcgggcgtctgcgcggggacagccgcctcgtccactcctcgtggtacctgccggggatcgccgcggcgctcggcgccccgagcctcgacgggccggagcggcgcgtcctcgtggtgggcggcggccagagcgcggtcgagatcgcggtcgatgcgggcgcgcgctatccgcgggcgtccatcgacctcgcgatccgcgcgcccgcgctgaaacccgccgacgacagccccttcgtcaacgagatcttcgacccggccgccgtcgaccgggtccacggcgcgcccgagcccgtgcgggcggagctgatcgccgcgcaccgcgacacgaactacgcggtggtcgacgccgacctgatccagtccttctaccagacgctctacgagcaggaggtgagcggcgagacgcgctaccgtctcctgcgcagcacccgcgcggtcgcggtcgcgcccggcccggacggcctcgccgcgacgctgcgcgacgacgtcgccggcacggagacccgccagggctacgactgcgtgatctgcgccaccggctacacccgcgcggcggtgccggcgatgcttgatccgctgcgtcccttcatggcgggcgagacggtcgaccggcactaccgcctgcccctcgcccccgccgagccgcggctcagcctgcacctgcagggcttcgcggaggcgagccacggcctcaccgagaccctgctgtcgatcctgccgatccgggccggcgagatcgccgcgacgatcctcgacctcgagcgggcggcccgcggcgcgatccgcccggccgccgagtga

SEQ ID NO: 7439 - DNA, 1110 bp, Methylobacterium sp.
gtggcagatcttgtcctgatcacaggcggagccgggttcatcggccgccatctcgcggccgccctgctgcggcgcggctaccgcgtccgggttctggacagcctgatcgagcaggtgcacggggtcggcgccggtacggcgctgccgcccgaggtggggttcgttgcgggcgacgtgcgcgaccccgagacggtcgcccgtgccctgaagggcgccgaccacgtcgtccacctcgccgccgaggtcggcgtcggccagagcatgtacgcggtcgagcgctacgtctcggtcaacgattgcggtacggcccagctcttccaggggctgatcgagcagccggtgcggcgcgtggtcgtcgcctcctcgatgagcgtctacggcgaagggctgtacctcgcggaggacgggcagaccgtcgaggacgccgtccggaagccccgccggcccggcgagccctgggatccgctcgatgcccaggggcggccgatgcgccccgtaccgacgccggagagcaagcgaccggccctcgcctcggtctacgcgctcaccaagtacatgcaggagcgcctgacgctgaccctcgcgccggcctacggcatggagggcgtggcgctccggctctggaacgcctacgggccgggccaggccctctcgaacccctatacgggcgtgctggcgatctttgccgcgcgcatccacaacggccagcgcccgatggtcttcgaggacggcgcccagcggcgcgacttcgtccatgtcgaggacgtcgcccaggcattcgtgctggcgctcgaacacccggccgcggcgggacaggtctacaacgttggcagcgggcaggaccgcagcgtcaccgaggtggcggaactgctcgccgccgcgatgggccgcgaggatctcggacccgagatcaccgatcaggcccggctcggcgacatccgccactgcatcgccgacatctcccgcatccgggccgagctcggctacgcgccgcgccgcgacttctcggaggggctcgccgaactcgccgcctgggtcgccgagcagcaggcggtcgaccgcgtcgcagaggcccggcgcgaactcgagatgcgggggctggtggcgtga

SEQ ID NO: 7440 - DNA, 702 bp, Methylobacterium sp.
atgaccgagcgcctgcgcctgttcacctcgccctccgccttcccgaaccctcagcgcgtgcggctcttcctgcatgagaagggcatcgcggaccgcgtcgacgaggtgatctacgacatggcgccgggcggccagcagcggcaatggccgcatctgaagatgaacccctggggcgagaccccgaccctgcaactcccggacggcacctatctcgccgagaccaccgggatcgtgcgctacctcgacaccgccttcgaggggcggcgcatcaccggtacggacgctctggagcagggcctcgacgcgatgtgggacagccggatctgggtgcacgtcctctaccggatcaccacgatgttccacgtgatgcatcaagggctcggcccgaaactcgaactgacgagcaatccgcaatggggcgagcattgccgcaaggaggccctggcccacgccgcgctcgtcgaccggcatctggctgacggccggtcctggctgctcgggggcgacgcgccgacactggccgacatcaccctctgcacggcgatcgccttctcgaaattcccggtgaacgcgacgccgctggacgagcgcttcgagcagatcgacgcgttctggaagcgctggaaggcgcgggagagcttccgcaaggcctatgcggacggcggcagcggcctcgatgaactgagcgagctgaagcgatag

SEQ ID NO: 7441 - DNA, 291 bp, Methylobacterium sp.
atgatcttcgactgggacgatgcgaagagcgcacgctgtctgctggagcgcggcttcggcttcgaccatgccgcgcgcatcttcgccggaccggtcctcgaacgcatcgacagacggaaggagtacggtgaactccgcatccaggcgatcgggaaaatcgacgggtgtctgtacttcgtctgcttcacggaccgggtcgtggatggagaatccgtgcgctggatcatctcggcccgccgcgcgcatgagaaggagcttccgcaatggctcggaaatcgctggacgacctga

SEQ ID NO: 7442 - DNA, 462 bp, Methylobacterium sp.
gtgagcgctctcgaccggaccgatctgaagatcctccgcctgctccaggcggacgggcgcatggggaacgccgagatcgccaagcgcgtgaacaccagcgcggcgacctgccaccggcgcacgcagcgcctgttcgcggagggctatgtccgcggggtacgggcgcaggtcgcgccggagacggtggggctcggcgccctcgtcatcgtcggcgtcgtgctcgaccgctcgacgcccgagagcttcgcggccttcgaggcggccgcgaaggcgatgcccgcgctcctcgactgccacctcgtggcgggggatttcgactacttcctgaagctgcgggtgcgcgacatggcggatttcaaccgcctgcacagcgccacgctgatcgcgctgccgggcgtgcgccagacccgcaccttcttcgtgatgaaggaggtggtcgacaacgcgcccctcgatctgtga

SEQ ID NO: 7443 - DNA, 138 bp, Methylobacterium sp.
atgttcctagcttgttctcaggaggcgcggcagatgctgaagcggatgatcctcaccggcatggcggagttcatggcgttcggtctcctgtcggtcgcgctcgtggcctggggcgtagccttggccccggtgaactag

SEQ ID NO: 7444 - DNA, 270 bp, Methylobacterium sp.
ttgagagagtgcgcccgtctcgtcctcctggccgccctcgcggccggcccgacgacgtttccgacccacgccgccgacggcacgctcggtcaggcgcggtcgcgggtggagatcggtgccgaggtctggcgcttgcgcccgtcccagacgggcgcgcccatgccggccggcatgccggttgccgcgacccgcaaagggcaggtggccgagatccccgaggcgcggcgcagcgtccggatggtctatccggccctggtcgaggcgcgctga

SEQ ID NO: 7445 - DNA, 1692 bp, Methylobacterium sp.
atgaccatgtcgagattgcgcaccatcggcgccaaggtcggtctatgccttgcgctcatcttcggcctcgtggcggcgctcggcgccatggccgtacacgagctgcgggcggtcaacggcgaggccgccgagttgcgcgacacccacctgccggccacccagatcctcggcaaggtccaggttctggtgctgcgccagcgcgtcaacggtgttcgcatcatcacggcggacacgccggagctgcgcgccgacgtccaggcgaccatcgacaagcgcgaccgcgagctcacggagctgcgcaccgcctaccgcgcgctgcccgcgaccggcgaggcgcgcggcctcttcgcggcctacgagcgggaatgggagacctaccagggcctgcaggcgcgcatcgccgccatggccgccgcgggcgaccgggacggcgcccagaagatctacatcaccaccatgtcgaccgggatcggcaaggtgctgggcgagctgcagaagctcgtcgatctgaacgacggctacgcgggcgccagcggcgaccgggcacgcgccgtctacgagcggggcctcacgctcacgctcgtcctcgtcggcctcgtggtcgcggtaatcgcggccgccatcctcggcctcgtcctgcatgtcgggcggccggcgcggcggatcacggacgcgatgaaccggctcgccgggggcgagacgggcctcgccatcccgggggcggaccggcgcgacgagatcggcgcgatggcagccgccctgcaggtgttccgcgacaacatgatccgcacccgccagctcgaggaggagacggcgctcgcccgcgccggcgccgaggcgcagcgcaaggcgacgatgcaggagatggccgacgggttcgagcgcgcggtcggcggcatcgtggcgaccgtgacgtcggcggcgacggagctgcaggccaccgcccagggcatggcctcgaccgcgcgggagaccgcgggccagtcggtctccgtcgcggccgcggccgagcaggcggccacgaacgtcaccaccgtggcggcggcggccgaggagctcggcgcctcggtctccgagatcggccggcaggtcgacggctcggcggggctcgccggcgccgcggtcggcgaggcggagcagacctccgcgctggtgcaggagctgagcagcgcgaccgcccgcatcggcgacgtggtggcgctgatctcgcagatcgcgggccagacgaacctcttggcgctcaacgccacgatcgaggcggcccgcgcgggggaggccggccggggcttcgcggtggtggccgccgaggtgaaggaactcgccaaccagaccgcccgggcgaccgaggagatcaccggccagatcggccggatccaggcctcgaccggccaggcggtcggcgccatcggggccatcacggggcggatccgcgagatctcgggcgctgtgacctcgatcgcggcggcggtggaggagcagggcgcagcgacccaggagatcgtgcgcaacgtgacccaggcctcggcgggcacgagcgaggtgacgagcaacatcgcgggcgtggcgggcgcggcggaggagacgggagcggcggcgagccaggtgcttgcctcggcctccgagctgtcgcgccagtccgagcatctcagcgccgaggtcgggcgcttcctcgccaccgtgcgcgccgcctga

SEQ ID NO: 7446 - DNA, 309 bp, Methylobacterium sp.
atgcgccgcctgccctggacgctcctgccgctgctcgccgccctcccggtcgcggcccaggcgccgggcgcagctcccccgatcggcgacgcggttccggtctgcgagagcctcgtggctctgcgccaactcgccgcgcgcgcgggcgaggaccgggcgcgcgccgccgccgcggtctcgggccagcccggatgccgtctcgtcccgcgcggcgcgatcggcgcggtcgagcgccgcgcgatggtcggcggcgcgccctacgagtgcctcgcccaggcgacgggcggctgcctgtgggtgatgccctga

SEQ ID NO: 7447 - DNA, 1488 bp, Methylobacterium sp.
atgcgcatcgtgaccgctcgcctgaaccacgagacgaacactttctcgccgctggcgacgccgctcgaagccttccggcccctctggggcgaggaggcccgggcggcggccgagggcagcgccacggcgctcggcgccttcctggccttcgcgaaggcgcgcggcgccaccgtagcggttccggtctcggcccacgccaacccgagcgggcccgtcgccgacgcggccttcgagaccctgtccggcgcgatcctggccgcggtgtcggaggggtgcgacgccatcctgctcgacctccacggtgcgatggtgaccgagagcctggacgacggcgagggcgagctcctcgcgcgcatccgggcggtcgcgccggacgtgccgctcggtgtcgccctggacctccacgccaacgtcacccccggcatggtcgcggcggcggacgtgatcgtcggcttcaagacctacccgcacgtggacatggccgagaccggcgcgcacgtcgcccgcctcgtcggccgcatgctcgacgagggcctggtgccgcaccaggcctggtgtcatccgccccagctcgcccacaccctgcggatggacacccgggtgccgggaccgatggccgatctcgtggccgccgcgcgcgcggtggaagagcggcccggcatcctcggggccacgctgttcgggggcttctccctcgccgacctgccggaggccggcgcatccttcctggtcgcggccgagagcgccgagcaggcgcgcgccgcggcggccgaactcggcggcgcgctctgggaccgccgcgcggagttcgtctacgaggaggagccgctcgccgcctcgatcgagcgggcgcggacggctgccgccgcgccgggcaccggccccgtcctgctcctcgaccacggcgacaactgcatgtcgggcggcacctgcgacgtgatggacgtgctcgccgcctgcctggaggccggcctcgacgggatcgtcgccgggccgatctgcgaccccgcttccgtggccgccctgttcgcggccgggaccggcgccgcggcggagatccggctcggcaacacggtggcgctcccgggcttcccggtccaggcgccgctggccctctcgggccgggtcgcgagcctcggcgacggcagctacgtcgtcaccggcccgacctatacgggacagcgcttctcgatgggccgcgccgccgttctcgacaccggccgggcgcgcgtgctggtgaccgaacagccgcacgagccctgggacctcgcgatcttcacgcagaacggcctcgacccgcgggcggcgcgcttcctgatcctgaaatcgcgcatgtattgccgtccggtcttcgagccgatcgcccgggcggtcgtcgagtgcgccagcgccggcgtcaccagctccgactaccagcgcttccccttcgccaagctggcgcgcccggcctacccgctcgacccggacgcggcctgggggccgcgatga

SEQ ID NO: 7448 - DNA, 1362 bp, Methylobacterium sp.
atgacgcgatgcgccgtcaccatcacggcgaacaaggatatgcgggacgtgacagcggacacgcgcggcggcgccgacctcagcgagatcgagcgccgcgtcctcgaccggatcgacgaggcggcctggctcgatctcgcctgcgccctgatcccggccggtcagccagaggccgagaacccgctcgaccccgacgagccgccagcgcgcgaggagggcgccgccctgttcgtcgccgacctgcttcgcgggatggacatcccgaccgagttggtcgccaagcggcccgggcgcccgaacgtcgtcggcgtgctcccgggagcggatcccgcggcgccctcgctcatcctgaacgaccacctcgacacctacccggccggcgactggtccgcctggacgatgaccggcggccatcccttccggccgacccggcacggcggccgtctctacgcgcggggcacctcggacacccgcggcaatctcgcctgcaccctgctcgcggtgcgggcgatccgcgaggccggcatccgtctcgggggcacgctgacctgcgcctacacggcggacgaggagaagaacgggccggacggctcgatcttcctgctcgacgagcggggcctcgccgccgactacaccatcgtgtgcgagccgacaggctggacgaatcccgacggctcctggggcatgggcgtcgccgtcgccaacggtggccacgccctcgtcgagatcgagacgcgcggggtgaagacccacctctggcggccggatacgggcgtcaacgcggtcgccacgatggcgcgcctgctcggcgcgctcgagagcatgaccttcacgcaccggcctgcccgcctcgccggtggcacgccgccgcgcaccgcgatcctgcgcgtctcgggcgggctgccccgggagatgcagttcacgccggatacctgccgggccgtgatcgccgtcgtcggcatcctccccggcatgagcctggagggcgtgatggcggatatcgatgcggtgatcgcggccgcggcggcggccgatcccggcctgcgggcgactgcccggccctatccgggcgcgctcttcgtcgacggcacgctggagcaggacgaggcggcgcagccgacagccgcgctcgcccgcgcctacgggcgcctgctcggcgaggccccgcggatctaccgcaagaacgccttcaacgacacgatccgcttcgccgagcgcggccacgccgcgatcaccttcggacccggcgaggacggctggccgccggtcaacgagttcatcgacatcgccaaggccgtcgccgcgacccgcgtgctggccctcacgatcctcgacctgctcggcgcggaggcaggcccctga

SEQ ID NO: 7449 - DNA, 735 bp, Methylobacterium sp.
atgatcgaggaggtcagcgcccgcgtgcccgcctcgctcgccgcctaccggggcggcgtcgcagccggtccgggcggccccggcgcccgcccgctcgcctccttgcgcgatccggcggtgttcgacgccacgctcgcggccttcggcgcgggcgtgggcgccccccaggccggcctcgagcggcgcgcgctcgtctcctactggagccagttctacctcgccgccctggcgacgccggcgctcaccgccctggtccgcctggggcgccccctgccgctcgccttcgagcggacgagcctcgaactcgacgccgccggccgcccagcgcgcctgctggtcgatccggcgacgggctgcggcggttcctgccgcgacgggacgcgggagccgcctcggcccggcctcgcgggtctggtggaggatcacctgcgcccgttcgtggagctgtgctgcgcccagtgcgggctcgccccgcgggtgatctggggcaacgccgcggtgatcctcgactacgtcgcgggggaactcgaaccggacgatgctcccgcctgcgccgaggtcgccgcctgtctcggccgccgcggcggcaccgcctgtacccggacgcccctcgcccaggccctctgcgcgggcgccgccggctgccgccgccgcacctgctgcctgcgcagccgcctgccgggcattccctcctgcggcgcgctctgcccgctggagcgctgcggcgggtcctga

SEQ ID NO: 7450 - DNA, 1188 bp, Methylobacterium sp.
atggcgcggtcgaggctctacaaggtcacccggggcacgctgcgcctgctgtcgcggccggtgcggcgggcgcaagggcggggcggcatcgtgctggagccctaccggggctacggctcgggcgacgagatcttcctgatcggccgtgtcttccggcagtcccggcccgatcccgacgccgaccgcgactcgctgcgcgacctctggcgcgacgtccgccgccgcatcgcccggcgcgccgtgaagggcggggccgtcaccgcacgcttcggcggcagcgagcagcgcgtggcgaccgaccgggacggctacttccgcgtgcatctgaagccccgcacgatgccggactgcgacgggccctggtacgcggtcgatctgaccctcgacgccgacccgccggtcgaggcccggggcgagatctacgtgccgccggccctcgcgcgcttcgcggtgatcagcgacatcgacgacacggtgatgcacacgggcgtcgccaacaagctggtgatgctgtggcgcctcttcgtcgaggatgcggagagccgcgtcgccttcccgggcgtcgccacgctgtaccgggcgctccacgacggcgcgggcggcgagcggaacccgatgctctacgtctcgcgggcgccctggggcctctacgacgtgctgagcgagttcttcgcgcgccacgcgatccccgccgggccggtgctgttcctgcgcgagtggggcctgtcctggacccatccgctgccgcgccgggccgaggaccacaagcgcatcctcatcggcaacatgctggcgctctaccgggacctgcccttcgtgctgatcggcgacagcggccagcacgacccggaggtctacgcggaggtggtggccgcgcatccgggccgggtgcgggcgatctacatccgcaacatttcggcggatgcggcgcgcatcgccgagatcgaggccatcgccgcgaccgtgacggcggccggggcgagcttcgttctcgccgccgacagcgtggcgatggccgagcacgcggtcggcctcggtctgatcgcgccggacgccgtggcgacggtgcgggcggagcgcgaggccgcgccgcccgagcccgccacgggcccgctgccgggcatgctgcgcccgtccgaggcaccgcccacggtggtgatcgagccggagggcggacggcgtctctga

SEQ ID NO: 7451 - DNA, 468 bp, Methylobacterium sp.
atgccggaacggcggatcgacgcgatcgaccggaagatcctggccgagctccagcgcgacggccgcatcacggtccaggatctcgccggacgcgtcggcctctcgccctccccggcgctccgccgcatccgcatgctggaggaggccggaatcctgcggggctacgtggcgctggtcgatcaggccaaggtcgggctgccgatcagcgtgttcgcctcggtgaagctggagcgccagcgcgaggaggagctcgaccgtttcgccgaggcggtggcgcgctggcccgaggtggtcgagtgctacctgatgaccgggcggcacgattacctcgtgcgcgtggtggtgccggatctcgccgcctacgagcgcttcctgaaggacaagctgacccggctcgacggcgtcggctcgatcgagtcgagcttcgccctggggcaggtgaagtacacgaacgtcctgccggtatag

SEQ ID NO: 7452 - DNA, 318 bp, Methylobacterium sp.
atgtcggcctgcatgagcctgctcggcggcgcctggacaccggagatcatctggaacctgagcgagggcgcgcgtcgcttctccgagcttcgccgcgcgatgccgaagatctccgccaaggtgctgagcgcgcgcctgaaggacctcgaggagcgcggcgtcctggttcgctccgtgctggcgacgaccccgccgagtgtggattacgccctgaccgatctcggcgaggagctgatcccggccatccgggcgatcgtggaggtgggctcgaagctgcacctgcgcgtgatgtcggcaggggcgggccgcgcggcctga

SEQ ID NO: 7453 - DNA, 330 bp, Methylobacterium sp.
atgcactacctctacctgctgctggccatcgtcgccgaggtcgtcgccacctcgtccctgaagatgtcggacggcttcacgcggctcgtcccctctctcgtcacggtcgtcggctacgccgcagccttctactgcctgtccctgaccctgcgggcggtgcccatggggatcgcctacgcgatctggtccggactcggcatcgtcctgatcgccgccgtggcctggatcttccagggacagcggctcgacgcgcccgcggtcgccggcatggccctcatcatcgccggggtcgccgtgatgaacctgttctcgaagaccggggcgcattag

SEQ ID NO: 7454 - DNA, 456 bp, Methylobacterium sp.
atgatcgatcgtacaatcgatggttgcgatgcgggcggttgcgagccggctccggcccaggccggcttctcgctcgtcgagttgctcgtggtcctggcgatcatcgggatgatcgccaccatggtgacgccccaggtgctgggctatctcggccgggccaagggcgagaccgcacggatccaggtcaagaacatcgcccaggcggtggaactctactacctcgatctcggcacctatccgacgagccagcagggcctgcaggccctggtccagccgaccggtcccggctggcgcgggccctatgtccgcgacgcccgcggtctgaccgatccgtggggccagccctatctctaccgctctccgggcgccaccgggctgccctacgaggtctactcgctcggcggcgacggcaagatcggcggcagcggcgaggggaccgacgtcgcgagcaactga

SEQ ID NO: 7455 - DNA, 2043 bp, Methylobacterium sp.
atgactctcccgggctggcgcgattgggccttctcgatcaagaccttcggagcggccatgctggccctgttcctggcgctctggatcgacctgcccaagccctattgggcgttgggcacggtctacatcacgagccaggtgctggccggtgccacccgctcgaaggccgtgtaccgggtcggcggaacggtgctcggcgcggtggtgaccgtcatcctggtgccgaacctcgtcgacgcgccggaactgctggtgctcgccatcgcgctctgggtcgctctctgcctctacgtctcgctgctcgaccggacgccccgcagctacctgatgatgctcggcggctacaccgccgccctgatcggcttcccgtccgtcggcgagccaggcgcgatcttcgacacggccgtggcgcgcgcccaggagatcacgctcggcatcctctgtgccagcctgatctcctcggtcgtcctgccgcaatcggtcgtgccggtgatcgccgggcgtttggacctgtggctgggcgatgcgcgggcctgggtccgcgacgtcctgggccgggccggtccggcggaggacacgcaggccaagcggctgcggctggcctcggacgcgatcgccttcgacgcgctcgccacgccgctgcgctacgacatgacgggcgcggagcgctcggccgaggccatggcgatcctgcgccagcacatgctgatgttcttgccgatcgtctcggcggtcgccgaccgcatcgagaccctggagcgagccggagccctgccgccgcgcttgcggggtcttctcgacgagatggtcgcctggatcgaggccggcatcaccgatccggccgaggcggcgcggctgcgcgccgcggccggggcactcgcgccggctctcggcgcgcggccgacatggaacgacctcgtgatggcgagcctgctcggccgcctggtcgacttcatcgacctgcgccaggacacccggctcctgcagcggcacatggcggacggcacgcccgtgcgcgagcatctggcgttccggtacacggccgccgcccggacgatccgtcatcgcgaccacgccatggccctcctgtccgcgatcggcgtgttcctgtcgatcctgctcacctgcgcgatctggatcgccacgggctggccggacggggccggcgcaccgatgatggcggcggtcgcctgcagcttcttcgccgcccaggacgatcccgcgccctccatcatcggcttcgcgaactcggccctgatcggcgcgctcggtgccgggatctacctgttcggcatcctgccgcgcgcgacgagcttcgagatgctggccctggcgctcgccccgggcctgctgctctgcggcgtcttcatggcccagccgaagaccgcgccgctggcgatgggcgcggcagtcaacggcccgaccttgatcgcgctccagagcagctacagcgccgacttcgccgccttcacgaactcggcgatcgccgtgatcctcggcatgtggaccgcggcgctgttcacgcgtctcgtgcggtcggtcggggccggctggtcggcccggcgcctgcgggccgtcaaccgccgcagcctcgcccgggccgcgcggcgccacggcgcccagaacggcctcgaactcgccgcgctcatgctcgaccgtgtgggcctgatcgcgccgcgcatcgccgccctgccgccggacgacgccgagtggaccgccgatctgctggccgaggtccgcgtcggcatcaacgtggtcgagctgcggcgggaccggcgacggctctcggacccggcgcgcgtcgcggtcgagcggctgctggccgacttggcgcgccatttcgagggcggggcggatgcgccgccggccgaactcctcgacgggatcgacgctgcgctcgacgcggtctgccgggatgccggccgggccgtgggccgcgccgcgctgatgggcctcgtcggcatccgtcgcggcctgttcccggatgcggttccctaccgcatgtccgccagcaccgcggcacgaccggagctcgcggcatga

SEQ ID NO: 7456 - DNA, 2376 bp, Methylobacterium sp.
atgaccgcccagagcctgcccgatccgcgcctgccctatctcgccgagctggagcgcaaggccctgtggctctccacctggatgatccacaacgccaaccacgtgcggccgaaccacgacggcatgaaggtcggcggccatcaggcctcctcggcctcgctcgcgacgatcatgacggcgctctatttcggcgtgctccgccccgaggaccgggtggcggtgaagccccatgcgggcccggtcttccacgcgctccagtacctcgccggccgccagacccgggagaagctggagaattttcgcggcttcggcggggtgcaatcctatccctcgcggacgaaggacaccgacgatgtcgacttctcgacgggctcggtcggcctcggcgtcgcacagacgctgttcggcagcctcgtgcgcgactacgtccgcgcccacggctggggcctcgaccggccggagggccgcatggtggcgctcttgggcgacgccgagatggacgagggcaacatcttcgaggccctgatggagggctggaagcacgggttgcgcaagacctggtggatcatcgactacaaccgccagagcctcgacgccgtgatccgcgagggcctctacagccgcttcgaggagatcttccggtctttcggctgggatgtggtcgtcctgaagtacggctcactgatggacgcggccttcgccgagccgggcggcgcgcggctccgcgcctggatcgacaccgcgccgaaccagctctacgcggcgctgaccttccagggcggggcggcctggcgccggcgcctgacccaggatctcgccgacgatgccgacgccctcgcactcctcgaccggcgcagcgacgaccagctcgccgagctcatgggcaatctcggcgggcacgacctcgtcaacctgctgaaggccttcgagggcgccgacaacgaccgcccgaccgtgttcatcgcctacacggtgaagggctacggcctgccgctcgcgggccacaaggacaaccattcggggctgctcacgccggcccagaccgagctgttccgcgagcggagcggcgtgcccgccggccgggaatgggagcccttcgcggggacacggctgccggaggcggagctgcgccgcttcatcgaccgggcgcccttcttccgcgaggggccgcgcctgcgcgacgccgcgcgcctgcccgtgccgcaggatttcccgtgcccgcgccagcccaccctctccacgcaggcgggcttcggcatgatcctgaacgagctcgcccgctcggacgcgccgatcaccgagcgcatcgtcaccacctcgccggacgtcaccgtctcgaccaatctcggcggctgggtgaaccggcgcggcctgttcgcccgcgaggagctgcgcgacctgttccgggccgagcgcatcccctcgaccttcacctgggatttctcggccaagggccagcacatcgagctcggcatcgccgagatgaacctgttcctgctgctctccgggctcgggctctcgcaccgcctcttcggcgagcggctgatcccgatcggcacgctctacgatcccttcattgcccgcggcctcgatgccctgaactacgcctgctaccaggatgcccgcttcatcatcgcggcgacgccctcgggcgtgacgctggcgcccgagggcggcgcccaccagtcgatcggcacgccgctgatcggcctgtcgcagccggggctcgccagctacgagccggccttcgtcgacgagttgtcggtgatcctggcccacgccctcgactacgtgcagcgcgacggcgaggccggcggctcggtctacctgcgcctgtcgacccgcggcctggagcagccgcaccgcgcgctctcggcggagctcgccgacagcgtcgtggcgggcgcctactggctgcgcgagccggggccgaactgcgaggtcgtggtcgcctatacgggggcggtggcacccgaggcgatcgaggcggtcggccgcatggccgaggatcggcgcgacgtcgggctgctggccgtcacctcggccgaccggctgcatgccggctggagcgccgcgcagggcgcccgcgagcacggggagcggggggccgagagccacatcgaggcgctcctcgggcgcctgccgcgccattgcggcatcgtcaccgtgatcgacgggcaccccgcgacgctgggctggctcggctccgtgcacggccaccgcacccgggcgctcggcgtcgcgcagttcggccagaccggcacggtggccgacctctaccgccatttcggcatcgacgcccgcggcatcgtcgcggcggcgcaggggctcagcccggagcggccgatccggcagttgagtctggttgcgggctga

SEQ ID NO: 7457 - DNA, 1338 bp, Methylobacterium sp.
gtgcggacatccgacttccgggacgtggccgacgcggtggccgccgagatcgcctcgggggcgctcaagcccggcgaccgcctgccgccgcagcgggacttcgcctacgcccgccgcatcgccgtctcgacggcgagccgggtctacgcggagctcgcccggcgcggcctcgtgacgggggaggtcgggcgcggcacctatgtgcgctcggacctgaacggcccggggccgatccagtcggagccgccgcccgccgcaatcgatctccagcgcacgcattcccgcctgcccgagcaggaggcgatgctctccgagaccctggcgaccctcgcccgcggcggcggggcggaggcggcgctgacgcatttcggccctgtcggcacgcccgtcgcccgccgggtcgcggccgccttcctggcgcgggacggctacgcgccggaacccgcggatctgctcttcaccggcaacgggcggcaggcgctggccgccgcgctcgccgcgctggcgccgcccggcgagcgcatcggctgcgagccgctgacctacccggtcgtgaagggcatcgcggcccgcctcggcattgggctggtgccgctggcgatggacgcggagggcgtgcggcccgaggcgatcctgcaggcgcaccgcgccacgccgctctccggcctctacctgcagccgacgctgcagaacccgctcggcgccaccatgggcccgggccggcgcgccgagatcgcggcggtgctggcccggaccgggctcacggcgatcgaggacacggtctacggcttcctctcggacgcccggccgatcgcggcgctcgcgcccgcccgcacgatcctggtcgacagcttgtcgaagcgggtgatgccggggctgacgatcgggctggtcgcgagcccgcccgacctcgtggaccggctcgcggcctcggtccggcaggggggctggtcggccacgggcctgccgctggccgccggcgtgcagtggatgggcgacggctcggccgcgcgcctcgtcgcggccaagcgcgcggacgcggcggcgcggcaggtgatcgcccgcgcgggcctcgcgggcctcgcggtcgcgggcgatccgagcgcctaccatctctggctggaactgcccgagacgtggcgggcggaggccttcgcggcggcggcgctgcgccgcggcatcgcgctgattccggcggcctccttcgcggtgaacccgggccacgccccgaacgccgtgcggctcgccctcgcggtgccgccgcgcgacgccctggccaccgccctggcggacctgcgccgcctcgcgctcgccggggacgaccacgcggtcgagtag

SEQ ID NO: 7458 - DNA, 843 bp, Methylobacterium sp.
atgccgctcatcgcctcgacctacggcaaggcccgcgtccgagtgatgcgcctcgtccgcgacggcgaccaccacaccccgcgggaactcgacctgacggtgatgctgcggggcggcttcgacgcggcctggacgggggccgacaaccgcgcctgcatcgcgaccgatacggtgaagaacatcgtcaacgtggcggcggcgcggaacgtcggcgccgacgcggaggccttcgccggggccctggcgacgctcttcctcgacacctacccgcaggtcgcggagatcacggtcgaggcccgcgagacgcgctggctgcgacgcgccatcgacggcgccccgcacgggcacaccttcacgctcgacggcaacggcaccggctacgtccggctgacggcaggccgggaggcgcgggcgctccgctccggcctgcgcggctacaccttcatgaagaccacgcaatccggctggtcgaacttcttcggcgacgattaccggacgctgcccgacaccgacgaccgcatcgccgccaccagcatggacgcgacctggacctgggcttttgcgccggtggactacccggcggcgaacgcggccgtgctcgacaccctgatccgggtcttcggcaccacctactcggcgagcgtgcaggattcgatgtaccggatgggcgaggcggtgctggccgcgatccctgagatcgccgagatcggcttcgccatgccgaacaagcactacatcccgatcgatctccggcccttcggcctcgacaatcccggcacggtcttcctgccgaccgacgagccgcacggccagatcgaggcgacggtcggccggggcgtctga

SEQ ID NO: 7459 - DNA, 513 bp, Methylobacterium sp.
atggccgacagcaaacggatcgtcgacgcactcgtgcgcgcccgccgcggcggcttggccgccggcgccgcgctcggcggcctcgccctggtcggcagcatcgcctggcacgccctgcggggcgcctccgcgacggggacgccgacgccggatttcagggacgtcggcgaggacgaggcgcggctgatgctgcgcgcgatggtggccgcaacgcttgccgacggggtgatcgacgcaggggagcggcagcgcctggacacggcggtcgcggaggccggcatcgaccgggacgggcgcgcctggctcgaccgcgagctggagagccccgccgagatcgacgagatcgccgacgccgtggacgcccccgaggccgcggcccggatctacgccgccgcgcgcctcgcgatcgacctcgacaccgtgcaggaacggcagttcctcaagatgctgggcgaggcgctcgacgtgtccgcggaggcggccgagcgcatcgagcgggaactggcgggctga

SEQ ID NO: 7460 - DNA, 138 bp, Methylobacterium sp.
atggacaccacctccgctccccgataccccgcgctcctgtggcgccgcctcgtctggttcgcctcgctgtgggcaggcagcgtcctctcgcttggggtggtcgccggcatcctgcggacttggctgaaggcgagctga

SEQ ID NO: 7461 - DNA, 786 bp, Methylobacterium sp.
atggagacgcggaagatggtgggcaccaagccgatgccgttcggggaactggtccgatcgggcacgacctacggcaccttcgtcggcctcggttcgacggtcgcggcggaggtctgcgcgctggcgggcttcgactggctgctgttcgacctcgaacacggggcgggcaacgagcgcgacctgatcggccagatcgccgtcgccaggcgccacggcgtcggcacggcggtgcgcgtcgagacgccgacgcgcatccgctgcggccgcgtgctcgacctcggcgtcgaggcggtgatggcgccccggctcgacagcgccgaggaggcggcggcgttcgtcagccacctgcgctacccgccgcagggcgaccgcggcgtcgcgacctaccactccgccgccgccttcggcctcgatcccggctatctcggccgcgccaacgacgccgtggtggcgatcgtgcagatcgagacgcagccggccctgtcggacgtggagcgcatcgcccgcacgcccggcgtcgatgtcctcttcgtcgggccgcgcgacctcgccgcagccctcggcacgacgccctccctcgacgcgcccgacttcgccgccgccctgcgccgcgtggtctccgcctgccgcggtgccggcatcggcgccggcgtgctcgcgggcgacgcggccagcgccgcgcgctacgtccagatgggcttcgccttcgtcgggatcggctccgattccgccttcatcgcccagggcgggcggcaggcgatccgggcggccaaggcgttgacgtga

SEQ ID NO: 7462 - DNA, 765 bp, Methylobacterium sp.
atggacgtcctgaccaaccgcttcaaggccgccctcaaggaagggcgtcagcagatcggcctgtggtgcagcctggcgagcccgatctcgaccgagatcgtggccggctccggcttcgactggctgctcctcgacatggagcactcggccaacgacctgcgcgacatctacggccagctccaggcgatcatggagggcgaggcccacgccatggtgcgggtgccgagcgacgagccgatcacgatcaagcgcatcctcgacacgggcgcgcagtcgctgatgatcccgaacatcgacgacgcggagcaggcccatcgggcggtcgccgcgacccgctacgcgccgcgcggcgtgcgcggcttctcgcaggcgccccgcgccgcccggttcggccgcatcccggactaccacgcccgctgcgaggccgagatcttcgtcgcggtgcagatcgagtcgcggcgcgcgctggacaacctggaggagatcgcgggcgtcgagggcgtcgacggcgtcttcgtcgggccgggcgacctctcgaccagcctcggctatctcggccagcagaaccacccggaggtggtggcgatcatcgaggagacggtggcgcgcatcacccgcacgggcaagctcgccggcatcctcacggcgaacgaggatctggcccgccgctacatcgcggccggcacccgcttcaccgcagtcggctccgacatgggcttgctcgcccgctcgaccgaggcgctcgccgcccgcttcaagggctga

SEQ ID NO: 7463 - DNA, 270 bp, Methylobacterium sp.
atggcgatgttcgatctcgacgcgacgcttgatcttctcgatacccccgcgctcccggcggacgacgacgccgtgtgggcagcgcgcgaccgcgatcacgggcgggccgcgctggcagccgccctcgacgacgggctcctgtccgaggaggtcgacgcgatcctgggcggccgccgggtggtcgaggccttcccggttcgctggggcgagagcccgccggcctacgcgacccgcgccgtcgccgagatgatggccgcctacctgcggtag

SEQ ID NO: 7464 - DNA, 324 bp, Methylobacterium sp.
atgagcgaagtgctcgcggctgcccgcccgaagcgggctccgacccatcccggcgcgatcctcagggaggacgtgctaccggccctcggactacccatcactcaggtcgcggatcatctgcgcatcacgcgtcagcagcttcatcgcgtgctgtccgagcagtccggcatctcgcccgagatggctcttcggctcggcaagttctgcgggaacggcgcggccctgtggatccggatgcaggaagcgttcgacctctggcaggccaagaacaagctcggcgacgagatcgacgacatcccgacgatgccgtttgctcccgcctga

SEQ ID NO: 7465 - DNA, 411 bp, Methylobacterium sp.
atgaagcgcgccgctctcgccgccacgccgctcgccttggcgctcgccatgggtgcgggcctcggcccgcccgcgaccgcccgcgcccagaccgtcgaggacggctccggggcccggatcgggcccgcggacacccgcgcggtgctcgatctggtcggccggaccctgaacagcccggaggcgcgggtcacggagctgcgccgcgccgagggcggggcgatctgcggctcggtggacgtccggaaccggcaggggctctacagcggtccgcgcggcttcgtggtcgatctcgcccgcgccgaattcggccgggtgccggacgggccggagctcctgagcccggcccggggcgaggaccgggaggccatggagcgggtgcgccagctctacttccggctctgcctggactag

SEQ ID NO: 7466 - DNA, 1248 bp, Methylobacterium sp.
atgaccctgaccgaaccgaccgagaaccgccccacggatcccgaggccgccgaggcgatgcgtccggtgcgcgccgcgccggggcgccacccgactctcgtcctgctcgcgctcgcggtcgggggcttcgccatcggcaccacggaattcgccgcgatgagcctgctgccggcctttgctcccgaactcggcatcgatgcgccgacggccggacacgtcatcagcgcctacgctttgggcgtggtggtcggcgcccccctgatcgccgtcctggccgcgcgcttcgcccgccggaccctgctcgtcggcctcatgctgctgttcgccgtcggcaacgccctctcggcgctcgcgccggattacggctggatgctggccttccgcttcattgccgggctgccgcacggggcctatttcggcgtggcctctctggtcgccgcctcgctcgtgccgcgggagcgccggacgcaggcggtctcgcgggtgaccctcggcctgtcggtggccaccatcgtcggcgtgccgctcgccaacggcatcgggcaggtcgtcggctggcgctggagcttcgccctcgtggcggcgctcgccaccctcacggcgatcctggtccagctcttcgctcccctcggccagcccgtccagggtgccagcgccctgcgcgaactcggtgccctgaagcgggggcatgtctggctcaccctgatgaccggcgccatcggtttcggcggcctgttctcggtctacacctatctcgcctcgaccctgctcgaggtcacgcacgcctctcccgtggtgatccccgcggtgctcgcggtgttcggtctcggcctgaccgccggaaccttcgtctgcgcctgggccggcgaccgggccctgatgccggcgatcggcctcaccctgctgtggggcgccggcgcgctcgccctctatcccctcgcgaccgggaacgtctggaccatggtggcggcggtgttcctgatcggctccggcggcggcctgtcgagcctgctccaggctcggctgatggacgtggccgaggatgcgcagacgatggcggcggccctgaaccattcggccttcaacaccgccaacgccctcggaccgtggctggccggcctcgcgctggcggccggatacggcctgccgacgacgggcgtggtcggcatgggcctcgccctctcgggcttcgccatctgggcggtgtcgtacctgctggatcgccgggccgttgcggtgcggcgctga

SEQ ID NO: 7467 - DNA, 771 bp, Methylobacterium sp.
atgaagaccgcaggcaacaccatcctcgtcaccggcgggggctcgggcatcggggaagccctcgcgcagcgcttccacgatctcggcaacaccgtcatcgtcgccggacggcggacggcgacgctggaggcggtcgccgccggccgcccgcggatgcacgcgatgccgctcgacatcgccgatgcgggcgacatcgccgcgttcgcgcggcggatcatcgccgagcacccgtccctcaacgtgctgatcaacaatgccggcatcatgcgcttcgaggcgctcgaccgggcgcgcgacctctcggacgccgaggccacggtcacgaccaacctgctcggcccgatccggctgaccgacgccctggtcgagcacctggccgggcagcccgacgcggcgctggtcaacgtctcctcgggcctcgccttcgttccgctgacggcgacgccgacctactgcgcgacgaaggcggccatccacagctacacgatcgccctgcgggaggccctgcggggccgcgtcgaggtgatcgagctggtgccgcccgcggtgcggacggagctgaccccgggtcaggccacccgcgagggctacatgccgctcgccgccttcatcgacgaggtgatgatgctgttccgggtgcagccgaccccgcgcgagatcctggtggagcgggtcgccttccagcgcaacgccgaggcggagcaccgcttcgacgcggcgctgacgaccctgaacgaggcggcgcgcaaggcgcgggaggcgcagccatag

SEQ ID NO: 7468 - DNA, 648 bp, Methylobacterium sp.
atgggcgacaagctgatccgccagaacgtcatcgacgagctcgacttcgacccgagcatcgacgccgcccatatcggcgtcgccgtggagaacggcatcgtcacgctcaccggtcacgtcggtagcttcaccgagcgcgtcgccgccgagaaggcggcccagaaggtgcgcggcgtgcgcggggtggtcgaggagatccaggtccgcttcggcggcgagacgccgccgcgcgacgaagatatcgcccagcgcgcggtgcagatgctcgactggtcggtgaccgtgcccaagggcgccgtgcaggtgaaggtccagaacggctgggtgacgctctccggcaaggtcgactggcagtaccagcgggaggaggcctaccgcgcgatccggcgcctcgtgggcatcgccggcatcatgaacacggtcgaagtggccccgaaggcgagcgcacccgacgtgcgctcgaagatcatggcggcgctcaagcgcaacgccgagcttgaggcggatgccatcaaggtgacggtgaaggacgccaaggtcgtcctggagggcaaagtgaacgcttggtacgagcgcgagcttgccgagaacgccgcttggtcggccccgggcgtgcgcgccgtcgaggaccacctcaagctgggctga

SEQ ID NO: 7469 - DNA, 1671 bp, Methylobacterium sp.
atgaaaatcggaacgaaactccttgggctcgtcggcggctgcagcgccgtcacccttgtggtcgcggctctgggcatcggctcgctccacaccctcaacgcggcgatcggcgacacccggcacgcggccacgcgcgcgctcaacggggcgaacctcaaccgcctcgcatccgaggtgacgatggattcgcgcggcgtctacgcctcggccgaccgcgccgaggcgaggaagtacgccgacggcatcgcccggggcctggcggcgatggaggccctgctgaaggcctgggcgccgatcgtcgggccggccgaccgcgccctgttcgaggcggtgtcccgcgacgcggcggccttcgcgcggatgcgcaccgagatcgcccgcgccggcaccgaggacgcgccgaaggccgccgccgcgctcggcttcaacgaggcgaaccagggcaaccgccgcgcctttcaggcgggcatcgccgagctggtcaagcgcgggcgcgacgaggtcgaggcgatcgatgcggccaccgatgcgctctacagccagcgcatggccctgctgctggccctggccctcggcggcaccctgggttgcctcctgatcggcgggctgatcgggcggcgccagatcgcccggcccctcgctgccgtctcggacgcgattcgggcgctggccggcgggcggcacgacctgccgaccgtccggcccacccgcgacgagatcggcgcgatctgggcgagcatgcaggtcttcgcggacgccatgcgcaccgccgaatccctgcgcgccgatcaggcacgggcggcggcggcggcgcgcaccgcccggcaggccgagatgggggctctggccgagcggttcgagggcagcgtcggtgagctggtccagcacctcgcggccgcggcgacggagatggaggctaccgcccgcagcctgaccaccaccgccgaggcgacgagccgccgctcggagaccgccgcccaccgctccggggagaccgcgggcagcgtcgaggcggtcgcggcggcgacgcagcagctcgccgccagcgccaacgagatcggtgcccaggtggcgcgcaccgccgaggcggccgcgggcgccgtcgcgggcacccgccgcagccgcgagcaggtcgagatcctggcccgcagcgccggcggcatcggcgaggtggtcggcctcatcgccagcatcgcgggccagacgaacctgctggccctcaacgccacgatcgaggcggctcgcgccggcgaggcggggcgcggcttcgcggtcgtcgcggcggaggtgaaggagctcgctgcccagaccgcgcgggccaccgaccagatcaccgcccagatcgccacgatccaggacgcgacccgcgagaccgtctcggcgatgggcgagatcgacgcgacgatcggcggcgtgcaccagatcgcgctcggcgtcgccgccgcggtcgaggagcagcaggccgccacccgggagatcgcccgcagcgtcgcgggcgccgccgagaacacgcgggccgtcaccggcagcatggcggagatgcgcggcgatgcccaggcggcgggcgcgggtgccgcccaggtgctgtcggcggccggcgagctggcccgccgggcgggcgacctcggcgtgcaggtcgacggcttcgtcgccgaagtgcgggccgcctga

SEQ ID NO: 7470 - DNA, 924 bp, Methylobacterium sp.
gtgcagacgacgagcctgcgttacttcctcactgtggcgcgcaccggctcgatcgcggcggcctcgagccagctcaacgtcgccgcctccgcgatcagtcgccagatcgccaatctcgaggccgagctcgactgcgtgctgttcgagcggcgcccgcgcggcatggtgccgagcccggccggcgagcgcctggcccagcacgcccagcacgtgctgttgcgggccgagcaggtcgtcgccgagatccaggaactgcagggcgtcgtccgggggctcatccggatcgcctgctcggagggcttcgcgctcgatctcgtgccgaaggtcatggcgggtttccacgcccgctatcccgggatccgtttcgagctgacgatgctgccgccgggacaggtgacgcaggtcgtcgccgccggcgaggccgatatcggcgtgaccttcaagctcgcctcgaccccgccggtcgccgtggtctacgagacgcaggtcgagatgatcgccgtgtccgcgccggatcatccgctcgcgggatctccgggcatccggctcccggagctggcggcctttccgctcgccctgcccacgcgggacaccaccgtccgccttgtcttcgaggcggcctgctacgccgaagggatcgcgatcgagccggcactgaccgcgaacgtgctgtcggcgctcctgcccttcgtgcgctactcgaagggcctcgccctgatgtcggcgctcaccgtccagacgccgctgcatctcggcgagctggttcagatcccgatccgggcgcggagcagcctgctgcgcggcatccaggtccagaccatgcgcgaccgccgcctgccccgcgccgtgacggtcttcctgcacgcgctgatcgccgcgctgccggcatccggcagccgcgcgctgcccgagggtcggctctga

SEQ ID NO: 7471 - DNA, 1518 bp, Methylobacterium sp.
atgctgagacagacgctcgcagcccttctgctcaccgcgaccgcgctcactgcgccggcgctggccggcaaggcgaacgacaccctggtctacgcctcggacagcgagcccgagaacgtcagcccctatcacaacagcctgcgcgagggtgtgatcctcgcccgcaacgtctgggacacgctgctctaccgcgacccggcgaccggcgactacaagccgatgctggcgaccgcctggacctgggtggatccggtcacgctggatctcaccatccgcgagggcgtgcgcttccacaacggcgacccgctcacgcccgaggacgtggccttcaccttcaactacgtgctgacccccgaggcccgggtggtgaccaagggcaacgtggactggatgaagtccgcggaggtgacaggcaagaacagcgtccgcatccacctcaaggcgccgttcccggcagccctcgaatacctcgccggcccgacgccgatcttcccggcagcctacttcaagaaggtcgggctcgacgggttcagcaaggcgccggtgggcagcgggccctaccgcgtcgtcggcgtcgagaacggccgcggcgtgaagatggagcggttcgagggctactggaccggtggtccgatcgccaagcccaagatcggcaagctggagttccgcgtcatcccggacggcgacagccgcatggccgagctcgtcaccggcggcatcgactggatctggcgcgtgccgaccgaccaggccgagcagctgaaggcggcgcccggcgtcacggtgctgtcggccgagacgatgcgggtcggcttcctgcagttcgacgtgctcggccgggcgcaggcgaactcgccgctgaaggatgcgcgcgtgcggcaggcgatctcctacgccatcgaccgcaaggccatggtcgacaacctcgtgcgcggcggcgcgcgggtgatgaactcggtctgcttcatcgaccagatcggctgcaccgacgcgggcttgccgcgctacgcctacgacccggccaaggccagggcgctcctgaaggaggcgggttacccggacgggttcgagatcgatctcgccgcctaccgcgagcgcgactacgccgaggcggtgatcggctatctgcgggccgtcggcatcaaggcgcggctgaactacctgcgcttcgccgccttccgcgaggcgctgcggggcggcaaggtctcgatcggcttccagacctggggctccttctcggtcaacgacgtctcggccttcacgggcgtctatttccgcggcggcgaggaggacctgacgaaggacccggccgtgatcgccctgctccaggcgggcgacaccggcacggacccgcaggcccgcaaggcgaagtacgccgaggcgctcaagcgcatcgcggcggaggcctacgcgctgccgatgttctcctacccgtcgaactacgccttctcgcaggacctgaacttcaccgcgcaggcggacgaggtgccgcgcttctacgccgcctcgtggaagtga

SEQ ID NO: 7472 - DNA, 915 bp, Methylobacterium sp.
atgctcggcttcgcgctccgccgcatcctggtcgcgatcagcgtcgcgatcaccgtctcggtggcgagcttcctgctcctccacctctcgggcgacctcgccaccgcgatcgccgggcccgaggccacgggcgagcagatcgcggcgatccgccagcaatacggcctcgaccagccgctcctcgtccagttcgccgactgggcgggccgcgcattgcaactcgatttcggcaactcgttctacttccgcgagcgggtctccgacctcatcgcctcgcgcctgccggtgaccctgacgctcggcgtcgtcgcgctctgcgtggcgctcttcgtggcgatcccgctcggcgtgctggcggcggtgcggcgcgacacctggatcgaccggacggcgctcgccgtctcggtgctcggccaagccatgccgagcttctggttcggcctgacgctcatcatgatcttctcggtcaacctgcgctggctgccggtctccggcaacgcgacctggaagcacttcgtgctgccggccgtcgcgctcggctactacgccatgccagccgtgatgcggctcacccgcaacggcatgctggaggtgctggcctcggactacgtccgcaccgcccgcgccaaggggctcccgccccgcaaggtcctggtccgccacgcgctccgcaacgccgtgatcccggtgatcgcgctcgccgcggtgcagttcggcttcatgctgggcggctcgatcgtgatcgaggcggtgttctcgctccagggcctcggccagctcgcctgggaatccatcgcccgcaacgacttccccgtcgtccaggcgatcgtgctggtgctggcgatgatctacatcgccctgacgctggccgccgatctcctcaacgccctcctcgatccgcgcctgcgctcatga

SEQ ID NO: 7473 - DNA, 219 bp, Methylobacterium sp.
atgcccgtcttcgaatccaagacccttgatgccgaattcgacgggcaggcgctcctcgcggcgatcctgcagccgacgcgttccgcccgcagccaagccctggtgaacgggcgccgccgggcgaagcgcgggatcatgccggccgggtctgcgacgctgacggcgcgcgagcccgccgcggtcgacatcgtcgcccccgccacgctctccgcgcgctga

SEQ ID NO: 7474 - DNA, 597 bp, Methylobacterium sp.
atggcccaggaagcgatcctcatcatcgacgaccacgcgttgttccgatccggcatcgtgtcgatgctctcgacggcgttcgacagcgttctgatccgcgactgcgcgtccctgcacgaggctctcgccgccgacgacgtcgtgccgacggtcgtcctcctcgacatccagctgccggggatcggcggcctggaagggatgggcctgctccggcaacgctggcccgccgccaggatcgtcgtcgtctccgccctggaccttccggatacggtcggcgccgcgctcgctcagggtgcctgcgcgttcctgtccaagacggatcggccggaccggatgatgacggtcctgcgcgagatgctggatcggccttccgccagcccgtccgtcggagcggtcgtctgcccgtcgctgaccccgcggcaggccgaggtgctcatcctcgtcgggcgcggattgtccaacaaggtgatcggccgccatctcggattgtccgagcatacggtccgaggtcatgtgcagggtttgctgtcggtcctcggcgtgaccaggcgcgcggaagccgtcttcaaggcgcagcagctcggcctgattcgatga

SEQ ID NO: 7475 - DNA, 1422 bp, Methylobacterium sp.
atgtcccgaaccgacgccgtcgccctggcggaacggcactacgacgacggaaccttccgcgccgtcctgcaggacgcggtcggccgccccaccgagagccaggcgtcgggccaggtgccccagctccgggcctatctgtccgacttcgtggcgccgctgatcgcccggctcggcttcgagagccggatcctcgacaacccggacggcgtgcacggccccttcctgatcggcacccgccacgagggcgacgacctgccgaccgtgctggtctacggccacggcgacacggtgcggaactaccccgagcagtggcgcgccggcctgcacccgctggagatcgtcgtcgagggcgagcgctggtacggtcgcggcaccgccgacaacaagggccagcacgtcctcaatctcggcgcgctggaggccgtgatgcgggcccgcggcggccggctcggcttcaacgtcaagctcctcgtcgagatgggcgaggaatcgggctcgccgggcctgcgcgagatctgccggcaggaagcggaggcgctgagggccgacctcctcatcgcctcggacgggccgcgggtcagcgccgagcggccgaccctgttcctgggctcgcgcggcggcttcaacttcgagctggtggtggacctgcgcgcgggcggccaccactcgggcaactggggcggcctgctgcgcaaccccggcaccgtgctggcgagcgccatcgcgagcctcgtggacggccgaggccgcatccggatcgaggcgctgcgcccgccgccgatcccggagggcgtgcgcgcggcgctcgccgacatcacggtcggcggcgacgcgaacgcgccggagatcgacgcggactggggcgagcccggcctctcgccggccgagcgggtcttcgcctggaacacgctggaggtgctggccttcaagtgcggcgatcccgatggaccgctcaacgccgtgccgccctcggccaaggcgaccctgcagctgcgcttcgtcgtcggcacggactggcaggggctgatcggcgccgtccgggcccatctcgacgccagcggcttcccgatggtcgcggtccagccctgccggagcgaggtcttccgcgccacccgcctgccggtcgaggatccctgggtcggctgggcgctcgcctccatcgccgagagcacgggcaagcgcccggcgctgctgccgaacctcggcggctcgctgccgaacgacgccttctcggagatcctcggcctgcccactctctgggtgccgcactcctatccggcctgctcgcagcacgcgcccgacgagcacctgctcgggccccagacccgcgaggcgctcgggctgatggccggcctgttctgggatctcggcgagaccgggcccgaggttctcgcccgacgccgggccgagcagggcgcctga

SEQ ID NO: 7476 - DNA, 957 bp, Methylobacterium sp.
atgacgatccagcccgcctccccgccggccgcgcccggcctcgctcccgagatgctgatcccggcccccgcggagaccgccgcgccgctggcgccggcccgctcaccgaccgcgctcgcgctccggcgcggcctgcaccatggcggcttcctgatcggggccggcatcctcggcctcatcgttctggcggcgctcgccgcgccgctcatcgccccccacgacccctacgcgcaggacgtctcgcggcgcctgatcccgccggtctggcacgccaagggctcctgggagcacgtgctcggcacggacaagctcgggcgcgactacctgagccgcctgatctacggcagccagatctccctgctgatcgggctctcggcggccctgatctcggggatcatcggcaccacgctcggcatcctggcgggctatttcggcggtcgggtcgatgctctcgtcagctacgtcgtcaccacgcggctcgctatgccggtggtgctggtggcgctcgccatggcctcgctggtcgggggctcgctgaaggtcgtggtgctggtgctgggcctgctgctctgggaccgcttcgcggtcgtcacccgcgcggcgacccggcaggtgcgcggccaggacttcgtggcggccgcccaggcctcgggcttcggcacggcccggatcctgttccaggagatcctgcccaacatcatgaacgccctgatcgtcgtcgcgacgctcgagatggcgcacgcgatcctgctggaggccgcgctctccttcctcggcctcggcgtgcagccgccgctgccctcctggggcctgatgatcgccgagggcaagcagtacatgttcttccagccctgggtgatcaccatcccgggggtggcgctcctcgtcctcgtgcttgccatcaacctgctgggcgacggcgtgcgcgacatcaccgcccccgagggccggcactga

SEQ ID NO: 7477 - DNA, 1131 bp, Methylobacterium sp.
atgatccgtgatctcgccgatatgaccggcgcatcgtcgcgacggagcggcctcgcgacgaccctgcttgccgcagcgctcgcggcggccgtgtgcgcgaccgcccgcgccggggatgccgtgccccgggccgagccctggaaggtctcgggcaagctctacggcgagccggacaaggaccgcccgggggatttcgccgcgagcgacaaggccgacgacgtcagcggcatcgcctgcgccaccgcgtcgggcttcccgcgcgtctgcctcgtggccgacgacgaggcccagggcgcgcagatcgtgatcctgcgcgacggctccctgcgggccggcagcttcatccggctcatcgacgccgcccatgacggcgtgccgctcgaactcgacgccgagggcgtggcctacgcggacggcgccttctacgtgatcggctcgcacggccgcccgcggcgcgcggccggcaagccggaggccggcacggtggcgcgggccgaggcgacgcggcacctgttccggatccgcttcgatccgtccgcggtcgatcccgagaccggcgtgctcgcgggcaagccggagatcgccgagatgggtgcgctggcgcggctgatccgcgaggatccggtgctcaagctgttccatgatcggccgctggaggagggcggcgtgaccgtcgagggcgtggcggtgcgggacggccggctgcatgtcggcttccgcgggcccgtcctccagggcggcgacgccgtgatgctctccgtttcgctcgacggcctgttcgggggcgagcctagtgcggcgacggtcacccgcttggcgctcggccgcgacagtcacggcactgcgcgcggcgtgcgcgacctcgccgccgtaccggagggcttcctgattctggccggccccatgctcgatccgaagggcgacggcgtcgagcccggcgactacgcgatcttccgctggaccggcacggacgcgcccgtgcaggcgctcgccctcgacggctacgggcggaaggtgaagcccgaggcgctgctgccgctcgaccggacgggggaccgcctgcgcgccctggtgctgttcgacggacccaaggagggcgcgccgcggacggtcgagatcccgctgcgctga

SEQ ID NO: 7478 - DNA, 936 bp, Methylobacterium sp.
atgaccctgacgattctcgcggcgctcgtgccgatcgcgctcctgatcggcctcggcgccgccctgcgccgcaggggctttctggcgccggccttctggccccaggcggagcggctcgcctactacgtcttgctgccgagcctgctcgtgcacggtctcgccaccgcgcggctcgatggcgtgccggtgctcgaactcgctgccgtgctggtgctctcgacggcctgcgtcgctatggtgctcgtcgcggcgcgcccgctgtttcggctggacggggcggccttcacctcggtgttccagggcggcatccgcttcaacaactacgtcggcgtctcggctgcggcggggctctacggggtgcagggcgtggcgctcgcggcggtcgccaacgcggcgatcgtgccgaccgtcaacgtgctctgcatgctggtcttcgcccgctacggcacggccgagcgggcggcccccggcgtgatcctccggcagatcgccctcaacccgctggtgctgggcagcctcggcggcatcgtcctccagacggcgcacatgcccctgccgccgggcatcgagccggccctgaaggcgctgggtcaggcctcgctgccgctgggcctgctctgcgtcggggcggcgctcgatttcggcacggcgcgcgcctggatccggccggtggcggcggcctcgctcttcaagttcggactgatgccggtggcgaccgtgctggcctgcctcgcgctcgggctcaacggcccggcagcgatgaccgcgctgctgttccaggccctgccgacggcgtcctccgcctacatcatggcccggcaactcggcggcgacgccccgctgatggccggaatcaccgcaacgcagaccgtgctggccgccgccgtgctgccgctggtgatgatcggcctgggcgcgctcgccggcctgggctga

SEQ ID NO: 7479 - DNA, 438 bp, Methylobacterium sp.
ttggtcttcgtcgacacgaacgtcttcctctacgcccgcgacgaccgctatcccggcaagcagcaggcggcaggccattggctcgcgacgctcgcgcgccgcgacgccctcgtggtgagcccccaggtgatcggcgagatccacaacgccatcctgcgcggtaagatcgacatggacgcggaggcgatgcggctcatggcggtcgagctgcaggcgttctcgcacggcgcgaccgacctcgatctgatcacgcaggcctggacgatccggaaggagacggccttccagtggtgggacagcgtgatcctcgcctccgcgatccaggccggatgccgttacctgctctccgaggattaccagcacggccgcacggtccgcggcaccaccatcctcaaccccttcaccgtcggccccgaggccgtcatgaccgagcattag

SEQ ID NO: 7480 - DNA, 477 bp, Methylobacterium sp.
atggacctctcgacctggctcaacctcgtggcggtgccgctcgtggcgaagatctgcctcgtcggcatgttcccgccgagcgcgctcgacaaggtcgtgcactgggacgaggcgatggagcaggcgcgctccggccccctgccctttccggcgctcctcctcgcgctcggcatcgtggtcgagacggtcacacccgttctgatcgtgatcggctggtacgaccgcctcgccgccttcgtcctcatgggcttctgcgcggtcacggccgtgctgttccaccggttctgggaacatccgggcttctggtcgcggaacggcgagggccgtgcccatttctgggacttcctcaagaatttcggtctcgtgggaggcctgctgctcgtggtgatcggcgggagctacgcgccggcctccgaggtcgcgcgccacccgctctcctccggcccctacgcggccgaaactcccgccacgccctga

SEQ ID NO: 7481 - DNA, 654 bp, Methylobacterium sp.
atgtcgccgcagatgattgaccgcctgagccaggccttcttcgacacgctcttcatggtcggcgtctcggccgggatcgcggtgctcgccgggctgccgctcgcgctcttcctcgtcacctcgggccccggcggcatcttcccggcgccgcgggcgaaccgggtagtcggcacgctggtcaacggcttccgggcggtgcccttcatcgtgctcctggtggcgctgatcccgttcacccgcctcgtcgccggcaccacgatcggcgtctgggcggcgatcgtgccgctctcggtgagcgccaccccgttcttcgcgcggatcgccgaggtctcgctgcgcgaagtggatgcggggctgatcgaggccgcgcagtcgatcggctgccgacggcgccacatcctcctccacgtcctgctgcccgaggcgctgcccggcatcctcggcggcctcaccatcacggtcgtcacgatgatcggcgcctccgccatggcgggcgcggtcggcgcgggcggactcggggacgtcgccatccggtacggctaccagcgcttcgacaccaccgtgatgctgacggtgatcgcgatcctcatcgccctcgtctgcctggtgcagttcgcgggcgacaccgccgtgcgccggctgcgcgcccgctga

SEQ ID NO: 7482 - DNA, 1152 bp, Methylobacterium sp.
atggcaggcctcgccttcgacaatctccgcgacgcgggcgcctggatcgcgcgcggcgcctcccgtcgcgccgcgcaggacgcgcgtgccggccaggacgtccgccaggcgggcggccgaggcgccggaacggtgcggttcgagggggtcaccaagacctttcaggccgcctccggcgcggtgcgggcgctcgacggcatcgacctcgcgattcccgccggcgcgatcttcggcatcatcggccgctcgggtgccggcaagtcgagcctgctgcgcaccgtcaaccggctggaggagccgagcgccgggcgggtcttgatcgacggagagccgatcgggaccctggacacggccgggctcgtggctctgcgccgccgcatcggcatgatcttccagcacttcaacctgctcgcggccaagaccgtccggcagaacgtggcgctgccgctcagcgttgccggggtatcgcgggccgagatcgggcggcgggtggacgaggccttgcgcctcgtcggactcgagacgaaggcggaggcctacccgtcgcggctctcgggcgggcagaagcagcgggtcggcatcgcccgggccctcgtcagccgtccggagatcctgctctgcgacgaggcgacctcggcgctcgaccccgagacgacgctccagatcctgaccttgctccgcgacatcaaccggcgtctcgggatcacgatcgtactgatcacccacgagatgagcgtgatccgcgagatctgcaccgacgtggtggtgttggaacagggccgcgccgtcgagtccgggccggtctggcgggtcttcggggcgccggagcacccggcgacccgggcgctgctcgaaccgctgacccgcggcctgcccgatgatctggcggcccgcctgcggccgaaccccgccccgggcgccgaggccctgctgcggatcacctgctcgagtgcggcccccgacctctcggccctgacggaggccgccggcgcgccggtgcgtctgcttcaggccggcatcgagcggatccagggccgcgcggtcggccggatgctgatcgcggtcgccgggaccgaggcggcggagcgcctcgcggcgctcaatgacgggatcgccatcgagaggatcggctatgtcgccgcagatgattga

SEQ ID NO: 7483 - DNA, 879 bp, Methylobacterium sp.
atggcggccgatcccgcgccgggcccggggcccgacgccttcaccggtcctgccccgcggcgcttcatcgacctgccgggctttccccgcatcgcctgggcggaggccggctccgggccgcccctcgtcctcgtccacggcgccctggtgacgctcgacgacatgtggctcgggccgatggcggcgctcgcccgccatttccgggtcgtcgcgatcgaccggcccggccacggcgcgagcgggcacgggcggctcgcggacgcctcgctctggcggcaggccgacctcgtcctggcgctcgccgacgcgctcgggctggagcgaccggtcgtggccggccactccttcggcgcggcggtggcgatcgcctgcgggctcgcggcgccggagcggatccgcggcgtcgtggcgatctcgccgatcgcctttccggagccccggctggagcaggtgctgttcggcccccgcgccgtgcccttcgtcgggccgccgctctcgcgggggctcgccccgacggacgcgctgctgctgccgctgctctggcgggcgatgttcctgccccgcacgatgccggaggccttcgcgcgggacttcccgttcgatctcgccgggcggccggaccggctcgtcgcggacggcgagaacgccaacctgctctggaccgacctcgcccgcagcgccgcgctctatcccgcctgccgggcgccggtgcacatcctggccggcagcggcgacatcgtcaccaaccagaccctgcacgggcgcggcgccgccctgctgatcccgggcgcccgcctgcactggctgcggggcgaggggcatatgctgcaccatgcccggcaggacgtggtggcggaggccgcgctggcgctggcctga

SEQ ID NO: 7484 - DNA, 96 bp, Methylobacterium sp.
atcgtgccggtcgccatggaggagaagctgcgcttcgccatccgcgagggcggccgcaccgtcggcgccggcgtcgtcgccgccatcaccgagtaa

SEQ ID NO: 7485 - DNA, 96 bp, Methylobacterium sp.
atcgtgccggtcgccatggaggagaagctgcgcttcgccatccgcgagggcggtcgcaccgtcggcgccggcgtcgtcgccgccatcaccgagtag

SEQ ID NO: 7486 - DNA, 1566 bp, Methylobacterium sp.
atgcaggaccattacgacatcatcgtcatcggctccggtccgggtggcggctcgctgaccgcgcggctcgccgggaccggcaagcgcatcctgctcctggagcgcggggactatctgccgcgcagccaggacaactggaacgcccgcacggtgttcgtggagggcaagtaccaggctgccgagacgtggttcggcggcgacggccgcgccttccacccgggcctgcactactatgtcggcggcaactcgaaggtctacggcgcggccctgctgcgcctgcgcgagcgcgacttcgaggcggtgcggcacgtcgacggcgtctcgccggcctggccggtctcctacgcggagttcgagccctactacgcgcaggcggagacgctcttcgccgtccacggcaaccggggcgaggatccgaccgagccctgggcgagcggtccctacgaccatccggcggtgagccacgagccgcgcatccagaagctctcggacgactgggcgcggcacggcctgcaaccctaccacctgccgctcggcatcaagctcgacgagcgaaacgggcgtccgacgcccaccagcatctgcatccgctgcgacgccttcgacggcttcccctgcctcctcaacggcaaggccgacgcgcaggtgatgacggtggacccgacgcttgccgcccacgacaacgtcaccctcctcgtcaacgcctacgtgtcgcggctggagactgatccgtcgggcaagagcgtgacgggtgtgcgggtgacccgcgaggggcgggaggagcgctacagcgccgatatcgtggtggtggcctgcggggcgctctcctcggccctgctgttcctgcgctcggccagcgacgtgcacccgaacgggctcgccaacggctcggatcaggtcgggcgcaactacatgcgccacaatatgtcggtgctgatggcgctctcgaaggaggccaacgacaccgtcttccagaagaccctcgcgctctcggacttctacttcgagtcgaaggcgtgggaatacccgatgggcctgatccagatgtgcgccaagacccatccggaccagatccgcggcgaggagttcccgaaatggacgggcttcctgccggacgcgcccttcaacatggtggcgcgccattccatggacttctggctccagagcgaggacctgccgcacccggacaaccgggtcggcatcgaccccgacgggcgcacgatcctcgacatccgggagaacaaccgcgaggcgcacgaccgtctgagggccaagctctccgacctcttggagcccgccggcgcctacacctacctgttcgagcgctcgctctatctcggcaagaacatcccgctgagcggtacggcgcatcaggccggcaccctgcgcttcggcacggatccgcgctccagcgtgctcgatctcgactgcaaggcccacgaactcgacaacctctacgtcaccgacgcgagcttcttcccctcgatcggcgccgtgaacccgacgctgaccatcgtcgccaacgccctcagggtggccgaccgcatcgccgagcggatcggctga

SEQ ID NO: 7487 - DNA, 888 bp, Methylobacterium sp.
atgttcgatttcagccagctgcgctgcttcgtggcggtcgccgaggagctgcatttcggccgggccgccgcccggctgaacatgacgcagccgcccctctcccggcagatccaggtgctggagcgcgtcctcgacgcgcagctcctcgaccggacgagccgctccgtgcgcctcaccgcggcgggccgaagcttcctgcccgaggcgcagcggatcctcaggctcgccgagaccgccgcgcacgtcacccggcaggtggcgacggggcgggcgggcgtgctgaagctcggcttcacggcggcctccgcctacgatttcctgccccgcctcgtcaccgcctgccgggcgagcctgccggacgtcacgctctccttgcgcgagatggtgacgaaggatcagctcgagggcctgctcgccggccagctcgacgcggccctggtgcgcccgatggtgacgcatcccgacctggagaccgcgcgcgcgctggccgagccgctggtcgccgcggtgccggcggagcacgcgctggcggaccggtccgccctgaggccggaggatttccgcggtgcggccttcattacctacgcgccgcacgaggcgcgctacttccacgacctcgtggcggggctcttcgccgaggccggcgtgcagccgcgcgtgctgcagcagctcacgcagatccactcgatcctcgcgctggtgcgggcggggatcggcctcgccctcgtcccggcggcggccgagcgcctgcgcttcgagggcgtggccttccggcccctcgtcctgccgcgggcgcacccggccgagctgatgctgacctggcggcgcgaccacgacaacccgctggtcgacgccctgcgggggatcgtggacgacctcgtgcactga

SEQ ID NO: 7488 - DNA, 687 bp, Methylobacterium sp.
gtgcagacccctccgcagacgacgatcctctcgtcggccaccgcgtcccgcgtcgccggggccctggccgatctcggcgccgtgcgcctcgcggccgggcagcccttcatctacacctcgggctgggcgagcccggtctacgtcgacacgcgcctgctgatgtcggacgtggaggcgcgaacccgcgtgatggacagcgcggcccggcacctgcgcgagcgcgtcaccggcctcgacgccatcgtgggggccgagagcaccggcatcgccttcggggcctggatcgccgagcgcctcggcctgcccttcctgtacctgcgcaagaagccgatgggctggggcagcgcggcccggctggaggggcacctgccccccggcgcccgcgtgctcttcgtcgacgacgtcaccaccgacggccgctcgaagatcgcggcggcggcagccctccgggagagcggcacgcgggtcgccgacgtgctggtggtcctcgattacggcatctatccgggcagcgcggcgcgcctcgcggacgagggtctgacgctgcacgcgctgaccgactggccggccctcctcgccgccctgcggggccgggcggcggcaccgcccgaagccctcgcgaatctcgatgccttcacggccgatccggtggcgtggtcggtcgccaacggcggagtcggcgcgtga

SEQ ID NO: 7489 - DNA, 351 bp, Methylobacterium sp.
atgacgatgatccccgctgatccgacgttcagcgctggagatctgatcctggtcgaattcgggcccgtccgcggaacggagcaggatgggcggcgtccggcgctggtcgtgtcggaagcgatcatgaacacggccacccgacgcgtcatcgtctgcccgatcacaagcaacaccgagccctggccgacgaaggtcatgctgccggccggtctccgtgtcggtggcgccgtcctgacggatcaggttcgttcaatcgaccaacgtgcccgcattctccggcggttgggcacggcaccggacacggtgctcgcggaagtccgccaccagatcgcgaaactgaccggcctctga

SEQ ID NO: 7490 - DNA, 210 bp, Methylobacterium sp.
atgacgggtgagttcgacctctacggcgtctacgtcccaagcctcgccgcctggatgttgatcgccttcgccatcggcctgccgatcaggcgggcgctcgccgggctcggcctctaccggctggtctggcaccgaccgctcttcgacctcgccctctacgtgctgcttctcggtgccgtcgtcgcggtcgcggtgccgctcacctcgtga

SEQ ID NO: 7491 - DNA, 933 bp, Methylobacterium sp.
atgccccggctcctcgcgctcacattccgtcttctcgtcaccctcgcgatggtggtcgccgccgtcgtcgtcggtctcgcgctgtgggactactacatggaggcgccttggacccgggacggccgggtgcgcgcggacgtggtgccggtagcgcccgacgtctcaggcctcgtcgccgaggttctggtcgaggacaaccaagtggtgcgccggggcgacgtcctgttccggatcgaccccgatcgcttcgcgctggccctgcggcaggcggaggcggtggtggagggcaagcgggccagtgccgagcaggccgcggccgactacgtccgctacacgaagctcagcgacgccgcggtgtcccagcagaaggtcgaggcggcacgggcggcgaacctggaggcgagggcggcctacgaccaggcgtcggcggaccgggatctcgccaagctcaacctcacccgctccaccgtgcaggcctcggtgaacgggcggatcaccaacatggagcttcggcccggcgcctacgtcaccaccggccgcggcgtgatggcgctgatcgacagcgataccctgcgggtcgagggctacttcgaggagacgaagctgccgcgcatccatgtcggcgaccgggcgagcgtccggctgatgggcgagaccgtgacgctggccggccgggtcgagagcttcgcgggcggcatcgaggaccgggagcgcacggcgggctccaacctgctcgccaacgtcaacccgaccttcgcctgggtccggctcgcccagcgcgtaccggtccggatcgccctcgatccggcgcccgagggcgtgcgcctcgtctccggccgcacagcgacggtcgcggtggagccgggcgggtcggctccgggcttcgacccgctgcgcctgctgcgcggcgcgtcggcgaccgcaccacggtag

SEQ ID NO: 7492 - DNA, 255 bp, Methylobacterium sp.
atgccccgctacttcttcaacgtccggcatcggcctggacccaacggtctggccgaggaccatgagggcgacgagcttgcggacgtggccgccgcgcgcgagcatgccctctcggtagcacgggacatgatcgcccgagcccgccacgtgatgatccgtgactggatggtctgctccttcgagatcctggacgaggatggccagcacgtgctgacggtgccgttcagcgacactgtttcagaggacgaggactga

SEQ ID NO: 7493 - DNA, 501 bp, Methylobacterium sp.
gtggcagcgagggatctgcgccagatccggcgggcttatacacagacgctcctgctggcaggacggcgctggcgccggctcgccgacatggccgcggaggcccacgggatctcggaggcgaaggcgttgcccctggtgctgatcgcccggatggggggcgcgccccggcagaacgccttggccgaggcgctgggcatcgaaggtccctcgctggtgcgcctcctcgatcagctctgcatggcggatctggtccggcgccgggaggatgcgaccgaccggcgcgcgaaggtgctgagcctgacgccggccggcgaggccgtcgtcgccaggatcgaggccgatctcgaccgtctgcgcgaggcggtgttcgcgggggtcagcgcggccgatctcgaagcgggcctgcgggtgttcgcggccgtccaggcgacggtccgcggccaggaggacggtcggcaggacgcgacggcggatcggatatcggacggggcagcgggatga

SEQ ID NO: 7494 - DNA, 981 bp, Methylobacterium sp.
atgaccctgttccgcgcgctcatcggctgcgccgccgcgaccgcctgcctcatgggcgccgcccgcgccgaggagaccgatcccggcgccatcgtggccgcccagttcgcggccggcggcaaccacacgggcgtgcgcgccagcggcgccaagggcgtctgcctgaagggcgcgttcgcccccgcccccggcgccgccgcgctctccaaggcgccgcatttcggcaagaccgtaccggtcaccgcccgcttctcgatgggcggcagcaacccgaaggtctccgacaaggccaagcccgtcacccgcggcttcgcgatgcggatggaggatccggccggcgacatggtgttcgtggtgatctcggcgccggtcttctcgacgaagaccccggcccagctcctcgaattcctgcaggtccgcgcccccgggccggacggcaagccggacgcggagaagatcaaggccttctcggcccggaaccccgagaccacccgtcaggcggcgtggctcaacgcccggccggtgccggcgagctacgcgggcgtcgattactgggcggtgcacgcctacacgctgacgaacgccaagggcgaggcgaaggtcgccaagctcaaattcgtctccgccgacaagaccggcctctcggacgacgagctcaaggccaagcccgacagcttctacgcggacgagctgaaggagcgcctcgccaagcgcccggcccgcttcgacctcgtggcgatcctctccgagcccggcgacccgaccgcggacccgaccgcctcctggccggaggagaaccgcaaggcggagacgctcggcaccttgagcatcacggcgatcgcgcccgacgccgcctgcgacgcccgcaccttcgatccggtggcggagctgcccgagggcgtcgccggtccgaccgacgacccgatgttcgccatccgctcgccggcctacgcggtctcggtctcgcgccgggcgaactga

SEQ ID NO: 7495 - DNA, 801 bp, Methylobacterium sp.
atgcgagttccgagactgatcgccgtcgccgccctggtgctcggcgcgttcgccgcgcgggcggagagcctgacggtcggcgtggtgccgggcgcctacgcggacgcggtcaacgtcgcggcgcaggaggccaaggcgaaggggctcgacgtgaaggtggtcgagttcagcgactggaccacgccgaacgtcgcgttggacgccggcgacatcgacgtgaacttcttccagcaccgccccttcatggagaatgccgagcggcagaagggctacgatttcgagatcgtcggcgccgggattctgcagaatctcggcctctactccctgaagcacaggagtctcgaccagatcccggtgggcgggcgcgtcgccatcgccaacgatccggtgaaccagggccgcggcctgctgctgctgcagaaggccgggctgatcaagatgaaggacggcgtcggcttcctggggaccctcgacgacatcgccgagaacccgcggaagctgaaattcaccgaggtcgagggcccacagctcgtccgcatcaccggcgacgtcgatctcgcgcaaggctacccgcacttcatcgtcgcggccaaggccttcgatccgaagagcggcctgatctactccggcatcgaggacaagcttttcgcggtaagcttcgtcacgaaggccaagcgcaaggatgatccgacgatcgccaagttcgtcgccctgttccagaaatcagaggccgtgaaggcccagatccacaagtccttcgccgacagcgacaagctctacctgctggcgtggctgaactga

SEQ ID NO: 7496 - DNA, 1908 bp, Methylobacterium sp.
ttgccccgcacccacctccgccgtcgccgacaaacggtcttttttcgccgtatcatcccccacgacctgcgccagcggttcggccagcgtgagatcctgcgctcgctcggtcaggccacgccgggcgaggcccgacgcatggcgcaacgcttgtgggatgggacggagaccttgttcacgcttgtccgcttcaaccggtcgctcacgcgtgccgacatcgtccggctcgcggagcagtacctcgaatccgagtccttcaagcacgacggcctgatcgcgaccatcgggcattatccggaactcgaggatctccctccttccgaaagcgcggcctccgaagacgacatcggcgacagcagcgctcccgccaagggcgatccgaaggggaccctcaatgacccagcccaatgggtaagcctctataagatccgattgaaaggcctgaagcgcgatcggtccctcaacaattttatctccgttcgcgacactgcaaaggatctcgctgcaagcaatgagatcgacctcgactcatacccccacgcaaacgcgctttgccgcgcattgctcgacgctgacatcacgatcacccaggagaagctgacctatctgcgcgacgtcgtcctgccccaccaccccctgcacaaggcgactcgtcgtaggagcacgcccgctccgatctcagagcccaagacgccagcccccacaatgctgcgcggagctcggcaactgttcagcgagagttgggagacctacggtcgggatcgcgtcgcaagcggcgattggaaggcgtcgatcgaacgccaagcccgatccaccgcgcggttgttcgtcgagatctgtggggacaaaccgctcggtgactacggaccggcggatgccgcggagttcaagcgcgctctgctcgcactgccggccaactacgacaagagcaccgaatggcgcaccatccagcgccgaagcggcattcgcggcctgatcgagcattgcaaaggcaagcccggcattgaccgactgaagccgcagaccttcaaccggcatctcgcggccttgtcggggatctggccgtgggctcaggccaacgaggtcgtcgccagaggcctgccgtcgatcttcgacgggcttcacgtcaacctgaggcgcatcagagggcggcatcaccaggcccgcgatgagcggccgatgtgggatcatgccgaactcgccgccgtgctcagcgcgcccttgtttaccgggatccgaagccgccggagctggaagacggtaggcccgtacgtcccgcgcgacgaacggtactggggcatcctcatcggctgtcacagcggcatgcgccgtggcgagattttccagctccgcgtgcggcacgtggttcaggatgccgagaccgggatctggcacttcaatctgcgggagaagaccctcgagctgaaagcggagggcagtgcccggtgggtgcccctccatcagaatctgctgagactgggtttgatcgaagcgctggtgcagggccgacgggaaaacgatctgctgttgcctgaaggcgaggccggcgtcgaggaagcggatgatctcgacgatggcgacgacgcggcatacggcagcgccttcgggaagtggttccagcgcttcaagtcggagtacggcgtgcgcaaggatgtggtgttccactcgttccgacactcggtgacaactctcctctgcaatgccggggttcagcaagagttcgttgaagagctgatcgggcacgagagccaggcgagacgctccgagatgaagcgttacaacaagggccagaccttgatgatgctcaaggacgtaatcgatcgtctcgttctgccgatcgacatcgagaggatggtcgacgcggcgcgcggcggtgagcctcgtccggcattccggccgcgccggtag

SEQ ID NO: 7497 - DNA, 759 bp, Methylobacterium sp.
gtggcctcaatcgcgaacgtcgtcctcagggggcggagcttccacttccgacgacgcgtgccggacggccttcggccggggccgcggctcgacgagctggtgcgcagtctcgcgacgtccgagacgcgcactgccaggctgcgggcctggcagctatatctcgcctcgaagagactgttcacggcctttcgcgcgacgccgatgctgaccgacgatcggatcgcccacctcgttcgagactgctgcgacctcatcctgatggacgagaacgccggccgactgatccgtggaccactgcccgcgggcgtgcgcggggcccgcgtcacgcgggcggccacgatgcccggcagaggtcgggatgcgctcgcccgcaaccgcctcgacgaggcggccttcaccgccgagatgatgctgaaacgtcagggtatcgtcttcggggacttggcgcccgcggaagcggccagggccaagcagctgttcctgacggcctacactcaagccttcagcaggatcgcgtcgactgcgctgcctatgcgcacgagccatgcttctgcctgctcggctcgctgctgcgccgcctgtactcgctcttccgcagctcgaacacggtgctcggctgccgagaggagtgcctcggttctcgcttcgctagcgcgcgcctggtctcgaagctggttgatctcggcacggagttcgttcacctgccgatcgtgcgccgaagcttgggctgcgagccgccgctcgcggtcttgggcctga

SEQ ID NO: 7498 - DNA, 441 bp, Methylobacterium sp.
atggcccgtgcctacagccacgatctgcgtattcgcgtcctggacgcggtgggcgcgggtctgtcccgccgggccgcggccctgcgctatcgggtcggcatcgccaccgtgatccgctgggcggcgcacgcaaccacgacgggagagacgcgggctcagcgtcaggggcgcccactcggctccaagctcgacgcgcacgaagccttcctgctcgcccttaccgaagagaaggacgacatcacgctcaccgagatgcaggagcgcctgcgggccgagcgcagcgtatcggccggactgggcacgctctggcgcttcttcgcccgccgggcggtgacgtggaaaaaaagtcagcgcacgcggccgagcaggctcgcccggacgtggccgcagcccgcgaggcgtggtttgcgggccagcccgacctcgatcccgagcgcctga

SEQ ID NO: 7499 - DNA, 714 bp, Methylobacterium sp.
atgagcgcgggcgcggctctgcgtctcgacgacgtccacggcttctacggcaagagccacatcctccagggggtcagcctcgaggtgcgcccgggcgagatcgtctgcctgctcggccgcaacggcgcgggcaagacctcgaccctgcgcagcgccagcggcctgctgccgccgcggcgcggccgggtgaccttcgggggcgccgagatcaccggctgggcgccccaccgcatcgcccgggccggcctcagcctcgtgccggagaaccgcggcatcttcggcctgctgaccgtcgaggagaacctccgcatcgcggtgcggaaaggctcgccctggtcgctccccgacgtctaccggatcttcccgcgcctcaaggagcggcggcgcaacggcggcgcccagctctcgggcggcgagcagcagatgctctcgatcggccgggccctcctcaacggcccgaagctcctgatgctcgacgagccggtcgaggggctcgctccggtcatcgtggaggagatcgtggcccagatccgcctgatccgggacgcgggcgtgccgatcctgctggtcgagcagaacctcgcggtctgcaccagcctcgccgaccggcactacatcctcgaactcggccggatcgcctaccacgccaacgggccggacttcgtgcgggacgaggcggcgcgcgaccgcttcctcggcgtgaaggctcactga

SEQ ID NO: 7500 - DNA, 468 bp, Methylobacterium sp.
atgaacgccatcccgttcgacaccctgaagttcgtccgcgccctgcgagacaaggccaagctcccgcccgaacaggcggagggctttgccgaggccatcgccgaggccgtgcagagcgatctggcgacgaaggccgaccttcaggcaacccgggccgatctgaagtccgaacttcaggccgtccggacggaactgaagaccgagatccagaccgtccggacggaactgaagaccgagatccagatcgttcggacggaactgaagaccgagatccagatcgttcggacggagatccgggagacggagcttcggctggaagcgaagatcgagtccgtgaaggccgacaccaaggcgcagatcgaagcctcgaaggccgagatcctgaagtggatgttcggcaccgtgggcttccagacgatcctgatcctcggtgccgtcgccgccctcgcgcgcttcgccagaccctga

SEQ ID NO: 7501 - DNA, 1125 bp, Methylobacterium sp.
atggagagcgacgacgccgtctcgcagctggtcgacagcttctacgaggccgccctgcggccggagctgtggcgcccgaccctcgagaccgccgcgcgggtcttcggcgccgagggcgcgctgatgctgccgggacccgacgcgccgctggaactcgcctgcaaccccttcctcgacgcggccatcgcggacgggctcgaccagggctggctcgcccacaacccgcgggtgctgcgcggcatcccggcgatgcgcgaccccgcgcgggtgctcaccgagcagcacatcttctcgccccgcgagctcgaccacctgcccttccacgccgagtacgtgaacgcccacggcctgcgccacttcgcggggtgctacctcgtgcccgcgggcgggcgcagcctgatcctgtcgctggagcgcgccccccgcagcggcgccttcacgcccgccgagatcgaggcggtggagcgggtggtgccccacctccagcgggcggggcgcctcgcgctgcggatcgcggaggcgcgggcgggctcggcgctggaggcgttcgacctcctgcgctgcgcgggcctgctcctcgacggggcgggcgcggtgctgcggatgaacgggcgcgccgccgccctgatgggggcgggcctcaacgtgctgcagggggcgctgatcgcccagcacgggccgagcaacgccgcgctcgggcggctgatcggcggcgtggtcggcccccggcgggggagcctggggccggtctgccgcccggtggcggtgccccggcccgcggggcgggagggcgccccgcccccgctcgtcgtgcacgccgcgccgctccccggcgcggccggcgacctgttccagcaggcccgcgcggtgctgctgatcgtcgatccggccgaggcgcacccgcccgccgaggggttgctgcgcgagctctacgggctgaccgccgcggaggggcgcctcgcccggatgctcgccgacgggcgcgatctcggcgaggcggcggacgggctcggcgtggcggtgagcaccgcgcgcacgcagctcaaggccgtcttcgccaagaccggcacgcgccgccaggcccagctcgcggtgctgctcgccggcctcggacgcgggccgtga

SEQ ID NO: 7502 - DNA, 450 bp, Methylobacterium sp.
atgtccgagcccacccccccgaccatgccctactggcacgtctataccgacgacgcgggcgtgagccgccaggagcggttcgaactcacggcgttccagttccagggcgtcggtccgggcgtcgcgccgcagtggaacgacaagatggatccggcgaaggccggggtgaccttcacggtgctgccggtcggctgggtcggcgactggcacgagaaccccaagccgcagtggatcgcggtcctgaccggccgctggttcgtcgagacgatggacggcaagcgggtcgagatgggcccgggcgagctgatgttcggcgaggaccagaacacgcgcgcgcgcgacggaaggaaaggccatctctcgggcacggtgggcgacgagccctgcacgatgatcgtcaccgggctcgacgtggaaccgacggtgaaccggccgggccgcttcaggtag

SEQ ID NO: 7503 - DNA, 696 bp, Methylobacterium sp.
atgagcgcgacggctgtgcagggttactggcaggattactggctcggctggcaggaggatctcctgacctacggtcccggcttcctctccgcgaccctcctggtgctcggcgtcacggtggcgagcatcctgctgagctgggtctgcggcctgctcggggcgctgggcaagcgctcgcatctcccgcccttccgggccctggcgaacttctacgtctggttcatccgcggcacgccgaccctcgtgcaggtgttcatcgtctatttcggcatgccgcagatcggggtgaagctctcgccggtcgcggcgggcatcatcgcgctcggcgtcagcagcggcgcctacgtcgccgagaccatccgcgccggcctcgcggcgatcccgcgcgggcagaccgagtcggcgctcgcgctgggcatggcgccccgcatcatgatgatgcgcatcgtgctgccgcaggtcttccgcatgatcctgccctcgctcaccaacgaggccatctcgacggtgaagaacacctcgctcctgtccacgatcacggtcgtcgagctgacgctctacgcccagctcatgatcgccacgaccttccggccgttcgacttctacatcgcggcggcgctgatctacctctgcctcacctcggtcctgtcgcagctctcggccttcttcgagcggcgctacgcccgcctctcctga

SEQ ID NO: 7504 - DNA, 657 bp, Methylobacterium sp.
atgtcgttcgatttcctgagcatcctcgcccagtggccgctcctcctgcggggcgccgcctggacgatcggcctcaccgcgctggcgaccctgtttggcgcgacgctcgccgtcgcgggcgcctgggcgcgcagccaagggccccggccgctcggctggctcgtcggcgcctatgtcgagctgatccgcaacacgcccttcatcgtgcagctcttcttcatcttcttcggcctgccggaactcggcatccggctctccccgggcgtcgcgtcggtctgcgcgatgacgatcaatctcggcgcctacgccaccgagatcctgcgggccggcatcgaggcgacgccccggggacagatcgaggcggcccagagcctcgccctgtcgcgagcacagatcttcctgcacgtcgtgctgccgccggccctcaagaccgtctggcccgccctcgtcagccagatcgtcatcgtgatgctgggctcggcggtctgtagccagatctcgaccgaggagctgagctacgccaccaacctgatccagagccggaacttccgcgccttcgaggcctacatcgtcggcacgctgggctatctcggcctcgcgatcctcctgcgccacctcctcaactgggcgggaccccgcttcctgttcgggcgctag

SEQ ID NO: 7505 - DNA, 393 bp, Methylobacterium sp.
atgccgttcgatctatccagtctcatctacgtcgtcgacgacgacctggccgtcctgcactccacccgcttcctgcttgagagcgagggacaccaggttgagaccttctgcggcggtccagaattgttggcggccttccccggtccgagcccgaccttcgtgctgctcgaccaagtcatgccggtgatggatgggctggaggtgtacgtccggctccgggagatcgatgccaatgtcccggtggttctcatcaccggtcatcccgatccgggcatccggacacgggctcgcgccgcaggcgtccccatggtcgagaaaccgctcgcattcgacgcgctgcgcggcctgctcgctggcgagatggccgtaccggggtctacccttcaggcttga

SEQ ID NO: 7506 - DNA, 861 bp, Methylobacterium sp.
atgttcctgcgctgcctcctcgtcccaaccgcgcccggcctcgacgccacgcgccggctcgacgcagccttgcgcctgggacggcgcctgcaggcccatatcggcgtcgcgttcatagcgccggggccggagcacgtcatggccagcatggcgagcttggtccccatggactgcgcgaccgtcgaggccatcgagcggggcgtgcgcgaggccgcggccgagggcaaggcggcgctccaggcttggtgcgagcgcgagggagtggcgttcatgccgacgggcggtcgactcgacgccaccttcgcgacctggaccgagctctctggcgaggtcgagccgctgttgacgcttgccggccgggtcaacgatctggtcatcgtcgaccgccggaacccggatgagcccttcaccggccgcgcgctcgacacggcgctgttctcgatcgggcgtccgacgctcatggtcggcgagagcgtaccctacgacctgctcgaccatgtcatggttgcctggaacggcagcctggaggcaacgcgcttgatcggccagtccataacactgctgcacgaggccgcccgggtcacggtggttcatgcgcggaccgagcgcttcgaggaggcgcgtgcggctgacctctgcgcctacctgcgctggcacggcatcgtggcggagagcgccacgctacaggtcgagggcgggacctcagttggcgccgccatcctggccgaggtcgagcggcggagcgcctcgatgctggcgctgggcgcctacacccacagccgcgtgcgcgagctcctcctcggaggtgttacccgtcacgtgttcgagcatgcccgcatcccggtgctgatggcccactga

SEQ ID NO: 7507 - DNA, 1677 bp, Methylobacterium sp.
atggactcgcccccgctcttcgacagcctcctcgacccgcaagccggcggcttcttccaggtcgaggcagagggtgccaaggtcatcgagcggcgctaccgccaggacagcaacgtactcgataccgtgctggcctcgggcgcgggtcgggcgcgtctgaccgagtcgctcaacagttccaccgccggccgcctgccctggtgcgagttcgcccgccgcatcgaggtcctgtcgggtacgatgacgttccgcgtccgcgcagtgttcggcacgcgcggcgacacggcctcgccctggcttcagccgaacccgaacggctgcgtcttccacgtcgggccggtgctcgggctgttccggtgcagcgacaacgtccgggtcaccgaggaggatgaccgcaccatcgccgccaccgtgaccctcgccgagggcgagcgcgcgaccgtggcgctgctcgcgggtgaggacgagccgctcggagtgccgacgatggaggagatcgaccatcgcatcgatgtcagcgacgaggcttggcggcgctgggccgaagggctgcgctacgacggcccgcaccgcgacgaggtccgccgcagcgcgctcgcgctgaagctcctcctctactcgccgagcggcgccatcgccgcggcagccacgacgtccctgcccgagggcatcggcggggagaagaattacgattaccgctacgcctggatccgggatgcaggttactcggtgaacgccttcctgcgggtcggcgcgatgccggaggccaaggcggctttctcctggctgatgaagcgcctcgaccggcacggtcctcgggtgctctacaccctgtgcggcgaggtcggaccggacgagcgggccctggagctgccgggttaccgcgcctcgcgcccggtcctggtcggcaacgccgcggctctacagcaccagcacggcatctacggcgacatcttcgagacggcggccctgttcgtggccgatggcaacatcctcgaccaaagaagcgccaccgtgctgtcggcgctcgccgaccaagccgccgaccgctggcgccagaaggatgccggcatctgggagctgcgagagcctcagcactacacgatgtcgaagatcagcgcctggcaggggctcgcacgcgccgtcgagcttgccgaggccggacacctgcccccgacctgcgtgccgcgctggacgcgcgagcgcgaccgcatcgcggcctggatcgaggaacattgctggtccgaagcacgcaaggccttcgtgctccatcctggcaccgagcggctcgacgcgtcgctggcgctggccgtccgcttcggcttcgacggccgggacaggctgtcctcgacgctcgacgcgatccgcgaggagctcggacgcgggcccttcctctaccgttactccggggccgagcgggaggaaggcgcgttcctggcctgctcgttctggctggcggaggcgctggcagagctcgggcggcaggaggaggcagagcaggtcttcaccgacacgatccgtgctctgcctgcaggggtcggcatcctgagcgagatggtcgacctgaggaccggtgacttcctcggcaacacgccgcagggtctcagtcacctcgccctgatccatgccgcctgcacgctgcgcggcgaccggacccgccctgtcagagcggcctga

SEQ ID NO: 7508 - DNA, 288 bp, Methylobacterium sp.
atgagcaacgtcgtccgcttcccccacggccgccgcatcccggcggccaccatccctcgcgaagagttcgagcggctggccgatctcgccctcgacgtggtcgatcggatcgtggcgatcctggatcaggctgacggcgatcctgatgctgaggacggcggcgatgccgaaccgtcgctcggcgctccggaagatcatgcctctcagatcggctggctgcgcggcaccggcagagacctggagctcgacctcagcccctgccctgccccggcagccgaccgctcataa

SEQ ID NO: 7509 - DNA, 243 bp, Methylobacterium sp.
atggcccgtttcttcatcgacctgcacgacggcgcgaatttcgtgcgcgacggcatcggcttcgacctcgcggacgaggcggagcttcgcgccaagctggtccgcatcatggcgaagatcgcgcagggcctcgcgccggggcccgaccgccaggactacctggcggtggtccggaacgaccggcgggaggtcatcctgcgggcgcatctctcgctcgacatcgagcgggtcgatacgccctga

SEQ ID NO: 7510 - DNA, 237 bp, Methylobacterium sp.
atgccccgctacttcatcgacctgcacgacggggcccagccggtgcgcgacgaggtcggcttcgacctgcccgatctcgatgcggcccgcggcaaggtcacccgcatcatgtcggcgatcgtgcgcgacatgctgccggacgtggagcgccaggactacgtcgcctgcgtgcgcgacgtcgccggtgcggtggtctaccgggcgcggctgtcgctcgcggtcgaggccgcggagtag

SEQ ID NO: 7511 - DNA, 1983 bp, Methylobacterium sp.
gtggcgtgggtcgaggctcgcaacgccgagacgctcgcccgctacgccgacgccgccttcgcccgcgatcgcgacattgctcagggcctgctcgatcggcccgaccgcatcccgcacgcccagcggtatggccggcacctctacaatttctggaaggatgccgaccacccgcgcggcctgtggcggcgtatcgacgaggccggctatcgggccggatcttcggactggacctgcgtgctcgaccttgatgccctggccgcggcggaggacgaagactggatctgggccggcgcgacgatcctgcccggcacccacgatcgcgccctgctgaggctgagccgaggcggcagcgacgctgtcgtgctgcgcgagttcgacctcgtaaatctggcctttgtacccaacggcttcgtgctgcccgaggccaagagcagcgccgcttggctcgaccgcgacacgctgctcctgtcgagcgcgctcggggccgggatggcgacgcgctcgggctatgcccggacggtgaggctgtggccgcgcggggcggacccgcagcacctcgccgtgctgttcgagacggcccccgagcacatggccgtgtggggctcggtcgaccggtcggacgggaccgaacgggtcgtcgtcgcggagcacaccggcttcttcgacgccgaggtccacatcggcgatcgccagggcgcgttccggcgcctcgacctgcccgcggatgccggtgttcagcttcatcgcgggcggctgtcggtgcgcctgcgccggccctgggcaccggacgggacggtgcacgtcgccgacacggtcctcaccatcccactcgccgagttcctggccggcagccgcgacttcaccatgctgtgggtgcccgatgcgcgcagcgccctgcagcacgtgttctggtcggccgggcgcctgttcatccacgccctcgacgacctgcgcccgacctacaccttctgcgagtcgcgggcggacgggtggtccacgcgtcccctcggcgggctgcccgttctgggcagcgcgagcgtctggccgctcgacggggaccccgaggcggcggacggcgcgcttctggcccaggtcgaggacccgctgcagccgcccacgctgctcgccttcgcgccggagctgggcgccccgaccgtgctgcgcgcaacgccggcagccttcgacgcgcggggcctgcgcatcacgcgccacgacgcggtatcgtcggacggcacgcgcattccctacatccaggtcgggccctccaccacgaccggcgacgcccccgtgcacctcacagcctatggcggcttccgggtctcgctgctgccaacctatcaggcggtgctgggcaagctctggctcgagcgcggcggcacgagcgtggtcgtcaacatccgcgggggcggcgagttcggcacgcgctggcatgaggccgggcgccgcgagggcaagattctggcccacgacgacttcgccgcggtggcagccgacctcgtcgcgcggggcgtgacgcggccggggcggatcgcggcgcagggcggctcgaacggcggtctgctgatcgccaacatgctgacgcgctatcccgaacggttcggggcgctgttctgcaccatcccgctgatcgacatgcgccgctacgccaagctcctggcgggtgcgagctggatcgccgagtacggcgacccggataagcccgaggattggtccttcctcgccactctgtcggcctaccacgcggcggagaccgggcggccctactcgccgatcctgctggcgaccagccggcgcgacgaccgcgtgcaccctggccacgcgcgcaagatggccgagaaactgcgggtgctgggctacaacgctgccttctacgagccggcgacgggcggccatggcgcgggcaagaacagcgcggagatggccacgttcctcgcgctgggccttgccttcctgcgccgctccatcggttgggacgaaacctga

SEQ ID NO: 7512 - DNA, 771 bp, Methylobacterium sp.
atgagcggcctcgatttcgaccgcctgcgcgacgcccatatcgcggccctcaccggcgggttgctggacggtgtcgagaccggtccggacggggccggctacgtctggtcgcgcgcgatcccggatccgaccctcaacttcgccttcggggtgcgcacggcggctcaattcacctgggcgggggcggtcgcgctcggacgcgggcgcccgcccgccttcctggcccgcgacgcggcggaggaagcgggcctgcgcatcctgttcgagccggccgcaatcttccccgcctgctggatggtggcgcgggcctgtgccgggccgcgcctgcccgagtcgcttcgcctcgtggagcacgagggcccgcgccccccggccgccttcgaggcggtgttcctgcgcctctcggaggacgagcgcgtgcgcgcgcacctgcgccgccactacctgccggtgctgcgcgcggcacggtgccggtcggggacggcagcgctccacctcgtcctggaggacgccgacggtcccgttgcctgcgcgagcctctatctgcgcgccgggctcgccggactctacaacgtgagcacccgggcagaccggcaggggcgggggctcggcggacggatgagtgcggcggccctcggcgtcgcccatcggcacggcgcgcgcgaggtcttcctccaatgcccggccggcggctccatcgagcggctctacgcgcgcgcgggcttcgaggccagatgtctgccggctctgatctgtacgagcttaccttga

SEQ ID NO: 7513 - DNA, 1254 bp, Methylobacterium sp.
atgacccgacgcctcgccctcgccgcgctcgcgctcctgccgctgacggccgcgccgctcgccgccgcggagccggacccgaccgtgctcgccgccgtgaaggcgcaggaccgcccgctgcgcgcgacgctcgccgagatcgtcaatgtcgataccggcacgggacaggtgccgggcctcaacacggtcgaggcgatcctgcgcaagcgcctggaggccgtcggcgcgaccgtcgaggcgcgccccgccccggccttcggcggcaataccctgatcggccggatcaaggggtcgggcacggccaagctgatgctgctcgtgcactacgacaccgtctacggcgagggcgaggccgccaagcgcccctacacggagcgggatgggcgcgcctacgggccgggcgtggccgacgccaaggccggcatcgccatcatcctgcacacgctggccgccctgcagcagatgaagttcaccgggttcggcgagatcaccgtggtgttcaatccggacgaggagcgcggctcgcgcggctcgcgggacgtgatccgggaggtcgcggccggccaggacgcggtgctctccttcgagccgactttcgcggacgaggcggtcgatgccgccacgatcgccaccaagggcatcaactacgcgagcctcaccgtgaagggtcgctcggcccacgcgggcggcgcgccggaatccggccgcaacgccgtcaccgagctcgcccaccagctgctgcagttgcaggatctcggcgacaagcagcggggcaccagcctgaactggacggtggtctcgggcggcaccaagccgaacatcatccccgaccaggccaaggccgagggcgacatgcgctacttcgaggcctcggaatacgaccgcgtcctcgcccaggcccgcaagatcaccgagacgcaccgcgtgcccgacacgcaggtgacgttcgatctggcgaagggccgcccgccgctgcccgtgaacccggcgacgcgcaagctgggcgaggaggcgcaaggcatctaccgcgaggtcggcggcgacctgaagctcgtcgagatcggcggcggcacggacgcggcctacgccttccagcccgacagcccggccaagcccgtggtgctcgaatccctcggcgtggtcggcgggcgctaccacagcccggacgagttcgccgtgctcgacagcctgacgccgcgcctctacctcgcgacgcgcctcgtcatgcagctctcgggaaaggcggcccgctga

SEQ ID NO: 7514 - DNA, 837 bp, Methylobacterium sp.
atgtcggacgagatcgcatccccggagggcgcggccctgcacgcgccggtggcgcgcctgctgcgccccctggtgcggctgttcgtggcccggggcatcaccttcccggcgctgacgaacctgctgcgcgagctctacgtgaacgtggccgagtacgatttcgcgctccccggcaaggagcagacggacagccgcgtctcgctgctcaccggcatccaccgcaaggaggtgcggcgcctgcgcggcgcgggcgccccggtgagcacggtgccggccgtggtctcgcgcacgagccggatcatcgcccgctggctcgccgatccgaagttcacggacgggcggggccggccgctgccgctcccccgctcgggccccggcgaggcgccctccttcgaggcgctggtcgccggcatcacccgggatctgcgcccgcgcgcggtgctcgacgagtggctcgaccgggggctggcgagcctcgacgaggcggaccgcgtcgttctggccgaggccgcctacgtgccgcggggcgggggcgagccgcagctctactatttcggccgcaacctgcacgaccacatcgcggcgagcgtcgccaacatcgtgggcgaggccccgcgcttcctcgagcgggcggtgcattacgacgggctctcggaggatcttgcccggcggctcgaggcgcgggcccgcgagatcgccatggaggcgctgcaacaggccaaccgcgaggcccacgccgcctgccagaccgatcccggcggcgaccaccgctggaacttcggtctctacgtctacgccgaggcggcgcccccgcccgcggcccccggacctcgttga

SEQ ID NO: 7515 - DNA, 1518 bp, Methylobacterium sp.
atgtcgattcacgcaaacgagctcgcgccgcctggcgccgcggtaccggacgtgccgggcggcacgcacgacgcggtcatcatgaagccgagctacgacccgaacctcgtcaacgaggatctggcgccgctcaggaagcagacctggggcacctacaacatcttcgccttctggatgtcggacgtgcacagcgtcggtggctacgtcaccgccggcagcctgttctcgctgggcctcgtgagctggcaggtgctgatcgcgctgctcgtcggcatcgtgatcgtgcagatcttctgcaacctcgtggccaagcccagccaggtctcaggcacgccctatccggtgatctgccgcgcctccttcggcgtgaagggcgccaacatcccggcgatcatccgcggcctgatcgcggtggcgtggtacggtatccagacctacctcgcgtccgccgccttcatggtggtggcgctgcgcttctaccccgaactcgccccctacgccgacctgacgcgctacggcttcgccggtctctcggcgctcggctgggcctcgttcatgtttctctgggtcgtgcaggcgctggtgttctggcgcggcatggaggcgatccgcgtcttcatcgactgggcgggcccggccgtctacgtagtgatgatcgcgctggccggctacctcgtctggcgggcgggcatcggcaatgtcggcctgacgctgggcgaggtgaagcacacgggctgggcggcgctgccggtgatgctcaacgccgtcgcgctggtggtttcctacttctccggtccgatgctgaacttcggcgacttctcgcgctacggttcgagcttcgcggcggtgaagcggggcaatttctggggcctgccggtcaacttcctgggcttctcgctgctgaccgtcatcacggcgtcggccaccgtgccggtcttcggccacctgatcaccgatccggtcgagacggtgagccgcatcgacagcaccttcgcggtggtgctcggcgccttcaccttcatggtggcgacgatcggcatcaacatcgtggccaatttcgtctcgccggccttcgacttctcgaacgtcgcgccgaagcggatctcgtggcggatgggcgggatgatcgcggccgtcggctcgatcttcatcacgccctggaacctctacaacaacccggcggtgatccactacacgctggatatcctgggcgccttcatcgggccgctgttcggcatcctgatcgccgacttctacctggtgaggaaggaaaagatcgttctggacgatctctacacgatgagcccggccggtacctactggtacgagaacggctacaaccgggccgcggtgacggcgctgatcccctccgccctggtgccggcgctctgcgtgctgatcccgagcctcggggtcgtggcgaacttcacgtggttcatcggctgcgcgctgggcttcgtgatctacatcggcctgatgcgccgccagccggcgatgagcgcgcaaccggcggagtag

SEQ ID NO: 7516 - DNA, 1260 bp, Methylobacterium sp.
atggtcggccaacgcatcacaaagcggctggtggatagcctggaaccgcgggcggccgagttcactgcatgggacagtgccctgacgggcttcggggttcgggtgcgccccaccggcgccaagacgtacattgtggcctaccgagcgggccgcggtcgcagcgcaccgtatcgccgccaaacgattggaccggccaccaagctttcccccgaccaagcgcgccaggaagctgaacggatcttggccggggccacgctcggtagtgatccggctgccgagattgcagctgcgaaggagacccttgctgaggagcgcaaggccccccgggtgcgggacgtgcttgaccgctttgtggctgagcacgtcgatgtgcgcctgaaggcgcgcacggcttatgggtatcgccagatcatcgaaaccgttctgaagccagagattggcgacgttcgtgttcgtgaactgacgccggccacggtggccgaccttcatcaccggaggcgcaagacccgcacctacgcggaccaaatcgtgcgggtgctgtcgtccgcgatgagcctggctgagcaatggggcctgcgcgagccaggatcgaacccgtgtcgtatccgaaagaacggtagccgacgacgtgagcgacttttcagtgacatggaggtcgcacgcctcctcaacgccgtggacaaattggagagcgatgctggcgtgacgccattccaggcgctcggcatccggcttctgttcgccactggctgccgtatcggtgaaatttgtgccctggaatggagcttcgtggatttcgaagccgggctcatcacctggccggatacgaaaacgggcaacctgaccaagccactaacgagtgaggcgcgagcgctgctcgacgctgcgcctcgcatcgagggcgcggtgtccgtctgcccctctcgcaacctgaggcccatgcgcgtcgagaccctggaaggtgccttcgaaaaggcgatggcacatgccgaagtggtcgcgaacgagaacgccaccacacacctcgtgcggcactggttctgtacgaagatctattctgacccaacgattcccctgcccgatcagatgcgcatctgtgggcacaagtcagtggccaccgcaatgcggtatgcccagttgcagcttgaagaggtcaagcgtgcggctgaggaaagctcccaaaaacgcgctgcggctttggctgaggccaggaaaaagttagctgcctcaaatgttgttcgccttcgcgcgggagattga

SEQ ID NO: 7517 - DNA, 1719 bp, Methylobacterium sp.
atgagcaccgccgagaccccgtccccggcggcccgacgcggcggactgcgcggctccgggccgatgcgccgcgaggacctgctggacaatctcggcttcgccgacgtcgcggacgcggatgcgagcgggatcatggcgcccggcgcgctgcgcggagccgcgcgcgggcgcgacctcgacagcctgacccgcaccctgttcctgcggatctaccccgtcatcgccgcggtggtgctgctgacccaggccgggatcgcctgggtcaactacaccgaccagttccgcctctacaccgaccgggcgaacctcctggcctcgctcaccgtcgcggccatcgcccggcccggctgggagcaggcgcccgagatcttcgggccgcagctccaggcgctgacccgcgaccccgccttccgctacgcggccctgcgcgacggggccggcacgctcgtgggcagcgcgggcgagcagccgcacgggcgggactggaaccgcgtccaggtgagcgcgcaggtaggcacgcaggccggcacggcgcccgacgcggccgccgcgcaggccggcagcctcacggtggtgctctcggccgaggaactgcgcgacaacgccgagcggcaggcgctgctggcgctcggcaccagcctcgtgctgatgctggccttcgtcgcgacgctcacccgcaccgtgcgccgccacgtcgtcgcgccgctgaagcgcctgctcgtggcgatgcgcaaggtcgagcacaagcactggaccacggtcgatctcggcggcgcctaccggccgagcaacgagatcgacgcgatctcccaggccttcaacagcatggtcgagggcctgcgcagcggcgacgaggccaagcgcctgctccaggcgctggagcaggcgcatgccgcgctggagcgcgccaacacccaggtgatcgagagcatcggctacgcccgccgcatccaggcctcggtcctgccggagcgcggggccctcggcgcgcgcgtcgagctcgcggtcctctacgagccgctgcacctcgtgggcggcgactattactggctggaggaggtcgacggcctctcggtgatcgtggtggccgactgcaccggccacggggtgcccggcgccttcctgacgctgatcgtcgccaccgccctcgaccgcctgctgcacgagcgcggcctgcgctcgcccgccgccatcctggcgggcctcgacgcgatggtgcgcgcgcagctgcgccaggacgggcgcggcgccgaatccgacgacgggctcgattgcggcatctgcgtctgggatccggccgagcgcagcctgctcttcgcgggcgccggcctctcgctgaccgcgatccgggacgggacggtcgcgcagatccgcggcggccggcgcggcctcggctatccgcgcaccgggcgggaggcgctgcccgaggccgacacgcgcgtgcccgtggagcccggcaccaccttctacctgatgaccgacggcgtcaccgaccagatgggcggccagatcagcgaccgggcgtccggcgcgtccggcgggcggccgaagctgctgggcccgcgcggcgtcgccgagcgcctgctcgcccgcgccgcggacggcctcgacgcgcagctcgccgggctggagcaggatctggccgcctaccggggcggccaaccccggcgggacgacatgaccctggtggccttccggctgcccgagctcccggcgtga

SEQ ID NO: 7518 - DNA, 861 bp, Methylobacterium sp.
atgccgggcatccgcgccgccgcgctgaagcgcgcacaggaagccgtcctgggtcccgccggggacccggcacgggacgacggcttcagcctgttcgatgccgaggaggccatcatcggccgcgccgacgtgatgctgacgcgcctctccgagatggcggacggcgtgcaggaactcgccggcgcctatcgccggggcacgcgcgagcagcgccgtctggtgcggatgagcgaccgcatgcagctcgagctgcagcgggcgaaccagcgcatggccgagcagcagcgcgagctccaggccctcaacgcggcgctctcgtccgagatcgagcaccgcacgcgcctggaggcggagctgcgccgcctcgtcgataccgaccacctcaccggcgcgctgtcgcggcgccgcttcctcgaggtcgccgagctgatctggccccgcgacacgggtcgcgcctgcctgctgatgctcgacctcgaccgcttcaagcacatcaacgacacccacggccacgcggcgggcgacacagcgctggtctccttcgcggcgacctgccgggcggtcctgcgcccgggcgacgccctcggccgtacggggggcgaggaattcgccatcctgctgccggagaccggagcgaccgagggcctcgccctcgcggaggacctgcgccgggccgtggcggacacggccgtgccggccgagcggggcacgctcgcgatctcggtcagcatcggcctcgcggcctccgggcgggccgagcccctggccgaggccctgaagcgggccgacgcggcgctctacgcggccaagaacggcggccgtgaccgggtgcgcgccgccgcggcgcccggaccggtctga

SEQ ID NO: 7519 - DNA, 390 bp, Methylobacterium sp.
atgacgcgcatccagcttgccgcgaccgagcgctcgcccgaggtcgatttcgatctcgccgccggccgcctgtcgctgcgcggcgaatcctatccggaggatgccgcctccttctacgggccgctgctgcaggccctgcgcggccttctggcggagcccggccaggccccgctcaccgtcgaggtcggcctcgcctacttcaactcgtcgagcgccaaggcgctgatgaacctgttcatgccgctggaggacgccgccgccgcgggccgcccggtgacgatccgctggctctacgccgacggcgacgacacgatcgcggaggccggcgaggatttcgccgccgatttcgagcacgcggccttcgaactcgtgatggaggcgcaggtctga

SEQ ID NO: 7520 - DNA, 555 bp, Methylobacterium sp.
gtgctcgcccaagacttcctgtccttccacgaggcgtcccgacgcaacggggtgatcctctccttcggcggcgacatctccgagaacgtgctgttctcgctcggcgaggtgctgaagctgcgcatgcgtcaggaggacaccgacgcgggcgtggccaagcgcgtcttctcgatcttcgtcgagcaggcccagaacgtgatccgctactccgccgaccgcatccagccggaggccgagccgcggcccggccgggtcagcggcggcatgatcgtggtcggcaccgagggcgagcgcttcttcgtggtctgcggcaacgaggtcggcaacgccgaggtgccgcgcctgcgcgagcggctcgaccacatcgcgggcctcacgggcgaggagctgaagcggttctaccgggagaagctgcgccaggccccggacgagggcagcctcggcggcagcatcgggctgatcgagatcgcccggcgctccagcgcgccggtcgagtacgatttccaggcgatcggcaccgatcgcagcctgttctgcctcaaagcctatatctga

SEQ ID NO: 7521 - DNA, 3165 bp, Methylobacterium sp.
atggccgcgatccagatccaggccccggacggctcgctcgtcgagttcccggagggcaccgcagacgacaccatcgtgcgggtgatgcgggatagcttcccgtcccagtccgccgcgcccgcgcaggccgagccgccctcggcgctgtcgcgcgcggcctccggcgtcggcgatgtggtccagtcggcaggcgcgggcatcatccgcggagcggccgggctgctcgatctgccgcagacgctctacggcctggccgagaccggcgcagactacgccgcgcagggcgccattcgggccttgggtggcacgccgagcgctgaccgcacccccgtggtgcgcggtctcgtcccgccgccttcggacctgccgaaggtcggcgagggcgcggtgcgcgggctcgaggcggcgaccggcaagctctacgagccccagaccacggccggcgagtatgcccgcacgctcggcgagttcacggtcggtgctggtcggacgcccgcccgtctcctcgccttcggtgctgcgcccgcgctcgcctccgagaccgccgggcaggcctccaagggcagcgcggccgaaccctacctgcgcgcggtcgcgggaatcggcaccaccctcggtgcgggcgcggtcgccggtccgaagctctacgagcggatggcggcgcgcgccgcgcacggggcgacgccggagcagttcgagcaggccgaagagctcgcccgcaacgcaccgttcccgctgatggccagcgaggcgatccaggccgcgaccggcggcgcgacgcagatgggccgcatgcagcggctcgccgagagcaccgagggcggcgcccgggtgctcgacccgatcatggcggcgcgtccggagcggatgcagaccgccaccaacgcggcgctgaactcgctcggcccccgcaacccgctgccgaccgagctgggccagcaggtccaggccgcggcccgtggcgccgtgatggagagtccggaggggcgcgcactctcggcggcgctcgatgcgtccggcccccgcaccacccccggcatggccggcgcggtgatccagcctgaccttcggggtacgcgcgatctgcgcgaagccgcccgctcgtcgcgcgcgaacgtggactaccggctcgcccgggaggcgccagagcgcatcggcgtcgagcgccagatcaccgtcgagcgccctggcgagcctgtcaccaccgtcacctatccggagggccgcccgcagttcgcgcccgacgcggcgcgcccgctggagccgtaccagcgcggcgtcgcagagtcggccgaggcagggacggagagcttggcgcgcttcgtcgcccggaacggcggcctgcgcctcgacggcgacgtgaccgcaaccgacctccagcgcttcaacatccccggcctcggcaacgtcgcccgggagaacgggcgcggcatcgacgacttctggcgcgagcacctgatcgagcacgggtacttccggcccgacgccgacggcggcgcggcccgggacatctcgagcgagctgctgcgcaagctccagaacgagcagcgcggtcttccctcctatccgatcgggtacgagcgcggcgcggccacccggtccgttacccggcaggcggacgaatacgccgagacgctggcgacccacgaggcgcgcctggcggaggatctggccaacgcgggcgtgccgccggagagcctgcaccccgatatccgcgcccgcgtgctcggctccctgatgcggggcgagaccagcgacccgatcgcggcgtacgagcacgtcgtcggctcgatgcgcgagccgcctgccccctacgtgaagaccacgccgaccacgatcgaggagcagatccccgacgtgcggttcggccaagtgaacccgcagaacgcggtcgacgccatcgactcgctccagcagaccgccaagggcgatgttagcggggcgctcgcaggcgtgcgccggaacctgcatggcccggacggacagaccgatctctcggtggcgggcaacctgcgcacgcgcgagcgcttggacttcgatatcgccgcggcgcaggaagtgggcgacgcgacgaaggttcgggacctgaccatcgcccgcaacgcgatcgacgccgaactgaagcgcgtgcccgaggtggcggccgccgacgcgaatttcacccgcaactcgatcccgctacagcccttctccggtcagcacccgctcgcccgcgcgacggcccgcgacgatctcaccggccgcatgcagatgccggccgagcaggtgcccgggcatctcacccagccctcagcggcccgcgagttcgggcagatcgcgggcccgggcgcgcgccgtgccttcgacgattatctcaccacgcagatgctcgacgccgccccggacgcctaccgggtcaacgccgaccgcctccggaccggcatgcgggacagcgctgacctgatggcggaggcgccgaccgtgcgagaccggctctcgcgcgttctcgcggcacgcgaaggtctggcaccggtcgaggccacgccggtcggccgcatggcggagaaggacacgcttcgcggccagctcgcccagatcctggcggagggtgccagcccgaccgagacccggcagacgatgcgggccctctcgaagcaggacaagccggcagcgcggggtctcgtccgcgagggcgcgagccggatggccgaccgcaccgtgcatgcccctgacagcgcgggtcggccggatcagttcggcggcgcgaagctggcgcgggactaccagacgccgggcgaaggcacgaacctgcaggcggcgatcacggcgacgctcggagacgatcagcgcatcaaccgcctgatgcaggccctcggggcgacgggctggcgcgagcgcgtcggctcccgcacggccttcaacgccgaggacctgaaggacatgaagcagggcggctatatcgggggcctgatgaagctcggatccggtccgatgcataccgcccgcgacacggtcgagcgcttcctgctcggccgctcgtcggaaggcctcgccgagttgctggcctccggcccggtcggtgtccgtcgcatccaagagctgcagcgggagaacagccgggccgccttgatcgccgcactcgccgcctcccgcgcggagcaggagccggcgctgccgcggcggtag

SEQ ID NO: 7522 - DNA, 630 bp, Methylobacterium sp.
atgtaccagccgccgcattttcgcgaggacgacccgggggcgctggccgccctggtccgcgcccacccgctcggcctcctcgtcagcgccggccccggcgggctccaggcgaacccgatcccgttcctgctcgacgcggacggcgcgcacgggacgctgcgcgcccatctcgcccggcccaacccgcaatggcgggagctcgccgcggtcgaggaatgcctctgcgtgttccaggggccgcaggcctacgtcacgccctcgtggtacgccaccaagcgcgagacgggccgcgtggtgccgacctggaactacgcgaccgtccaggtctggggccgcccccgcgtcatcgaggacgcggactggctgcggcgccagatcgaggatctgacggcggcgcgcgaggccgcccggcccgagccctgggcggtctccgacgcgcccgaggcgttcacggcggcgcagatccgcggcatcgtcggggtcgagatcgcgatcacccgcatcgccggcaagtggaagatgagccagaaccgctcggaggccgaccgcgcgggcgtcgtcgccggcctgacgggggagggcggtccgggcgatccggtcgccgcgctcgtggcgagggcgggccggtga

SEQ ID NO: 7523 - DNA, 642 bp, Methylobacterium sp.
atggtcgacttcaccctctgggacattctgcgcaacctgctcctcgccgcgcgctggaccctgctcctctcgctcatcgccttcgtgggcggcggtgtcgtcggtctcgcgctcctcgtcctccggctggcgggccgcccgggcaccggccggatcgtgggcgcctatgtgcagctgttccagggcacgccgctcctgatgcagctcttcctgctctatttcgggctggcgctcgcggggctcaacacctcggcctggctcgcggccgcggtcgcgctcaccctctacgcctcggcctatctcaccgagatctggcgcggctgcgtcgcggcgatcccgcggggccagtgggaggcctcggcgagcctcgcgttgagcttcggccagcagctccgccacgtcatcctgccccaggccctgcgcatcgcggtcgcgccgaccgtgggctttctggtgcaggtcgtcaaagccaccgcgctcgcctcggtgatcggcttcgtcgagctgacgaaggccggcggcctcatcgccaatgtcagctacgagcccctgctgacctacggctgcgtggcgctcctctacttcgcgatctgcttccccatcagccagctcgcccgcctgctcgaaaggaccctgcgatga

SEQ ID NO: 7524 - DNA, 1515 bp, Methylobacterium sp.
atgaagggatcgagcaggcttctccccgctctcgggctctgtgccgcggccatcaccgggcacgcgacgggcgcgcgggcgcagagtgcggcacaggccgacggcaacctcggcgtcggcatcccggcgacggcggtgtcgccgctgctgcggcaacgggcggcgcgtcggcccccgccgcgtccggacggccagggcttcggcggggccgacagcgcggcgggcgccgccgacacgctcggccagaccgccacgcccccgaccctgccgcccgggacgctcgatctcggcaacggcctgtcgttcctggcgaactacaccggtcagggcgcgatcaacccggtcggcggcatccgccagggctcggcctgggcagggcagctcttcttcggcatcgacggcgacctgcagcggctcgccggcatcgcgggcggctcgttccacgtcgcggtgacgaaccgccacgggcgcagcctcgccaacgacgtcatcggcaacaacaccagcgtgcaggagatcttcgggggcggccagaccacccggctgaccctgctctcctaccagcagaagctgttcgacaaccggctcgacatcgagttcggccggctggtggcgaacatcaacttcctgaactcgccgatctactgcaacttccaaacaaattccgtctgcggcaacccgaccttcgtgttcaagacctcgaacttcacgttctggccggtgtcgagctggggcgcgcacgccaaggcgtggctcaccgacacggtcttcgtccacgcaggcgtctacgaggtgaacccgctgcatcagcagccgggcgacaatggcctcgacttctcgctgaagggcgcgaccggcgcgatcctgccgttcgagctcggctactcgacgaccttcgccaacgacctgctgccgcgcaactacggcatcggcggctggtacgacgcctccgactacgccgacccggtgcgcgacgtgaccggccgggccgcggtgctcaccggcctcaccccggcgacccgcttcgggcgctcgggcgtctacgcccgcttcgaccagatggtctggcggcccgatcccaccggcatccagggcctgacgctcttcggcgtggcgatggcggggacctcgggccggctgatcgaggactacttcctggagatcggcgccctccagaccggcaccttcgcggggcggccctacgacacggtcggcttcgtgatcaacacgcagaggttcagcccgctggcgcagcagaacatcgcgctcgcccagaacgcgatcggcctgaaccgcagcctgccgacgcagcagatcatgatggagctgaactacgggatccaggtcacgcccgcgatccggctgacgccgaacctgcaatacatcgtcaacccggaccagacccgcttcccctaccgcaaccggaacatcccggacgccttcgtggtgggcgccaagctctcggtcgacctgttcacgctggcgggcctcgcgcgcggtcccggcagcccgtaa

SEQ ID NO: 7525 - DNA, 219 bp, Methylobacterium sp.
atgttcgcactcaccgtcccggccgccgcggccgagcgtcaggaacggccccggctctgcccggaggacgcccccgagggcgtgcggctgccgccgcgcccgggctgcgggcgggaggcggcccgcacgggtgcgccggccggcttccgcgatctcggcaacggcgtgaaggtccggatcggtggccgggtcggcgccgattacgacgtgcggcgctga

SEQ ID NO: 7526 - DNA, 807 bp, Methylobacterium sp.
gtgcagcggttcactctgatccagggcggctacgcggtcggccccgccgccggcgcggggtggcgcatcgacctgaagggcgcaccgggggtcgatgcggaagcggtcgcagcgtggcgggcgctcctcgtgcgcaacgccgtgctcgatccgcgcaccgatccggactacctcctcaccgccgcgcggcacctcgcgggcggcgaccagatcgccttcgcgctggcctgggagcaggggccggacccggccttgcggggcgtggtgccgctggcgatcgccgagccgctgttccgcgcctcgcgcgcccggccgtggtggccgccgggactcaacccgcgctccctggtcgaccccggacggggggcggcgatccacgccgcaatcgcggcccatctcagggcgctcccccggcccgtcgcctacgatcccgaggcccgggcgggcaccgtgccggtgctgcggcggcccgtcccgcccgagagcgttctcggcgtccggcccgagggctacgtcccgccgagcgcgacggtcgagaccgtccgggagccggagcgcgtccgcgacgcggtcgaggccttcctggcgctggacgcccggaccgcgcggcatccgatcatcgccgcgccgcaggaggccgccatggtgcgggtggtgacccggctgttcgcccgccgccagcaactcgcggtcgtgctggcgagccgcgcgggcgggctggtcgccggcacgatctccctgggccagggggccggcaccatcgcgtggcgccacgcgggcggggatgcgggcgcgcttccggcctga

SEQ ID NO: 7527 - DNA, 996 bp, Methylobacterium sp.
atgcaatccgaagtcgcagaaactgacttctcacaaatagaagacgatgccgcgcggcgggaggcgtggatacgcgcgatctccccgatctacgtcgcggagatcgacaaggccgtcccggtcccacgcaccgtccgcttccgctcatggcggctgggcaccgtcctcttcaacgagatgtgcgcctcggcccaggcggtcgagcgcacgccctcgcagatcgcgatgcagggcgtggatcacgtcgtcctgcgcctctacacctccggtcggacaggtatcgacaccgctgccggcgaggcggaaatcccaacgggcgggctcgtgctcttcgacctctcgcagcgcgcccgctccgtcacgcacgagatgaccggcctcaacctggcaatcccgcggcggctcttcgacagccgcgtcggcgaactctcggacctgcatctcggcgttttccggaaggaggccccgttgatccgcctgttgggcaaccacatgcaccaggttcggaacagcatcgacggcctggacgagcggcagcgaagcctcatctcctcggcaacggtcgcgctatgcaatgccgccctcacgcccgcctcggacagcgcccacaaccgcccggcggtcgcggccatcgagatccgccagttcatcgaggcgaacctcgcccgagccgacctcggcatcgagacgctctgcgcccgcttcgggctgtcccgcacgccgatctacgccttgttcgagcccgatggcggggttgcgacctacatccgcaaccggcgcctcgcccgggccatgcggatgctttcgggcgtggaagcagggccgccccgcatctccggtgtggcctatgcctgcgggtacgagaacctgaaatccttcagcaaggccttccacgcccgctacggcgtgaatccgcgcggtgttggtgcgggccatcggaccgatgcccactgggaaagcggcacgacgctactgtcctggatcaaggagctataa

SEQ ID NO: 7528 - DNA, 966 bp, Methylobacterium sp.
ttggaggatgagcggcagcgtcgggaggcctggatccaggcgatctcgccggtcttcatgccgacgctggatcgggacacgccggtcccgcgagaggcgggcttccgctgctggaacctcggccggattctgctgagcgcgatccaggcctcgccgcagacgatcgagcggacgccgtcccagatcgcgacgcagggcgtcgatcacgttatcctgcggctctacacctccggtcgttccagccttgacacggccgcgggcgacgcgacgatcgccccgggctcgttcgtgctgttcgacctgtcgcagcgcgctcgctcgatctcggccggcatgaccggcatcaacctctgcattccgcgccgcctgttcgacgggcgcgtgggcgaggtctcggaccttcaccgcggcctgttcgagcagcgtgggcagccgctgctccggctcctctccgaccacatgcgcaacacccgacactgcctcgacacatcggacacggcgcagaaggcgctgctggcctccgccacggtcgcgctgtgcaacgcggcgttcgcgccgccctccgacagcgcacacaaccttcccgctgtcgcggcgatcgagatccggcagttcatcgaggcgaacctcgggcgcgtcgatctcggcctagagatgctctgcgcccggttcgggctgtcgcggacgcccatctacgcgctgttcgaggcggacgggggcgtgatgacctacatccgcaaccgcaggctcgccctggcgatgcgcctcctctccggggtcgaggagggtggcccgcagcggatctccggcgtggcctacgcctgcggctacgagaacctgaagagcttcagcaaggccttccacgcccgctacggcgtgaacccgcgcgacgtcgacgccgcgttccggatcgaggcgcgccgggagaccggggcgaccctgctgtcatggatcaaggagctgtag

SEQ ID NO: 7529 - DNA, 2241 bp, Methylobacterium sp.
atgtccagcatcaccctctcgtctgccacgcggcagaacctgctcgtggcccaggatacggccagcctcctgtcgaccacccagaaccgcctcgcgaccggcaagaaggtcaacaccgcgctcgacagcccgagctcgttcttcacggcccagggcctcgacaaccgcgccggcgacctctcgaacatcctcgactcgatctcgaacggcgtgcaggtgatccaggccgccaacaccggcatcacctcgctgcagaagctcgtcgacaacgccaagtcggtcgccaaccaggcgctgcaggcgacgatcggctactcgaccaagtcgaacgtctcgaccacgatcgccggcgccactgccacggatctgcgcggaacgacgtcgtacgccaatgcgcaggcgagcagcaacgtgctgttcaacggcacagccggcggcacgacggcggcgacaggcactacgacgctcggcggcaccgctggcacctatgcggggacgtccgtcgacgacaacgcatcggcagacatcacgaccagcacgctgatctacggtgccactggcgcgttgacgacacaggccactactaagttcaccgacggtgacaccctcaacgtcaacggcaagacgatcaccttcaagtctgccgcgactcccggtgccgccacgctgacgggctcgcagggcctgctcggggcgagcggcaacgcggtcaccgacggcagcggtaactccaccgtctatctgaacgcggcgacgaccgttggcgacgtgctgaacgccatcgacgtcgccagcggcgcgcggaccgctggcacgccgtcgagcggtgtgtcgaccctcagtggttcgggctcgagcatcaccgccggtgcgatatcgctcaagtccagcaccggctccgacctgagcctctccggcaaggccgacatcctcaacgcgctcggcctctcggcggcgaccggctccggcacgacctccgtctcggctgtccgctcgacctcgtcgacgagcttggctgcactgatcacggacggctcgaccctgaacgtgaacggcaagaccatcacgttcaaggatgccgccgtcccggccgcgtcgtccacgcatacgggcgtgagcggcaacatcgagacggacggcaacggtaactccaccgtctatctccgcggcggcagcatcaacgacgtgctgaaggccctggatctggcgagcggcgtccagaccgcgacgctctccgcatcaggtgcgaccgtagctaccgctacgggtgcggtgaactcgtcggtcgggccgaccggtgctctcaaaatcagcaccggtagcttgtctgacctgaacatcaccggcacgggcaatgccctggcctcgctcggcctcgccggcaatactgggacagataccagcttcacggcatcgcgcagctccacccccggcggcctctccggcaagacgctgacttttggctcgctgaacaacggcaccgcggtcaacgtcaccttcggcgacggcaccaatggcaccgtcaagacactggacgatctcaacgcgaagctcgccctcaacaacatgcaggcggcgctcgacgccagcggcaagctgacgatctcgacgacgaacgactacgcctcgtcgacgattggcagcacggccgacggcggcgcgatcggcggcacagcttcggcgctgttctccgtcgcccaggcgccggtcgaggacgtgaactcgcagaacacccgcaagtcgctgctctcgcagttcaaccagatcctggacaacatcaagacgaccgcccaggacgcctcgttcaacggcgtgaacctgctgaacggcgacacgctgaagctgacgttcaacgagaagggctcatcgacgatgaacctgatcggcgtcaccttcgatccggccggcctcggcctgaccaagctcggccagaacggcctgaacgagttcgaggacatctcctcggcgaacaaggtcatctccacgctgacacaggcctccacggccctgcgccagcaggcctcgaccttcggctcgaacctgtcggttgtgcagaaccgccaggacttcaacaagcagatcatcaacgtgctgcagaccggctcgtcgaagctcaccgacgcggatctcaacgaggaggcggcgaactcgcaggccctctcgacccgccagtcgctgaccgtctcggccctgtcgctcgccaaccaggcccagcagagcgtgctgcagctcctgcgctaa

SEQ ID NO: 7530 - DNA, 276 bp, Methylobacterium sp.
atggacgcccgagcgatcatcggctggaacctgcggcgcctgcgcgtcgagcagggcctgtcccaagagcggctggccctcgcggccgggatcgaccgcgcctatgtcggccgcgtcgagcgcggctcggagaacgtgacgatcaccaccctggaagcgatggctaaggcgctcgcggtgccgatcgccgacctgctcaccgaacctgagccggacgcgccccggccaacgccgctgcgcgccggtcgccgggcgcggcgtgagcccgccgcctga

SEQ ID NO: 7531 - DNA, 291 bp, Methylobacterium sp.
gtgggaaagtccgacctcgccaaggtggacgcgcacgtcatcacggccgaggagtacgaggagctgcccgagatcaccgacgagatgttggaccgggcggacttccgcgtgggcggcaagctggtacggcgcggccgcccaccgaagcccgacgcgaaggaggccgtgtcgctgcggctctcgcccgacgtgctctcccacttccgggccggcggaccgggctggcagacgcggatcaacgcggtgctgctcgacgccgtagcgcgggagaaagccggctcgcggcgctga

SEQ ID NO: 7532 - DNA, 2499 bp, Methylobacterium sp.
gtgactgccacgaaggaacgggcgcgcgcgctcgtcctactcctgcaccagcttgctaaccccgtcgtctacctgctcgcggcagccggcgccctgtctttctactttggcgattggcaagaggcggccgcggtctttgcggtcttggccgtcaataccggcctcggcttcttcaccgagctgcgggcggctcgaaccgtcgagggcttgcgggcgctcgggatgcgctcggcccgcgttcgtcgtgacgggcatgtccgtatgctggccgcagtggatctcgtcccaggcgacgtcgttctcgtcgagggcggcgatgccgtccaggccgacctccggctggtcgaggcgtcaaacctgggcgcggacgagtccacgctcacgggcgaatccgtgccggtcgacaagtcggccgacccggtcgccgcggaggcacgccttgccgagcgctcgtcgatgctgttccggggcacgctggtcacccgcgggagcggcacgggcgtcgtcgtcacgactggagcgggaactgagctcggcggcgtcgctcggctcgtggagcaggcggagccggacagttcacccctggagcgccgcctggaacgcctgtccggccagatggtctgggtcgtcctgatcgtggtggtactcctcggcggtctcggcgtggtgaccggcaaggatctccgcctcatgaccgaagccagcatcgcgctggcggtcgcggccatcccggagggcctgcccatcgtcgcgaccctaacgctcgcgcgcgggatgtggcggatggcgcggaggaacgcgctgatcgagcgcttgtcggccgtcgagacgcttggcgccaccaccgtcatcctcaccgacaagacgggcacgctcaccgagaaccggatgacggtacggcgactgtcgctgccctccggtgaactggacctgtcagagcgagcgtccgaacgtgcacccgaggccgagcgactgctccgcgtcgcggtgctctgcaacgatgcctctctcgggcaggggccggggcacggcagcggcgacccgatggaacaggcgctgctgcaggcaggccgggcctgcggcctggatcgcgctgcgatgcttctcgaccagcctctcgtgcggaagcacgccttcgacgcagccaaccgcatgatggccacggtccacgcgtccggaccgcgctacttcgttgcggtcaagggcgccccggaggcggtacttgcggccgcgcgttccacccgcgagggcgaacgtgaccagccgctcgacgacgtcacccgcctcctgtggcaacgccgcgtcgaggacctaggcacaaggggcctgcgggtcatcgcgtgcgccgagaggagggtggatgcggcggcatgccatcccttcgaggagctctcgttcctcggcctaatcgggctggaggaccccgcacgggaggatgtcccggaggcggtggcagcctgccgcgccgcgggcatccgagtcgtcatggtcaccggcgaccatgctgtcacggcgcgaagcatcgcccacgcggtcgggctcgccggtccgggggaccgcgtcgcggagggtgtgcccagcggcgacttgccgggtggattggaagctgtcgcagtcttcgcgcgggtaagcccggccgagaagctgtcgctggttcgggcgtaccaggagaagggcgaggtcgtcgccatgactggcgacggggtcaacgacgccccggccctgaagcaggcggacatcggcgtcgcgatgggccggcgagggacggacgtggcgcgcgaggcagccgcgatggtgctcctcgacgacgccttcccgacaatcgtgggcgcgatccgcgagggacgggtcatcttcgacgacatccgccgcttcgtcgcctacctgatggcctgtaacctcagcgaggtcatggttgtcgggctcgcggtcctgacggcgctgcccctgcccatcctgccgctgcagatcctttacctgaacgtcgtcaccgacgtgttcccggcctttgcgctggcgatgggggaagggcgggacgacatcctcgaacggccgccgcgcgacccgagggagcccatcctcggacgcccgcaatggagccggatcgcctcgcacgccgccctcatgacggcggcgacctttggggccctggctgttgccgaattctggatcgccctcgaccgggcatccgtcgtgacggtcacattcctgacgctcgctttcgcccagctctggcaagtcttcaacatgcgggccccgggctcgaagccgttccacaacgaggtcacacgcaacccctgggtctgggccgccctgctcctgtgcacggtgctgctggtcgggcccgcccacatgccgtcagctggcgccgtgctcggcctcgtcccgcccgacctgggcatgtgggtgttggtcctctcggcgagtcttgcgccgctcctgctcgtccagctttggacgatgggcgcgagcgcgtggaggcgcgtcggtcagacctga

SEQ ID NO: 7533 - DNA, 1440 bp, Methylobacterium sp.
atggattcgcacgacgcgatcacggatctcggcgccgtcgcgctcgccgcggcgatccgcacgcggcaggtctcctgcgccgccgtgatgggagcctacctcgaccgcatcgagcgcctgaacccgcgcgtcaacgcgatcgtcgctctccaagaccgcgccgggctgatgcggcaggcgtcagcgtgcgacgcgcagctcgcccgcggcgagcccacgggcccgctacacgggttcccgctcgcggtgaaggacctcgatccggtgcgcggcctgcccttcacgcagggttcgccgatcttccgcgaccgcgtggcagagaccgattcgatcatggtcgcacggctgcgcgcggcgggggcgatcttcgtcggcaagaccaacatcccggaattcggactcggctcgcacagcttcaacccggtctacggcgcgaccggcaacgcctacgatccggcgctcagcggcggtggatcgagcggcggcgccgccgtcgccgtggcgctgcggctcacgccggtggcggacggcagcgaccatgccggatccctgcgcaacccgcccgccttcaacaacctgttcggcctgcgcaccagctacggccgcattccggccgagagcccggatctcttcaccccctcgctcggcgtgctcggcgcggtcgggcgctcgcccgccgatatcgggctgatgctctcggtcatcgccggctacgacccgcgcgtgccgctctcgaaccacgaggacccggctcgtttcgccgccccgctggagcgggatttttccggcacccgcatcgcctggatgggtgatctcggcggtcacctgcccttcgagccgggcgtgctggagaccggactcgccgccctcgacacgttccgggcgatcggctgcacggtcgaggcggcattcccggcctacgactacgaggccctctggcgggactggctgaccctgcgcgcctggacggtcgcggggaatctgcgcccgttctacgagaacccggtgacccgcgcccggctcaagcccgaggcggcctgggaggtggagcgcggcctcgcgctcggcgccgaggccgtgacccgggcgcaggaggggcgcacgcgctggtaccggacggtcctgcgcttcatggagacctacccgttcctcgtcgcgccgagtgcgcaggtcttcccgttcccgatcgatcggcgctggccggacacggtcgccggacggccgatggacacctaccaccgctggatggagacggtgatcccggtgacgatgtcgggcctgccggcgctgaacgtgcccgcgggcttcggccccggcggcctgccgaccggcatccagatcgtcggcccgaaccacggcgagcgcgcctgtctcgaactcggcgccgcctacgacgcggcgagcggctgggtcgagcgccgccggccgccggaggcgtga

SEQ ID NO: 7534 - DNA, 2214 bp, Methylobacterium sp.
atgagcataacgccggcgcccgccgcgccgaccgccgcagaaccgccggtccagtcgcaggctcagccccagccgccgcaacccagaccggattccggactgagcgcgctggcgctcgtctcctccttccatcaggttccctgcgacagcgcccagcttggccacgagctcggcgtcggagagcgcccttcctcggctatcgacatcgtgcgcggtgccaagctcctgggcctcaaggcgcgcatcctgaagaaccagaagccgagccgtctggagagcattccgctcccggcgatccttcagaccaaggacggccggttcgtcctgatcggccgccggcacgaggacggcacctaccggatcatcgacgcggcgacccggcaggtcgaacagccgaaagcggccgatttcgcctccgagacctgggacggcactatcgtgctggtcgcccggcgtgcgcgcatgaccgacacgccgcccgagttcgggctcgcgtggttccggccgtcgctgtggcgctaccgcaagccgctcatgagcgtcatcgtcgcctcgctgttcgtgcagctgtgcgcgctgatcacaccgctcttcatgcagatcaccatcgacaaggtactcgtgcataaggggtattcgaccctcgttctcgtcgtggtcggcctgatccttatcggcttcttcaacgtcgcgatccagtatctgcgaacctacgtcctcgtgcatacgacgagccgcatcgacgtggagctcggcacgaagctgttcgaccacatgctgcggctgccgctcgcctatttcgaaacgcgcgccgccggacagacggtagcccgcgtgcgcgagctggaagcagtccgcaacttcctcaccggccagggcctgagctcggtgctcgacctcgtcttcaccggcgtcttcttcgtcatcatgttcatgtactcggcgacgctggcgctgatcgtgctagcatcgatcccctgctacgtgctggtggccgcactgctgcgcccgctcctgcgcgacaagacgaaggagcgcttcaaccgcggcgccgagagccagcaattcctggtcgagtcggtggtcggcatccaaaccatcaaggcgatggcggtcgagccgacgcttcgcacgcactgggaggaacgcctggctgcctacgtgcgatcgtcgttcgagggcgtgatgctggccaatctcggccagaacgcgatccagtacatcaacaaggtcgcttcggcgctggtgctgttcttcggtgctcaagcggtgatcgcaggcgagctcagtgtcggctcgcttatcgccttcaacatgctgatgggtcaggtcaccgccccgattctgcgcctgtcccagctctggcaggacttccagcaggtgagggtctcggtcgagcgcctcggggacgtgatgaacgcgccggtcgagagccgcgccatggcccaggcctcgctgccgccagcccgcggcggcatccagttgcgcaacatcgtcttccgctaccagccgggcggcaacgaggtgttgaagaacgtttcgctcgacatcccggcgggtcaggtcgtcggcatcgtcggcccctccggctcgggcaagtcgacgctcacaaagctgatgcagcgcctctaccagccggagaaaggtcaggtgctcgtcgacggcatcgacatcgcgcaggtcgacccgacctggctgcgccgccagatcggcgtggtgctgcaggagaatctgcttttcaaccgcacggtccacgagaacatcgctctggccaacccggccatgtcgcgggcccaggtggtggcggtggcgaggcttgcgggcgccgacgagttcatcaaccgcctgccgctcggctacgacacccgcatcgaagagcgcggaggcaacctctccggtggccagcgccagcgcctcgcgatcgcccgcgcgctcgccatcaacccgcgcatcctgatcttcgatgaagcgacctccgccctcgactacgagagcgagcgcatcattcaggagaacatgcgccacatcgtccgtaaccggacggtcatcatcatcgctcaccgtttggccgccgtccgtgacgcggaccgtatcatcgcgctgaaggacggcgccctggtggaggacggttcgcacgccgagctgcttgccaagcccaccagcctctacggccggctgtggcgtctgcaatccggggagaccatcgcggcatga

SEQ ID NO: 7535 - DNA, 612 bp, Methylobacterium sp.
atggcacggtacgatgcggcctgtccggctccttcggtcgccagcatccaagatgcgatcgacgcggccgatgtcgtcggccattgggactgggacatcccggccgaccgcctcgccgcggacgcgctcgtcgcgctcctcttcaacatcgagcctgatctggccgaggccggtgtcccgctcgccgccttcggggccgggatccaccccgacgaccgcgcgcgcatcgttcggctgatcgaggagcacgcctggtcggggcggtcctacctggcccagtaccgggtctgctcggccgacggcgtgacgcgctgggtgctggcgcgcggacgcttctccagggatggtgccgggcgtccgctgcgtggccgggggctcatcatcgacgtcacgcgtacccgcatcaacgaggacgcctccgccgtggcgtgttccgacacggctgggtcccccctggagcgggcggcccgcagcttcctggaagggtacaagctgctcgagacaatgcaggaccagccgcagcttcggcggcttgccgaggtgctgctgttcgagacagggcgcgccctggcagcacaggtcgaccgggcgcggcgaaccggcatgaactga

SEQ ID NO: 7536 - DNA, 411 bp, Methylobacterium sp.
atggcggagagcgagcagttccagaagggcttggccgtgcgccgcgccgtgctcggcgaggcctatgtcgacgagggcttggccaaggccgacgatttcatgatggcattccagcggatcacgacggaatggtgctggggctatgcctggacgcgcgagggtctcgaccggaagacgcgcagcatgctcaacctcgcgatgctgacggccctgagcaagcccgccgagctgaagctgcacgtcaagggcgccctggccaacggggtgagcgtcgaggagatcaaggagatcctgctgcacgcgaccgtgtattccggcatccccgccgggctcgaagccttcaaggccgcgcacgaggtcctcaaggcggagggcgcggtcaccggcgagccgcccggcccgacggcctga

SEQ ID NO: 7537 - DNA, 1290 bp, Methylobacterium sp.
gtgatcgctccccccaccccccaaaccctcctgtccggccacgcgctgcccgccgccgtcctgcgggcggagccgactgtctggcgcaacccgcaccggcgcggcagcgcggcggtcctgccgggcctcgcactcgccgagaccgacatgcgggcggcggcggcgcgctggcaccgcttcgccccgctgctcgcccggctgttcgacgggctcgagggcgggcggatcgactcgcccctcgcggccctcccgccggccgtcgccgagagcgtcctcggcggcgctcccggcgccgtctgggtcaaggccgaccacgacctgccggtcaccggctgcatcaaggcgcgcgggggcgtctacgaggtgctggcctatgccgagaggctcgccgagacggccggcctgctgagggaaggcgcctggtacgcggatttcgcaacgccgcccttccgcgacctcttcgcccggcacacggtcgcggtcggcagcacgggcaatctcggcttcagcgtcggcgtgatggggcgcgcgctcggcttcgcggtcgaggtgcacatgtcgcacgacgccaaggactggaagaagcggcgcctgcgcgagctcggcgcccgcgtcgtcgagcatccgggggattacggcctcgcggtcgcgacggcgcgggacgccttccgcgatcgcggcgacgcgcacttcgtcgacgacgaggactcggccgacctgttcctcggctacgcggcggcggcgctcgacctgcagcggcagctcgcggcggccgggatcgcggtcgacgccgcgcatcccctcgtcgtctacctgccctgcggcgtgggcggcgcgccggggggcgtggccttcgggctgaccctgctgttcggcgacgcggtgcggccggtcttcgtcgagccggtggccgcgccctgcatgctggtccagctcgcggcggggctcgaccgccccgtcagcgtctacgatgtcggcctcgacaaccgcaccgcggccgacgggctcgccgtggccagcgcctcgatgctcgtggcgcgcaccgtcggcgaactgatcgaggcggtcgtgaccgtgaccgacgacgcgctcttccgctggctcagggcgctgtgggacggggcggccctgcgcctcgaaccctccgcggccgcgggcttcgcggcggtgggcccgttcgtcgccgcggcggccggcgccgatctggcgcgcgccacccacgtggtctggacgacgggcggcgcccatctcccggacgccgagttcgaggccgcgctggcccgcggctga

SEQ ID NO: 7538 - DNA, 1299 bp, Methylobacterium sp.
gtggggcgcgaccatcgtccgagccgccggctcgtcctcggcctgctcgccggcgcggcattcctgcccgggcgcccgcccgcgcaggaggcgccgatccgcgaccagggcatcggcggcaccggcgcccgcccgaccgacacccccggcgagggcgatcgcggcatcggcggcacgggggtgatcggcacgatccggcgcttcggctcgatcgtggtgaacgacctgcgcatcgcctatccggacgacgtcgcggtgcgcatcgacggcgccccggcccgcgcctcggacctgcgcgtcggccacgtggtgcgggttgtggcccggcccgagggcggaggcctcgcgacgcgacgcatcgacgtgacgagcgaggtggtgggcccggtcgaggcggtgggccggaacagcctcacggtgctgggccagcgcatagccacgggcatggcgggcggcacctggacggtcggccagcgcgtcgcggtgagcggcctgcgccgcccggacggtgtggtcgtggcgagcctgatcgagccccgcacggagggcgcggaccgggtcgccggcccggtccggcgcgggccggacggcgcgatgcggatcggcgacctgcggctgaacggtgccgggcacctgcccgcggggcgccgcgccgctctcgccgggcggatgcgggacggcgcgctcgcggtcaccgacgccgccgaggccggccttccgcccggcatccggaccgcctcgatcgaggcctatatcggccggcgaaagggtgggatgaccctcggctccggcctgccggtcgcgggcattccgggcgcggacctgccccgctccggcgcggtccgggcggtgctcaccacgcaggtggcgggcgacgggcgcctgacggtcgagcgcctgcgcgtcgaggatcgtctcgccccggtgcgcgatccggcgcgcgcgcccggccgcttcgagggaccggacttccagcgcgaccggctcgacctgcgcggcctgccgggccacggctccggcggcgtcccgggtcgtgacggtgtcggtcccgggccgggtctgcgcatcgacacgcggccacccggcggtttcggcggtcccggagggcggggggcgggccctggcggcaatcccggcggcttcggagggccgggtggtacgggcgctcccggaggaggcttcggcggcccaggcccaggcccaggcccaggcccaggcccaggcttcggcggcccaggcttcggcggcccaagcctcgggggcgccggtccgggcggcttcggcggcggccggcgctga

SEQ ID NO: 7539 - DNA, 1149 bp, Methylobacterium sp.
atgcccggccggttcaccctcaccaccgcgatcctgctggcgctcgccgccacgggggcgcgggcggacacgatccgcatcggcgtcaacgagcccctgaccgggcccttcgcggcctcgggcacctacgtggtcaacggcgcccggatcgccgccgacgagatcaacgcgcggggcgggctcctgggcaagaagatcgagctcgtcgtcgaggacaacaagagcaacccgaccgaggccgccgcggtcgccgagaagctgatcaccagcgacaagaccccggttctgatgggcgcctggggctcgagcctgacgctggcggtgatgcccaagctcgccgattacgaggtgccgatgctggtcgagacctcctcgtccggcaagatcaccacctcgggcaaccccttcgtcttccgcatctcgccgccctcggcgctggaggccgagaccttcgcgccgatggtcgccaagctcgggatgaagaaggtcgacttcctggtgctcaacaacgatttcggccgcggcgccgcgaccgatttcggcaagatgctgaaggagaagggcgtccaggtcggcctcgtcgagaccatggaccagggcgcgcaggacatgagcgcccagctcgccaagctgaaggcctccgacagcgacacgatcatgatcacgagctccgtcgaccagctcgtgctgctgttcaagcagatggcggcgctggggctcaagaagcgggtgatcaccaccggcggctcgcagaaccccgaccagatcatcgcgcaggcgggctcggccgccgacggcacgatgcacctgaccaccttcctgccgtggatccccgagaagaccccggacccgaaggcgaccgagatcttcatcgcggagtggaagaagcgcggcttcgcgttcgcgggcgtcaccgagagcttccgcggctacgacggcatccgggcgatcgcccacgccatcgagaaggccggcaaggcggagcccgccgcgatcgccaaggccttctggtccgtcgacttcacggggctcaacggcccgatccgcttcgccaagtccggccccgccggcaaggagagcggccagagcaagcccgacgtctacctgatcgagatcaaggacggccgcgtcgtcgtgccgacgctctga

SEQ ID NO: 7540 - DNA, 567 bp, Methylobacterium sp.
gtggccgcagcccgcgaggcgtggtttgcgggccagcccgacctcgatcccgagcgcctgatcttcatcgacgagacggggctgtccacccgcatggcgcgcctgcgcggtcgctgtgcccgcgctcagcgcctccgctcgggcatcccgcacggccattggctcacgacgaccttcgtggcgggcctgcgcctgtcggggatgagcgcaccgatggtgttggacggtcccatgacgcgggactggttcttggcctacgtcgagcaggtgctcgccccaaccctcaggcccggcgacaccgtcatcctcgacaacctccccggtcacaagggcgcggcgatcaaggccgccatcgaggcgcgcggggcacgacttcagttcctgccgccgtactcgcccgacttcaatccgattgagatggccttcgccaagctcaaggcactgctgcgcaaggcggccgagcgcaccgtcgatcggctctggactgccgtcggcgatcttctcgacgccttcacgccagccgagtgcgccaactacttcgccgccgccggttacgatccggaatag

SEQ ID NO: 7541 - DNA, 528 bp, Methylobacterium sp.
atgtgcgaggatctgcaggtcgcatcggcgcaggaaacggaggtgccgccgcccgcttcgccctcgtcgtcgccccggccctggccgctgcacgagcgccccggcttcctcgcgcgccggatgcatcagatccacgtcagcctgttttcagagcgctgtgccgcttttcggatcacgccgctgcagtacagcctgctctcgctgctgcgggacctgcgggaggccgaccagaccacgctggcgcaggcggtcgccctagaccggacgacgacgacaggggcgttgaagaggctcgctgcccgcgggttggtcagccgggcgacctcgccgacggaccgccgcgcccaggtctgccgtttgacggaggccggggaggcgctccacgacgcgatggaggggtcggtgcgcgaggctcacgccctgaccgtggcggcgctcaccacgcccgaccaggagcggctcaccgagctcctgcggcgcgtcgtctccggccacgaccaccggagaggtcaggccgacatcgcctag

SEQ ID NO: 7542 - DNA, 801 bp, Methylobacterium sp.
atggtcgcggtcgacgacgggcgccacgccaggacgcggatccgtctcgccgcggaactggctcaccgcctcggcgcccgcctcgtcggggccgccgcctgcatgcccgactacccgcagggctacggcgagaccgccgtgcccatgggcatggtcatcgaggagatccgccaagccgccctcgacaggtgcgcggccgccgaacaagtcttccgccaaggctcctgcctgaacgaccgcgtcgagtggcgctccgacatcgccggtccggtgccgttcctggcagggcagtccagggccgcggacctcgtcgtggtcggtcgctacgccgaggacgagggcgtcaggccgggcatggccgtcgacctcggcgacgcgctcatgggcctgggccgccccgtcctcgtggttccggccggcatcgagcacctggaggccaagcgcatcgtcgccggctggaagaacacgccgcagacccgccgggcgctctcggacgccttgcccctgctcaggcgcgcggaggaggtccaggtgcttcgggtcacggataccgaggaccgggcggaggtggacgacgtcgtccgctacctcgccctgcacgacgtcaacgccaacgggcatctggcggcgcgctcgggctggagcgtcgccgaggacctgcagaaggccgtccgcgcgatcgacggggaccttatcgtaacgggcggctacggctacagccggctgcgcgagtggttcttcggcggggtcacgcgcgacctgctgagcgagacgaccgtctgttgcctgatgtcccactga

SEQ ID NO: 7543 - DNA, 837 bp, Methylobacterium sp.
atgatcatcctgtccgaggagcacggcgaggcgcgccgcctggcgtcgctggaggccgagaaccgtcacctgcgcgccttgatgctggcgggccggcgggccgaggtcgagcggcggcacggcgcccggctcggccgtgcggaggccgagcggatccgggccgagaccgaggcgcgcgaggcccgctaccgccacgagatcgccgagctgaagcagggcgcggaccgccagtccctgctgatgcaggagatggcccatcgggtgaagaacaccctggcgatggtccaggcgatcggcgcccagaccctgcgcacggccccctcgctcgacgcggcgcgcgcggcgctcgacgcgcgcctcctcgcgctggccaaggcccacgacgtcctgctccaggacgcctggaccaccgtcccgctcggacggatcgtggcgtccgccgtggcgctccacggcggcgaggccgggcgcttcgcgatctccgggccggaggtcgcgctggccgctcgggccggcctgacggtcgccctgctgctgcacgagctcggcaccaacgcggccaagtacggcgccctctcggcgcccgccggccgcgtggcgatcgcatggacgatcgacaggggggcgatcgaggagcgggcggaggccgcccgcttccgcttccgctgggaggaatccggcgggccgccggtgagcccgccgcgtcaggccggcttcggctcgcgcctgatcgagcgcagcctcgtccacgggttcggcggccgcgtcgatctggcctacccggtcaccggcctcgtcctcgccttcgaggcgcccctggcgatgctggcggcctga

SEQ ID NO: 7544 - DNA, 1590 bp, Methylobacterium sp.
gtgagcaccgcaacggccaaggcgcccgggggccacaacccctgggcgatcgccctcgtggtggcgctcgccaccttcatggaggtgctcgacaccacgatcgccaacgtcgcgctccgctacatctcgggcggcctcgcggtcgggcccgacgaggcggcctgggtggtgacgagctatctcgtcgccaacgccatcacgctgatcgcgtcgagttttctcgccaagcgctacgggcgcaaggccttcttcctatggagcgtggcgctgttcacgctcgcctcggtcctgtgcggcttcgcctggagcctcgaatcgctgctgctgttccgggtgctccagggtctcggcggcggcggcatggccccgctcgcgcagtcgatcctggccgattccttcccgcccgcgaagcgcggccaggccttcgccctctacggcgtcgccatcgtggtggcgccggtgatcggcccgacgctcggcggctggctctccgacaacgcctcctggcactggtgcttcctgatcaacgggccgatcggcgtgatcgcgctcgggctgatgtactggctgatcgaggacagcgacgcggccaagcgcgagcggcgcgacctgcggaagaagggcgtgcgcttcgaccgcgtcggcttcctgctggtcgcgctcttcctcggctcgctggaggtcatcttggacgagggccagcgcaaggactggttcgggacctcgacgctgatgaacgtcttcggcgtgctcacggtggtctcgttctgcgccatgatcccgtggctgctgacccggaagaacccggtcatcgacctcaggctgctcaacagccgccagttcggctcctgcttcgtggtgatgctgttcacgggcgcggtgctgatcgccaccacgcagttcatcccgcagatcacgcaggaatattacggctacaccgccaccctgtcggggctggtgctcggccccggcggcctcgtcacggtggcgatgatggcgctggtcgggcggctctcgtccttcgtgcagccgaaatggctgatcgcgacgggcggggcgatcgtcgcggccgggatgtacgacctcacccggatctacggcgacaccgccttctggttcttcgcgtggtcgcggatctatatcggcatcggcctgccgatgatcttcctctcggtgacctcggcctcctacgagggcctgccgaaggaccggaccgaccaggcctcggcgctcatcaacgtggcgcgcaacgtcggcggctcgctcggcgtgtcgctcgcccagaacatcctggcctatcgcagccagttccatcagagccggctggtggaatcggtcgatccgtcgagcccggcctaccagcagaccctggcgcaggcgacgcgctacttccagcagcacggctacgcggggccggacgcgcagaaccaggccatcgcctggatcggcagccagctctccacgcaggtggcgtactgggcctatatcgacgtgttctgggtgctcggcgcgatgaccgcctgcctcgtcccgctggcactcatcctgaaggacgtgaagctcggcgggggtgcgccggcggcgcattga

SEQ ID NO: 7545 - DNA, 1713 bp, Methylobacterium sp.
atgacatcgtcgtcccaacggctgcgcagcctcaccgccaaggtgatcctgctcgccggcgccgccatcctgctcaccatcggggcgctgctcacggccacgagccacagcctgtggcgccaggtcgaggcggcgcaggaggaggagggcggcacgcatatccgcacgctcgcgctcgtcctggccggccgcgtgcccggcgccgccgccaccctcgacggcgcacggctcgggcgcgtgacagcgccggatctcggtggcctcgcagacctctcggtggtcgacgacgtgacggcctatgtcgggggcaccgccacggtcttcgcctacgagaccgcgaccgaccggttcgtgcggcggatcaccaacgtgcggaccgagacgggtgcccgcgccgtgggcaccgcgctggcgcccgaccacgccgcgcaggcgagcatccgggccggtcgggccttcgccggcaccgtcacgctgttcggccggccgttctacacagtctaccatccgaccatcgacgcggccggcaaggtcaacggcctgctctatgtcggcatcccgatcgagcgctacctcgcgcgctacacggcgaccctgaacaccacggcactcgccgccggcctcgtggccctcgcggccctgctgatcatggtaccggtcgccctgcggatgttccggccgctccaggcgatcgcggcccgcacggaggcgctggcggcgggcgatctcgacggggagatcccgagccgggcgcgccgcgacgagatcggagccgtcgcccgggcactggcgaccctgcgcgacgtcagccggcgcgcccgcacgctcgaggcggagcagagcgccagcggggcgggcgagcgcgcccggcgcctgcgggtcgatgccgaggtcgagcgcttccgcggcgccgtctccggggcgttgcgcgcggtcgacgcccgcaccgccgagctgcgccagcgcgccgccgcgatgagcgcggcctcgggcgaggcgcgcggcgccgtcgagggcgcgctcgcgggctcgcgcgagaccgccaccacgatccagggcgtggccagcgccgccgaggagctgtcggcctccgtgaccgagatccgcgaccggctcgaccgggccgaggccgaggtctccggtacggtgcaggaggccgccgccacggaggcgcaggtgggcgagctcgccagttcggccgcccgcatcggagacgtggtggcgctgatctcgcagatcgccggtcagacgaacctgctggccttgaatgccacgatcgaggcggcgcgcgcgggcgaggccggccggggcttcgcggtggtcgccgccgaggtgaaggagctggccaaccagacggcgcgggcgaccgaggagatcgccgcccaggtgggtcgcgtccagggtgcgaccggcagcgccgtcgaggcgatcggccggatgaccacccgaatgggcgcgatcggcgtcgcgaccgccgacatcgccggggcgatcctggcccagggcgcggccacggacgagatcgcccgcagcgtcggcgagacggcgggcaccagcgcggcgatcgcccgggagctcggcacggtctccgatgcggcccggcagaccgccgacacggccgccgcggtcgagcaggccgcgggctccgtcgagaccgtcgcggcggggctggaggccgagatcagccggttcctgacggcggtcgccgcctga

SEQ ID NO: 7546 - DNA, 774 bp, Methylobacterium sp.
atgacctacgagaccatcctcaccgagacccgcgggcgcgtcctgctgatcaccctgaaccgcccgaaggcgctcaacgcgatcaaccggcagttgacgggcgaggtgatcgaggcggtgaccgccgcggatgccaatcccgatatcggcggcatcgtgatcaccgggtccgagaaggccttcgcggccggggccgacatcaaggagatgcaggcggcgacctacgccgagatgtacgcgggcgaccgcttcgccgattgggagcgcttcacggcggcgcgcacgccgatcgtcgcggcggtcgcgggctacgcgctcggcggcggctgcgagctcgccatgatgtgcgacttcatcctggccgccgacacggcccagttcggacagcccgagatcaagctcggcgtgatgccgggcatcggcggcagccagcggctgacccgcttcgtcggcaagtcgaaggccatggagatgtgcctcaccggccggatgatggacgccgccgaggccgagcgcgcggggctggtctcgcgcgtcgtgccggccgccgagctcatgggcgaggcgatgcgggtcgccgagatcgtcgcctccatgtccctgccgatcgcccagatgaccaaggaggcggtcaaccgcgcctacgagacgacgctgaccgagggcgtgcgcttcgagcgccgcgtcttccacgcgatgttcgcgacgcaggaccagaaggagggcatggccgccttcgtggagaagcggccggcccgattcacgcacggctga

SEQ ID NO: 7547 - DNA, 789 bp, Methylobacterium sp.
atgcgtctgtccaaacgcggccttctgctcgccctcgcgctgaccccgctgctcgcgggcgccgcggtcgcgcagaaccagctcgccaccatcaccgagaccaaggtcgtcaagatcggcgtcccgaccgattacccgccctacggcttcgtcggcgtggacctgcagccgatggggctcgacgtggacgtcgccaacctcatcggcgccaagctcggcgcgaaggtcgagctcgtgcccgtcgtcagcgcgaaccgcatcccctacctgcagacccgcaagatcgacctcatcgtctcgacgctgggcaagaacgaggagcggcagaagatcatcgacttcagcgtcgcctacgcgcccttctaccaggggatcttcgctccgaaggggacgagcatcaagagcttcgacgatctcgccggcaagaccgtcgcggtgacgcgcggcgcgatggaggacgagatgctggccaaggtcgcgccggcggcgaccgtggtacagcgcttcgaggatcaggcggccaccaccgcggccttcgcggccggccagacccaggcgatcgccaccagcgtctcgaatatcggcgtcctcagccgcaagaaccccaatctcggcgccgattacaagctgctcctgcgcgacagcccctgcttcgtcgggatcgccaagggcgaggacgccctgcgcgcccgggtcaacgagatcctgctcgccgccaaggccgacggcacccttgaggcgctcgcgcagaaatggctgaagcgcggcacgggcgacctgccgctctga

SEQ ID NO: 7548 - DNA, 351 bp, Methylobacterium sp.
gtggcgcggccgggccggatccgcctgggctcctgcgaccttctcggcgatctctccggcgaccggcccctgctcccggtcttggcgggcgggcagcacctgctcctcgtgcgcgacgccgggcggatcctcgccgtcgagcgggcctgcccgcacgagggcgccgatctggcggccggccgctgtggcgccggacggctgttctgcccccgccatctcgcttcgttcagcctgcgcgacggctccgtctccccgggctggtcgttccgtcccctgcgcgtgttccccgtcgcggtcgcggccgacgggctctgggtcgagacgggccccgggccgcaccggccccgatag

SEQ ID NO: 7549 - DNA, 840 bp, Methylobacterium sp.
atgagcccgatcctctcggtcgatcatgtcggcgtgcgcttcggcggcctcatcgccatcgccgacctgcatttcgacgtccacccgggcgagatcgtcagcctgatcggtccgaacggggccggcaagaccaccgccttcaacgtgatgacgggcttcctcaagcccagccagggcgcggtgcgcttccgcggcaccgacctgaagggcctccagccgcacgagatcacgcggctgggcctcgcccgcaccttccagcgcaccagcgtcttcccggacgacacggtgttcgacaacgtgatgatcggcctgcaccggcagggcgcctccggggcacccggcatcggccgcgcgccgctcctcgacgcgctcctcggccgcgccggcgcgagcgagcgggcgctgcgcgagcgcgcggcgtccctcctcgactgggtcggcctcgcctcccgggccggggagcgggcgggcgccctcgcctacggcgagcagcgcctcgtcggggtcgcgctcgcgctcgccaccgagccggccatgctgctcctcgacgagccggtctcgggcatgaacgcctcggagaccagggtgttcgtgcgcctgatccgccagatccgcgagcgcggcatcacgatcctgctcgtcgagcacgacatgccgatggtgatggaggtctccgaccggatcgtcgtgctgaactacggccggctgatcgccgagggcccgcccgaggcgatccgcagcgacccggcggtgatcgaggcctatctgggccagggcagcgctgcccgccgcgccgccgccgaggccctgagttccgtgagcgaggcggcccatgcttga

SEQ ID NO: 7550 - DNA, 942 bp, Methylobacterium sp.
atggttggctttctgctcaagcggatcggcgcaacgatcccggtcatgggtttcgttgccgtattcgtcttcctccttctccacctcacgccgggcgatcccgccgctgtgatcgccggcgacaacgcttcgccggaacaactcgaacggatccgcctgtccctgggattgaatgagccgctgccgatccagtttctccactggggctggaacgtgatccggggcgatctgggcacgtcgctcatctctcaggtgcccgtcctcacgatgatcggccagcggctcgagccgaccctgagcatcgcgctctgcacgatcatcgtagcggtcgggatcgccgttcccctcggcgtcctcgctgcctggaagcacggaacctgggtggacaccctcgtgatgtccctttccgtcgtcggcttctcggttccggtcttcgtcgtcggatacgtactcatcaaggtgttcgccatcgatctccggatcgtgcctgttcaaggcttccgctcgatcggcaacggcgtcggcccgttcttggagcgtgccgttctgccgacgtcggctctcgccttcatctacgtcgccctgatcgcccgcatgacgcgggcgagcatgcttgaggtcatcggcgaagacttcgtccggacggcccgggcgaaaggcatctcggagggacaggtcctcgtgcgccacgtcctacgaaacgcggccgttccgatcatcacgatcatcggtgccggcttcgcgctgcttctctcaggcgtggtcgtgaccgaaagcgtcttcaacatccctggcctcggacggcttacggtggatgcagttctggcgcgagactatcctgtgatacaaggaatcatactcgtcacgagcttcgtatacattcttataaatctgttgatcgacgtggcctatacgttgctcgatccgaggattcgctactga

SEQ ID NO: 7551 - DNA, 609 bp, Methylobacterium sp.
ttggacgaggacgacgaggcagcggtggagcgctgcaatcaggcctgtgacgccgatgccgaggccagcaaggcgctggcggaggtgctgcccaccacgcccgcggggctgatcgcactggtggccttctacgccgaggacggagaggggaccgacacggcctcgctctacctcgaccggttgctggccgttctgaagcaccccgattccggacggctgtttgcgggctcgaatccgaagattgcaacaccggatcaggggcttggccgagtgattccgcaggccggttttgaggtcttgcggacgatgcccggaccctcggacatcgaggcggcttggcatggtctgccggccgagacccgcgaccgcatcggcatcatcgccgtcgacatggtgtttcagggcttcgtttacggcgacgtctacgtggtcaacgggacgcccgaggatcgggcggtatccgatgaggcgatccgcggggccgcagcagaggccgaggatcgacgcctgaacgagctgcatagcgtcgtcgaggccgtgctgcccgacctgttcggaccagagggcgagaacccggcgtggtgcgagaacccggggccacggccatga

SEQ ID NO: 7552 - DNA, 507 bp, Methylobacterium sp.
atgcacgacacatcgccgaagcctgagcgcccggatcccggctactcgcaagaggactgggacgaggtgtccgacaacccggagctgaccgatgccgagctggccgagatgcgcccggcccacgaggtgcccgaggtctacaacctgctccccaagcgcgggcgtgggcggccgaagctcgccgacgccaaggtgaacctgacgctccgcatcgatccggccttactcgacgcctacagggcgaccggcgcgggctggcaggtgctgatgcacgaggctctggccgcgggccgcccggagatggacgaggccgaggcgatcgaccaagccgcgcgtcggaccgccaagcagaaggccgcggatgccagggccacccgcagcgggtcctatgaggtggtcgggccgaggagtggcaccgtcgcctccgggaagagcagcacgcgggccggcgccctctcctcgtccagcacggcacccggcaagcggccgggcaagaagtcggcctag

SEQ ID NO: 7553 - DNA, 318 bp, Methylobacterium sp.
atgccgaagcctgagcacgcccccggctacgtgccgaacgctgcctacacgcaggcggattgggatgcggtgtcggacaatcccgctttgaccgacgccgaactcggccaagcccgccggggcaccgacgggatgccgcccgcgattgcggcagccttccggcgcgggggacgcccgagatccgaacagcgcaaggtgccggtcacgatccggctcgatgccgagatcgtggaggccttcaaggcgacgggccccggctggcagacgcggatgaacgacgcgctccgccgggccgcgtgcgacctggacgcggcctga

SEQ ID NO: 7554 - DNA, 435 bp, Methylobacterium sp.
atggagaccgcggacagggagcccgagggcggctttgccccgctcgctccggagctggacgtcacggatctcgacgcgagcctgcgcttctggtgcggggtgctgggcttccgggtcagctacgcccgcccggaggacggcttcgcgtatctcgaacgggcgggcgcgcaggtgatgctgtgccgccgcaacgggaactgggatacggcgccgctggaacgtcccttcggccgcgggctgaacctgcagatcgccgtcgcggcgctcgatcctctgctcgagctcttgcgggcggcgggctggccgctgtttcgcgaaccgcacgcggcgcgctaccgcgtcggtgacggcgcggtattcctgcggcagttcctcgtgcaggacccggacggctacctgctgcgcttctccgagcggctgccgcctcagccctga

SEQ ID NO: 7555 - DNA, 234 bp, Methylobacterium sp.
atgaagaacgtgaccgtgaccatgagcgaggcgctgctgcagcgggcgcgggtcgcggccgcgcgcgacggcaagagcctgtcgaagttcgtcgccgaggccgtggagcagcgggtcggccggccgatgacgcagcttgaggcgatcgaacgcttcctggccggaccgcctctccatctccttgacgagaacggaaaggccccgacgcgggaccagttgtacgatgacgagtga

SEQ ID NO: 7556 - DNA, 294 bp, Methylobacterium sp.
atgtccaaccgctctctgtcctggaacgccgccctccggtctctccacgcggaccgcgtcgccatccctgccggcctcgctggtgcccgcgcaatggtccagaccttcgcccgcacccgcgccccgctcgttgttgctggccggttcgaccgcaaggcgatcatggcccacgccgcggccgccgcgaagctgcatcagggccgctacggctcgacctgggccgaagccatgtccgttgccctccgtgccgcatggcaggccgcccacgccgcccgccgcgcgaccgcgcactga

SEQ ID NO: 7557 - DNA, 1341 bp, Methylobacterium sp.
atgtccgatacgagccatacggctcgcaccgaggaggcggtcgtcggcgagctgcacgacctgattgcttggctgcgccagcgcctgcgcggcgagcacacggtgcgggctagcgtgctgaacgtcgagccgaacgggcctgacagccatctcattctgctgggcgaggcggagacccgcctcacgaacgatccgcctcggctgaaggcccggttggatgccgcagaactcggcgatatccgggctgcgcatggcctggacttcgatccggtcagcctcgtcaaccgcaccgtcacgctcaccttgcgcacgagcctgcgccagcgcttcggtcggggggccggcgtccaggcgaaggtcatggcgctgcgctcggtcgggcaggtcccgctcgaggccgatctcgagcgtgagcgcacgctgcagcggctgcggctggaggggcggcgctttggacccgacacctggaacgagcccgacgatccgcgccacatcgctctcgtcgtctccgagcacggcgacgtgcgccgcgacgtcgagcacgtgctgcagccgctggaggaggctgggctcatccagatccaccgggtctgggcgatgttcgagggggcaggggctgagcgctcgctcgccgaggccttcgcccaggtagcgagcctgcagcgggagcacggactgtcggcgacgctggtctgccgaggcggcggtccggtcgaggcatttcggcctctcaacgccttcgtgacagcgaacgcggccgcagcggccgaggttccgaacctgatcaccggcctcggccacgccggcacgccgcgcaccgcgctcgatgcggtggcggcgcgctccgaaccgactccgacggcggcggcgatgctggtgcgcgggctcgtcgagcgcaccgggatccgggccgagcgcgcgctcgcaagcctcgatgccgcgatcgaggaggagttggaggtggcgggccgcatcaccctggctcgggtcgcggctgccttcgacacggcgctgagggatctcgccgaccgagccgacgaacggctgcggcagctcgaccgtggggtcgagcggagcctgttcgccaatctggccgtggcggccgcaaaggccgagccgccagccgatgctgctgagaccgatggcctcggcgctatcgaggacgacgtcctcctgagcgatgccctgagcctggtggtcgcagccgagagtggccgggtcgtcgtcacagccgagcaggcacgggcggagacagacctgttgctgcacttcccggacggcgccgtacctgtccgggtcgaaccccacatcgcgatcatctctcccgcaaccatgcactga

SEQ ID NO: 7558 - DNA, 1293 bp, Methylobacterium sp.
gtgcacgaactgcgcgacctgatcggctggctgcgccagcggctgcgcggcgaacacagcgtgcgggcctgcgtcctcacggtcgaggccgccggtcccgacagctatctgctcttgctcggcgaagcacaggcgagcctgagctacgatccaccgcgcctgaaggtccgtctcgatgcccccgagctcaacaggatccgaacggagcatggcgttgacttcgatccggccgacctcgtcaaccgtaccatcgaggttcagttgcgcaccggcctgcgtcagcggttcggccgcggagccggcgtgcaggccaagctcatggccctgctctcgctcgggcagatcccgctcgaagcagaaattgagcgcgagtgcacgctgcagcggctgaggctcgaggggacccgtttcgggccggacagctgggtcgagccggaggacctccatcatattgcgctcgtcgtctcagagcacggcgaggcacgccgcgacgtcgagcatgtgctgcagccgctcgaagcggccggcctcctccgcctccaccgggtgtggaccaacttcgagggtgccggggccgagcgcacgttggtcgaagcctttacccgcgttgcgagcctgcatgccgagtatggactgtcggcgaccttggtctgccgcggcggtgggccgatcgaagcattccgtccgctcaacaactacgcggttgcgcgcgccgcgacagctgatcgactgccgaacctgatcgtgggcctcggccatgccggtacgccgcgcaccgccctcgatgcagtggcagcgcgctccgagccgactccgacagcggccgcgatgctggtgcgccacctcgtcgagcgcaccgggatccgcgctgaacgcgcgctcgccgccttcgacgctgcgattgaggaggatctcggggcagccggccgcatcgccctagcgcgagccacgaccgccttcgacatggcgctgcaaaatcttgtcaccggggccgaagcacgactgcgacagctcgatcgggccgtcgagcagagcctactgctgggattgagcgcggcagtcggcgggatcacgcggaaagaaccggatgccgatcccgtcgaggtggatcccctcggtgacaccgaggacgacgcagccctgagcgcagccctggtgctggtgatcgcgaccgatacgggctgcatcgtcaccagcgcccaggatctctcagcgggtctgccgttactgctgcaattccgggatggcgccgtaccggtccgggtcgaacctttctctttcaccgcccactga

SEQ ID NO: 7559 - DNA, 519 bp, Methylobacterium sp.
gtgaccatcattggggatgtgaccgaggacagcgtggtggacgcgattgaggcggctgagcgtgcggcacagttcgttatcgtggacctggaaggtacggctagcttgatggtatctaatgccatcggcatgtccgacttggtggtgatacctgttcagggctcatccatggatgccaaaggcggagccaaaaccatccgcctcatccgtaatcaggagaagatgagccgtcgcaagattgcccacgccgtagtgctgactcggaccagcgcggctgttacatccagagcgctacgcaacgtctctgagcagctccaggccggcggtattgaggtctttgtcactgccattgtggaacgagcagcctaccgtgatttgtttgactacggcggcacactatctggcatgaatgcatctcaggtcagcaatcttgataaggccatacagaacgctcgggagttttccggcgaggtaatctcaaagctgaaggcgactaccaatccgagggcggctgcgtga

SEQ ID NO: 7560 - DNA, 1236 bp, Methylobacterium sp.
atgcttgacgatcagcggcaggctgcgcccgccgacgcgtccgcgcgccggtccgaggcggacgacgcgcgcgacatcctcgatctccagccgacgggccgcaaacccggtgacgcgggccgcgaggccgcgccggacggcacggggcaatcggccgaggggcaggacggggacgcggacgacgcggacgagaccgaggcgcggcgcccgaacgtgctgcggcgccacccctggtggttcgtgctcggcggcctcgcggtgctggcgctcggcgtcgcgacgttcttctactggcagatctacctgcacccctacgagaccaccgacgacgccttcgtggatgcgcgcagtttcacggtcgcgccgaaggtcggcggctacgtggtggccgtggccgtcaccgacaaccagcacgtgaagcccggcgacacgctcttccagatcgacccgcgcgactaccgggtcgcgctggagcaggccgaggcgcaggtgcaggcggccgaggccgcgatccagaacgtcgacgcgcagatcgcggcgcagcgggcgcagatcgaggtggccaaggcccaggtcgagaccgcgcaggcggcgctcacgttcgccgaggaggacgccgcccgctacaaggcgctcgccgagcgcggcgcgggcacgatccagcaatcgcaatcctcgacctcgaccctgcagcagcgccaagccgcgctggcgagcgccaacgcgaacgtggtggcggcccagaagcagatcggctcgctccaggcccagcgcgccagcgccgaggcgcagctcgcccaggcgaaggcccagcgcgaccaggcccggctcaacctcggctacacgaccgtgacggcggcgcaaggaggccgcgtcgtgcgcctcaccggcggcgtcggggaattcgcgcaggccgggcagagcctgtcgatgttcgtgcccgacgagatctgggtcaccgcgaactacaaggagacgcaggtcaccgacatgcggccgggccagcccgtcgccatcacgatcgacgcctacccggagcgcaggatcaccggccgcatcgcctcggtgcagccgggctccggcaccgccttcagcctgctgccggcgcagaacgccaccggcaactacgtgaaggtgacgcagcgcatccccgtgaagatcgtggtcgacaactggccgaccgacgtctcgatcggcccgggcatgtcggtggtgccccgggcacacgtgcggtga

SEQ ID NO: 7561 - DNA, 516 bp, Methylobacterium sp.
atgcagaagagcttgatcggcatggccgccgctctcgtccttgtgggatgcccgatggcttcagcaggggatgtgtccaccactggcgcagtcggcgagaacgggacgctgaaccaacaagatttcaagatcctgaccgatgctcggatcggcgtcttgaaggccgtgctccaactgacgcccgagcagcagcaatactggccgggcatcgagcaagcgatccgcgcacgcgctgaagcgcgatacagccggctatctactttggtcgggcggctcaaccaagttagcgatgccgatccgctcgcagccattcgcgcgcgtgcggactcgctgaaccagcgcgctgctggcctcacgaagctcgcggatgcatggcagccactgtatcaaaccctcagcccggatcagaagacgcggatgcgggtgatcacagggcgtctgatcggagggctgcggcaggctgtcgagaaccgtcgcagggaccttctcgacgacgactacgaagatgaaggttga

SEQ ID NO: 7562 - DNA, 951 bp, Methylobacterium sp.
gtgcccacgcatcacgagatccccgccatgcccgagacgatggtgctcggctatttcgacgccgcgctcgcgcccgtcctcaccgtcgagtccggcgacaccgtcaccctgcactcgcacccggcgggcgggcgcgagtcgctccaccccgacccgtcccgggtcccggccgagctcacggcggcgctcgacacgctgaagccgggacccggcccgcatttcgtcaccggcccgatccacgtgcgcggcgccgagcccggcgacatgctgcaggtcgacatcctcgacctgaagttccgcctggactggggcttcgtggcgatcctgccgctgctcggcaccctgccggacgagttcaccgactacgagaccgtccacgccgacatcgacgtggcgcgcggcgtctgccgcctgccctggggcacggaactgcccctcgacccgttcttcggcatcctcggaaccgccccgcccgccgcctggggccgggtcggaacgccggtgcctcgggccttcggcggcaacatggacaacaaggaaatgcgggtcggcaccagcctctacctgccggtgttcaatcccggggccggcttctacgcgggcgacgggcacggcgtgcagggcgacggcgaggtctgcatcaccgcgctggagaccgggctcaccggcaccttccggctcaccgtgcgcaaggatctcccgggcgcgtggcccttcgccgagaccccgaccgacctgatgtcgatcggcctgcacgagagcctcgacgaggcgatgcgccaggccgtgcgcgagatggtgcgcctcgtctgcgcgcgcaccgaccacacccgcaaccaagcctacatgctctgctcgctcgccgggaacctgcgcatcacgcagacggtggacggcaacaagggcgtgcacatgctgatgccgaaggcggcgctggctcggaacgcgtga

SEQ ID NO: 7563 - DNA, 618 bp, Methylobacterium sp.
atgacggtgaggatgatcggccgggatccggcccctgcggacacgtcccctcaggtccacatcgccgaggagatccgccgccgccgccgggagcagggcctctcgctggaggccctcgcgacgcgctcgggcgtcagccgctcgatgatctccaagatcgagcgcctcgaagccatcccgtcgacggtcgtcctgtcccggctggccgaggcgctcggcgtcacgttctcgcgcctgatgaccccctcgaccgagcgcgaggtcctgctgatcccggccaaccgccagccgatcctgcgcgacgaggaatcgggctacctgcgccgctgcatctcgccggtcctgcccgggcgcggcatcgactgggtgctcaacatcctgccggcgggggcgagcaccggcgagttcacggcgcacaggcgcggcgtcgccgagtacatcttcgtcctgcgtggccgcctgcgcgcggtgatcggcgagcgcgcggtcgtcatggaggccggcgacagcctgtacttcgaggccgatgccgggcacgccttcacgaatgtcggcccggaggcgtgcgagtacttcctcgtcatcgatccctcgcacgcgcgctggagccgatcctga

SEQ ID NO: 7564 - DNA, 921 bp, Methylobacterium sp.
atggcgcaggatcggcaggacccaccgctcgtccggcgcatcgtcgcggtgagccgcacggtggcggatctcgggcggacggaggccttctaccgcgacgcgctcggcttcgcggccatcgcgccgcccgagccggtgccggagccgatccgcgcggccctggggctcaccggcaccgccgcgcggaggcttcggatgcggctcgggcgtcagacgctcgccttcctctgcgtcgatccgcccggcgcgccctatccggcagccgcgggcgcgaacgatccggtcttccagcatgtcgcgatccccgtgcgcgccatggagccggccgccgcgcgcctccgcgcccatcatccggccccgatcagcgcgggcggcccgcagacgctgcccgcctcctccggcggcgtcaccgccttcaaggtccgcgatccggacggccatccggtcgagctgatcctcttccccggcggcgcgccggcccggcgctggcgcgacgcgccgggcctgttcctcggcatcgaccactcggcgctcagcgtcaccgatctcgaccgggcgctcgcggtcttccgcgacgccctcggcttccggctggccgagcggggcctcaaccggggcgcggcacaggcccggctcgacggcctccccgatccggaggtcgacgtgctcgccctggagccggcgggcgcgggcacgccccacctcgagctgctgcactaccgccgcccggccgcaccgcccggcccggcgccctacggcccccgcgaccgcgccacgagccgcctcgtcctcgcggtgcgcgacctcgacgcggcggcggacgcgctcgccggagcgggctgcccggtgcgccgggcggacggtatcgcctacgcggtggggccggacggccacgggctgctgctggtgccggaggcgtag

SEQ ID NO: 7565 - DNA, 903 bp, Methylobacterium sp.
atggacggtttcgagttcacgcagagccgcttcaagagcttcgtcctgcccaacgcgccgctggagacgctggccgagggcttccgctggtgcgaggggccggtctggttcgcggaccgggacgagttgctgttctccgacctgccgaacgaccgggtgatgcgctggagcgagggcggcggcccgagcgtctaccgcgcgcatgcgggcttcgagaacggccacgcccgcgaccggcaggggcggttgctctcgtgctcgcaccggctgcgccggatcgcccgaacggaactcgacggcagcgtcacggtgctggtcgattcctatgagggcaagcggctcaactcgccgaacgacatcgtctgcaagtccgacggcacgatctggttctcggacccgccctacggcatccagaccgattacgagggcggcaagcaggtctcggaactgccggccaacctctaccgcttcgacccgcgcgacggctcgctcaccgtcgcggcgggcgatttcgagggcccgaacgggctgtgcttctcgcccgacgagcgcaggctctacgtggccgagacgggcctgcagttcgctgagaatccgacgcgccacatccgggtcttcgacgtcggcgaggacgggcggctgtcgaacccgcggatcttccacacggtctcgcccggcatggcggacggcttccgctgcgacgaggagggcaatgtctggtcgagcgcgggcgacggcgtgcacgtcatcgacccgggcggcgcgctgatcggcaagatcaagaccccgaccacggtgtcgaacctctgcttcggcggccgcttccgcagccgcctgttcctctgcgtctcgcacagcctgatggcgatctacgtcaaccggcggggcgcggcgctggtctga

SEQ ID NO: 7566 - DNA, 1038 bp, Methylobacterium sp.
atgagccggctcctccccctcgcgctccttgccgcgctcgtcgccctgccgctggcgctcggcaccgagccctacctgctcaacgcgctgatcgtgacgggcatcctgacgatcggcgccatgagcctgaacctgctcctcggcttcaccgggcaactcagccttggccacatcgccttcttcggcatcggcgcctacgtgagcgcgctcacgagcctcggcttcgacatcgagatcggcttcggcctccgcgtggtgcacgagccctggccggcggcggtcggcttcctgctggcggtcgtggcggcgggcctctgcggctacctgatcggccggctctccttccgggtgcgcggcgcctatttcgtgatcgtgacgatctccttcgccgaggtggtgcggctcgtcgccctcaactgggtcgagctgactcaagggccgctcgcgctcaccaacatcccggcgatcacgctcggcctgccgggcctcggcagctggacgctgcggacgaagctgcagaactactacctcgtgctcgccgttggcacgctctgctggctcgtcgtcgcgcgcctcgtcggctcgcgcttcggccgggcgatgcgggggctgaaggagaacgagtcgctggcgctgtcggtgggcatcaacgccacccgcaccctcaccatcgcggcggtgatctcggccgcgatggcgggcgcggcgggcagcctctacgcgcactacctgcgcatcatcgatcccgacgtgttcctgttctccaccaccgtcagcatggtcatcatggtggtggcgggcggcaagggcacgctgatggggccggtggtcggcggcctgatcttcggcctcctgccggtggcgctccgccccgtgatggcgccggaggcgcagtggatcgtctacgggctcgtgctcatcgggatcctgttcgtgatgccgcggggcatcgtgccggggctcgcggccctcctcgcccgccgccggccccggccggcggctccggtcctcgatgccagcccgatggtgcagcgatga

SEQ ID NO: 7567 - DNA, 873 bp, Methylobacterium sp.
atggaccaattgatccagcacctcgtcaacacgctgatcctcgggggcacctacgcgctcctcgggatcgggctgaccctgatcttcgggatcatgaacgtggtgaacttcacgcacggcgccctctacacggtcggggcctatctcacctacctcgcggtggcggggctcgggctcgatctcttcctggcgctgccggtcgcgatcctcggcgggctcctgctcggggcgctgatcgagatcgtgctgctccggccgcttcgcgggcaggacatcgacaccaccatgctggtgatgatcggcgccggcatcgtcctgcaatcgggcacgctctggattttcgggggcgtcgccaaggcggtgccctcgccgttccccgaggcgcctctgcagatcggcccggcctccgtctcctggctgcgcctgttcgtgctcggcgccgccctcctgctgatcgggctcacctacgcgctgatcaaccggacgaagctcggcctcgcaatgcgcgccgccttccaggattccgacaccgcggcgctgatgggcgtcaacgtgcgggtcatctacaccgcgaccttcgcgatgggctccgcgctcgccgccgccgccggcgccctgctcggcccggtctacgttgtccacccgcagatggggggcttggccgagctgaaggccttcgcgatcgtgatcctcggcggtctcggcaacgtcacgggggctgccatcggcggcttcatcctggcgctcgccgaggaactcggggccggctacatctcctccggctatcgggacgcgatgggcttcctgatcatcatcgcggtgctgctctaccggccgactggcctgttcgcgaaggcggagcgcatcggatga

SEQ ID NO: 7568 - DNA, 1299 bp, Methylobacterium sp.
atggtcgattcccaccctgatccgcgccgctacgatctggtcctgcgcggcgggcgcgtcatctgccccgcctccggcatcgacggcatccgcgacgtggcgatccgcgacgggcgcatcgcggcggtcgaggaaaccatcctgccctccgccgccacggaggtcgtcgacgtctcgggcaagctggtgctgcccggcatgatcgacacccacggccacgtctaccagtacgtcaccggccgcttcggcctgaaccccgacatggtcggcgtgcgctcgggcgtcaccacggtgatcgaccagggcggtccctcctgcatgacgctcccgggcttccgccacttcatcgcggagcgggccgagacgcgggtgctggccttcctgtcggcctacctcgtcggcggcctggagggacacttctacccgaacctctacagcccggacggcgtcgacatcgacgcgacagtgaagtcggcggtcgagaaccgcgacctcgtgcgcggcatcaagggccatgccgagatcggcggcttcgcccgctggggcatcaaggtcatggagatggccgccgagatcagccggcgggcggacctgccgctctacgtgcatttcggccagctctggggcctgccggaatcgggcgccaacggcgaggacgccgacaccatcgtcgagcgggtgatcccgctgctgcgccccggtgacgtgctggcccatcccttcacccgtcacccgggcggcttcatcaacgaggcgggcgaggtccaccacatcatccgccgggcgatggatgcggggctgaaggtcgatgtcggccacggcagccacttctcctaccgggtcgcccgcgcctcgctgccggccggggtcatcccatacacgctcggcgccgacatgcacggctacaacaccgaggtgcccgaggccccgaagcctgccgggaccccggacgagcaccacgacgacgagaaccaccccttcctcggccaagcccgcttcagcctcacccaggcgatgagctcgatgatggcgctcggcatcccgctggaggcggtggtgccgatggtgaccgcgcacccggccgagatgctgcgcatgagcgacagcctcggcgccctgaaggtcggccgcgtggccgacgtctcggtgctgcacgacgaccgcggccgcttcctgctgcgcgacaacgaggacaccaaggtcgtggccgagcggctgctgcgcccggccttctgcctgcgggccggccggcgcttcgacgccgactcgccgatcctgccccaggcggtcgcggcctga

SEQ ID NO: 7569 - DNA, 519 bp, Methylobacterium sp.
atgctcgtcgtcctggccgccagcgtcgtcttggtgatggtcaccatcctggtgctctacgagacgcttcgcctgacctccgagcacctcgccgagctgccggtgccaccgcgctggcgcatcgtcgccgtggtgctcgccgcctttgcggggcacaccgtcgcggtctggatctatgccggcgcctattggctcctcgtactgaagctggggctcggcgccttctcgggcgtgcccatcgagaccttcgaggattgcctgttcgtctcagtcgttgcctactcgtcgctcggctacggcgaccatgcacccgtcggccacgctcgcctcctcactggcgtcgaggcgctgaacggcctgctcctgatcggctggtctgcctcgttcacctacctcgccatggagcgctactggccgctgcacggcaaagcgcatgtccgccgggccgcgaaggcccgccaccctgcggacgaggagctcggccgcgagcgcctctttccgccagcaaacggcacctga

SEQ ID NO: 7570 - DNA, 399 bp, Methylobacterium sp.
gtgacgctgacgctggcgcgctgcccggagcatccggacggaagcgcggggcgcggctacgacatcgtggcaccactggggcccgacggccgcctagacccggtactctggcacgagacgcgcgaccggtgccgcgtgcgccgcttctggaccggggaccgcgaccgtcacggtcgcttggtgcaccgcgccggcggcgaggggggcgccacttggctgatcgactacgaggaccgcacgacagacgacgacgagttgggctaccgcctcggcacccacgccctcgtagagggcgagtacgtctcgatccgcgaggcgggggacgaggagtatcatacgttccgggtcgcccgcgtcaccgcgaccggcgcgggaggccacgcgggaggctcggcatga

SEQ ID NO: 7571 - DNA, 1044 bp, Methylobacterium sp.
atgacgacgaaccagcacaaagccacgaccccgctcctcgacatcgcctacgaggccggcggtccccccgatggatttcccgtgctgctgctgcacggctggccggacgacgtgcggacctgggacgccatcgtcccggctctccgggcagccgggttccgcacgctcgcgccgtatctgcgcggcttcggcccgacgcgattccgcgggcccgagctcccccgctcgggccagctcgccgccctcggcgccgacctgctcgacctcgccgacgcgctcggtctcggccgtttcgccgtgatcggccatgattggggggcgcgggcagcgtatatcgcggcctgcacggcgcccgatcgcgtcgcggcctgcatcgcgctctcggtcggctggggcacgaacgatcccggccagaccctgacgctgagccagacccagaactactggtaccactggctgatggccctcccacgcggcgaggccctcgtgcgggacgatcgacaccgcttcacgcgccatatctggacgatctggaatccgggctggccggtttccgatgcggccttcgccgcgacgggcgccgcgttcgacaacccggactgggcggcggtgacgctgcattcctaccgcgtgcgatgggggcatgcgaggccggatccgcgctacgccgaactggaggcccgcctcgcggccgatccggtcatccgcgtgccgaccttggtgctgcacggcggcgcggacccctgcaacgatccggcgacctcggagaatcgggacgcgctgttcgcggctgcctaccgccgcgtcgtcttgccggccctcggacacttcccgcaacgccaggcgcccgaggccgtcctggcggagatcctgcctttcctaacccgcgcggtgggccgggcggttcccgcatccgtcaccgaccctgatgcagagggtgcggtgcccgtgcagccgggggggccggcccgctcgctcctgtccgcattcgccgatctgctgagcgcgaagccgccctccctggcgatgcggggcgccggctga

SEQ ID NO: 7572 - DNA, 861 bp, Methylobacterium sp.
atgcggatccaggatgcgtctcgggagggtgccgttcaccgcccggcggacgggcagggcgcgccgcgccgcgccgcgcaggctcggctcggccgctcgggcctcgtgctggccgcaggcctcgccctcaccctcgccgcgccggcccgcgccaacccgctgaccgaggtgccgggcgcgcgggccgcccccgaggaagcccccccgccgcgcgacgccgaggccgcgcgggcggaggccgaggaggcgcgcgccgcgaaccccagcgccaacgcgatcatccgggcgctcgcgcccttcgcggacggcaatccgggcgcgcctgccagaccgctggcggtcgcccccgacgacggcggtccgaccgtgcgggtcgatcccgcccgctcggtcgatctcacggtgttcttcgcctacgacagtgcccgcctgaccccggaggcgcgcatccagctggagccgctgggcgaggccctgcgtgccagggacctggccggccacggcttcctcatcgccggccacaccgacgcgtcgggcggcctcgcccacaaccggcgcctgtcgctggcccgcgcgcgggccgtgaaggcgcatctcgtcgagacctacggcctcgcgccggagcgcctgcgcgtccatggctggggccccgcgcggccgaagaacccggccgcgcccctgtcgcgggtcaaccgccgggtcgaggtcagcctgatcgcgcccgcccgcagcggcgacctccgcttcgtcctgccggtcgccgggcaggcctgcgccggtctcgccgacccgcgcgcccgcgtcgcgctcgacctcgacgatttcgacgcgggcccgacgccgcgaccctgcgccgaatga

SEQ ID NO: 7573 - DNA, 522 bp, Methylobacterium sp.
atggccgagaagagcgacgagccgggcacgctgacgcgcgcctcgaccttcctgttcctgcacacggagcacgcgatctacgcgatcctcggcctgctgctcgccgtgacggcgctgctcgcgctgtacgacgccggccgcctgaccctggaggcgatccaggcccaggggcgggccgcgcagctcctggaggtggtggaccggctgctgttcctgctgatgctggtcgagatcctgcacacggtgcgggtctcgatgcgctccgggcggctgacctgcgagccgttcctgatcgtcgggctgatcgcctcgatccggcgcgtgctggtggtcacgctgcaatcggcggaggtcatgcacagcaaggactggacgccggagaagcaggccctgttccaggcctcgatgatcgagctcggggtgctggcgggcctgatcctggcgatcgtgctctcgatcttcctgctccaccgcgcccgccacgacaaccggcccgccggggaggagagcgcggaggcgtga

SEQ ID NO: 7574 - DNA, 444 bp, Methylobacterium sp.
atgaagccgccgctggcggacgatctgtacgaggcggacttctatgcctggggccgcgcgcaggcgcgggcgatcgcgggcctggaactgcctgcgctggatatcgagaacctgatcgacgaggtggaaacggtggggcggggccagcgggccgcgatcgaggcgcatctgcgcgtgctgatcatccacctcctgaagttccgctgccagcccgagcgcgtgacggtgagctggcgcgtcaccctgagcagccagcgcctgagcatcggccggctcgtcgcacgcagcccgagcctcgcggattatccggcccggatcctcgacgaggcctacggggacgcggtccggggagccgccagggaggtcggcctgccggagagcgcctttccgtccgcgtgtcccttcgctctggcgcagatcctcgatcccggattcgtgccctga

SEQ ID NO: 7575 - DNA, 483 bp, Methylobacterium sp.
atgtcgaaccccgttttcgcgcagcccggtacggccgatctctacgagaccgatctctgcctgtggacggagcggcaggccgcactcctgcgggccggccgctggcgggaggtcgatgccctccacctcgccgaggagatcgagagcgtgggcggctcccagaaatccgagatccgcaaccggctcgtcgtgctgctcctgcaccttctgaaatgggagttccagccggagaagcggaagtatggctggcgcgcctccatcatcgatcagcggcttcagatcgccggcgtgatcgaggtcagtccgagcctgcgcgggtggcccgaccatgtggtcgccgcggcctatcggcaggccgtggtcggtgccgcgagcgagacggggttgcccgagaaggccttccccgcaacctgtccttacgccatctccgagatcctcgacatcggcttctacccgggtctgcccgaggccgatgtcgtgtga

SEQ ID NO: 7576 - DNA, 390 bp, Methylobacterium sp.
atgacccgccacaccatccgcaccgacagggccgccgccgcggtcggcccctacgcccaggcgatccgggtcggcgacctcgtcttcgcctccgggcagttgcccatcgatccggccacgggcgcgttcccggaggggatcgaggcgcagacgcggcaggtgctcgccaatctcgcggccgtcctcgaggcgggcggggcgagcctggccagcgccgccaagacgaccgtgttcctgaaggacatgaacgacttcgccgccatgaacgcgatctacgccgagcattttcccggcgagccgccggcccgctcgacggtcgaggtcgcgcggctgccgcgcgacgcccgcgtcgagatcgaggcggtcgcgctcgccacggaggccgcatga

SEQ ID NO: 7577 - DNA, 546 bp, Methylobacterium sp.
atggtggaggccttcgcccatccggcgggcgctgccgccgcgcaggtgccgggcggcgcgaccggatggtcgggcacgctcctgcacatccatatcgcgcccgcggcgagctacgagatggaggagctccccgagggcctctgcgtcgccggccgcggcatcgagggcgaccgctacttcctcggcgcgggcacctactcgcccaagcccgacgtccgggaggtgacgctgatcgagcaggaagccctcgacgcgctcaaccgcaacgacccgccgctccaggagggcgggctgcgcctgatgccggcggatcaccggcgcaacctcacggtgcggggcgtgccgctcaaccacctcgtgggccgccgcttccgcgtcggcgaggtcatcctgcggggcgggcggctcaacttcccctgccgctatctcgaggaactcctcgggatgccggtctacctgccgctctacaaccgatcgggcctgaactgcggcatcgagcggggcggcacgatccgaccgggcgacacgatcgagctggtggactga

SEQ ID NO: 7578 - DNA, 882 bp, Methylobacterium sp.
atgaccgacctcgccatcgctcggacgcccccgcggcactcctcgacccttgtgcgcatcatgagccgcaagccctgggcgttcgccgcaggcatcgttctcgccacgatcgccgccagcgcgatcctggcgccgatcctggcgccgcacgatccgctaaccctggcaccgagcttgcggcttcgtccgccgagcgagacatatcctctcgggacggacgcctacggccgggacctcctgtcgcgcgtgctctacggcagccgcatctcgctggctgtcggcatcggagcggcgacgctcagcacggctctcggtctgctgctcggtcttctggcaggattcttccggccgctcgacgcgacgctgatgcgcatggcggacgggctgatggccattcccgccatcctgctcgccgtcgccgtggtctccctgtccggggcaagcctcgcctccgtcctcatcgccatcacgctgccggagatcccgagggtcatgcgcctcgtccgctcggtcgtgctcctcgcgcgggaacagccatacgtcgaggcggccgtctcgctcggaacgcggacgccccgcctcctccggaagcacatcctgccgaacacgatcgcgccggtcatcgtgcaggcatccttcatctgcgcctccgccatcctgacggagtcggcgctctcctttcttggggcgggcatcagcccgacgacgcctacatgggggaacatcatggccgatggccggaccttctttcagctgcggccgtcgttgatcttctggccaggcctgttcctcgccgtgaccgtgctctcgatcaacatcatcggtgatgcggcgcgcgatctgctggatccccgaatgaagcagagggagacgggcctgtga

SEQ ID NO: 7579 - DNA, 924 bp, Methylobacterium sp.
atgaagcaactcaccagatccctgcccgccgccctgctgctgatcgctctcgccgcaccggccgccgccgaaacgaaattcaccctcttgatgtcggaggtaggcgatcccttgctcgacagcctgcaggcggccgtcctcaacacggcgacctccaagttctccgcctcggtcgatgtggcgcaggcggccggtaacgggggaacccaagtggtccagggtcgggccgccctcgacgcgaagccgacagccctgatcgtcaatcccgtcgacgacgccagcgccaggacgatcaccgagatggccgcggcggccgggattccggtggtgttcgtgaacaagcgcccgagcggtccggcggcccataggatggcgatcgtcagcgcgaaccaccttgtcgcaggtcgggttcagatgcgattgctcgcgcagggtctcggggatcgcggcaacgtggccatcctgcgcggcaaggacagcgacaacgccgcccaggagcgcaccgccggcatgaaggagatcctcgggcaacggccggggctgaagctcctggcggaggcgagcgccgattggagccggcggcgggcgcaagatcaggtgacggcatggctgcgcagcggcctgaagcctgacgccatcgccgccaacaacgacgagatggcgctcggtgcggtggccgccctcaaagcggccggcctgtcgggcaaggtcttggtcggcggcgtcgacggaacctcggacgggattgcggccgtgaagagcggcgaattgttggtcagcgtccttcaggatgcgccgatgcagggggcccaggcggtgaacgatgccgtgaagctcgcccgcggagagtacgtgcagccctacgactgggtgccccatcgattgatcctgccggcgtccggcgacttggcaaacggacgatga

SEQ ID NO: 7580 - DNA, 879 bp, Methylobacterium sp.
atgagcgcccaagccagccggcgcgagccggaccggccggacccggtggtcacggatggtgatttcgcgaagtttcgcgacttcttctaccgcaagaccggcatcatgttcgccgacaacaagcgctacttcgtcgacaaacgcctgcaggaacgcatgctggctgccggccagcccgggttccgcgactacttcaacacgctgcgcttccaggcgagcggcgccgagttccaggcgctcgtcaatctgatgaccgtcaacgagacctatttctaccgcgaggagtaccagttccgctgcctcgtccgctcgatcctgcccgagatcgcccgcgcgaaacgcccgggcgagccggtgcggatctggtcggtgccctgctcgaccggcgaggagccctactcgatcgccttccagctcctcgacaactgggcggacgtcgaccgctacgacgtcgagatcgtcgcctccgacatcgacacgaccgttctcgatcaggctcgggccgggctctacggcgaccggtcggtgcagcacgtgcccaagccgaccctcgaacgcttcacgcggcggcggcgcggcggctacgaggtgatcgccgacatccgcgactcgatcgccttcacccgcgtcaacctctccgatccgctctcgacccggcagttccgcgatttcgacgtcgtgttctgccgcaacctgctcatctacttcgacgacgagtcccgccgcgaggcggcgcagacgatctacgaggcgctcaatccgggcggcttcgtctgcctcgggcactcggaatcgatgagccggatctcgtccctgttcgccatccgcaagttcccggaggcgatcgtctaccagaaacccctcagcgccgaggcttga

SEQ ID NO: 7581 - DNA, 345 bp, Methylobacterium sp.
atgaccacgttcgacgagcgcgagcaggccttcgaacgccgcttcgtgcaggacgaggagcagcgcttccgcgcccgtttcaggcgcaacctgctcctggcgacgtgggcctccgagcggatgggattggggaaggacgcagccgcgcgcttcgtcgaggacttcaccgaccgaggggtcctgatcgccgacgagccgctcgtcgccgagctgcaggccgacctcaaggcgacgggcgtcgaggagacgctgcccgcgctacgcacggagatggagcgctgtgccgccatcgcccgggccgagcagcgcgtcgggcttgcgctggatcaaggccggcccgtctag

SEQ ID NO: 7582 - DNA, 258 bp, Methylobacterium sp.
atgagccacgaactcaccgaacccgtgcactggcaggggcggcaatgggccgtcaccggctacggcatcgaggcgctcgacggaatgtaccacgtcccgttctccgacatcccggacgccgatgccgccccaccccggtggctggacgacctatgccgccgctacggcaccgaccgcgacgacctcgcagcggccctgcgagtggcgcgcgcagtgcgtccgagggccgaggggacatcggcgaagtcggctgcatga

SEQ ID NO: 7583 - DNA, 1119 bp, Methylobacterium sp.
atgactcgcgaggccggcctcgccagcctcgtcgccatcaccgaccgcctcgggccacgctacgccgctgagcgcaataccgcacccggccctgatgcggacacgacaacctcggcgctttccccctacctgcgccgccggctgatcaccgagcaggaggtcgtcgccgtggctcgggaggcgcatggcgcggccgcggacaagttcgtctcggaggtgttctggcgaacctacttcaagggctacctcgagacccacccggcgatctgggccgactacctccgcctcgtcgctgagggcgagcagcaactcgcggcctcgtccgggttgcgccgcacctacgagcgagccgtcgagggacagactgggatcgcgggcttcgacgactgggcgcgcgaactcgcagagaccggctggctgcacaaccacgcacgcatgtggttcgcgtcggtctggatcttcacgctgcgcctgccctgggcgctcggcgcggcctttttcctgcgccacctgctcgacggcgacccggcctcgaacacgctatcctggcgctgggtggcggggctccacacgcgcggcaagcactacctcgcccgtgccgagaacatccggcgctacaccgatggccgcttcgatccggcgggtctcgacgagcaggccgcgccgttgagcgaggcggaggtcgccccagcggtgccgctggcgcctgccgatcccgtgccagccggcccggtcgccctactgctccatctcgacgacctgcacccagaaagcctgccgctcgaatccgtccaagtcacgcggatcggcgggctgctcgcccacgcaccgggcgcgagcgaggcggcgcgggcggccgacgcggcggcgatggcggacgccctggctcgcgcgggggcacacttctcctgcccagccggactggctgatgctggctggtcgggcgacctgccggtggtcagcgcctgggcgccgatcgggccgagtgccgcggccttgccggccggggttctgcagcttcggcgaacctgggacgaggcgagttggccgcacgccacacgcggcttcttcaagatgcgcacggccatcccgcgcatcctcgacaccgtcgcggcgtag

SEQ ID NO: 7584 - DNA, 1209 bp, Methylobacterium sp.
atgcaggccggacgaccggatgaagcgcggaccgaggtcgcgatcgtgggcggcgggttggccggctcgcttgccgcggccatgctcggccgggcgggccgcgacgtcgtcctgatcgatccgcacaccgtctacccgccggacttccgctgcgagaagctggagcagggccatctcgaggtcctgcgccgcaccgggctggcgcaggcggtgatccgggcctcgacccacgccgacaccctctggatcgcccgattcggccgcgtcgtcgacaaggtgcccttcgaccagtacggcctcgcctacgacgggctcgtgaacacggttcgggccgagatcccaccctccgtccggatcccgcggacggtcgcgcagcggatcgagcccgatccgctgcgcccgcacgtccacctcccgggcggcggatcgatcgaggcgcgcctcgtgatcctggccagcgggctgaactggaccctgcgcgaggcgctcggcatccgccgggatctcgtcagcgcctgccactcggtcacgatcgggttcgatctcgagcggaccgacgggcaggccttcgccttcccggggctgcagtacaatcctgagcgctacgaccaggggctcgcctacctgaccctgttccggatcggcgccggcatgcgggcgaacctattcctgtaccagcccctgcggagcccctggctggcgcagttccgggccgctcccgacgccgccctgcacggtctgatgccgagactggcgggactgatcggcgcctatcgggtggcgagcccggtcaaggtccggccgacggatctgcacgcgtcgcacggcatcgagaagccgggcatcgtgctggtaggcgacgctttcgcgacaccctgccccgccacgggcagcggctccctcaaggtcttcaccgacgtggagcggctctgcaatcaccacgtcccggcctggctcgccacacccggcatgggcgtcgagaagatcggcaccttctacgcggatccggcgaagcgggcctgcgacgctctctcggtcgccaaggccttcgatctgcgggcgctctcgaccggctccggcgtcgcgtggtcgctgcggcgctggctgcgcttctgcctgcgtctcgcgcgctggaacctgcgccgcgccgtgcgcgtgcgccccgtccgggcggagcgcaccgaggtgcgcggtgccgacgtgacgtga

SEQ ID NO: 7585 - DNA, 2283 bp, Methylobacterium sp.
atggcacaaccggaccgccccgatcccgcgtccgacccgtcgctgctcggacacccccatatccgcgtggacggcctcgggaaggtcaggggcgccgcgctctacgcctcggatcgccgctttccgaaccgcgcgcacgcggccctggtgaccagcgcgatcccgctggggcgcgtctccgggatcgcaaccgacgcggccaccgcgcttcccggggttctcggcatcttcacgcaccgggatttcgccggcgcgatccgtcccgtgaagcacctgatggccggcggccacgccaacagctcgcacctgccgctgggctccgaccggatcgcctatgcgggccagatcgtggcgctcgtcgtggcggagacggtcgaggcggcgcaggccgcggcggcgcgcgtcgatgtccgctacgagccggaggcctttgcggcgaccctcgacgcgcccggcgccgagcccgtccgcctcgccgatctcaaggagaagcaccgcgacccgcgccggggcgacgccgacgcggcgctcttcgccgcggctcaccgggtctcggcgctctaccggacgcccgtgcagcaccacaacccgatggagctgttcaccaccacctgcctctgggagggcgagcgcctcaccgtccacgagccgacccgctatgtcggcgccctgcggcacgggctcgccgaacagctcgggctcgacgccgacaccgtgcgggtggtctccgggccgatcggcgggcatttcggctcgaagctcgcgctctcgcagcacacggcgctggtcgcgctcgccgcgcgccgcctcggccgccccgtctcgctggtgccgacccgccggcaatgcttcaccatcgccaaccaccggcccgagacccgccacgaggtccatctcggcgcggaccgcgcgggccgcttcaccgctctcgtgcacgaggccgacatgggcgcctcgcgcttcgaccccttcgccatggaggggacggacgtcaccgcgagcctctacgcctgtcgggcgatccgcacggaggagcgggcggtgcgcctcgaccgcaacacgcccgggccgatgcgggcgccgccggaggtgccctacctgttcgcgctggagagcgcggtggacgagatggccggtctgctggggctcgacccgatcgagctgcggcggcgcaacgacaccgacacggatccggtctcgggcaagcccttcaccacgcggccgctgatccgctgcttcgaggccggcgcgcaggccttcgactgggggcgccgccgcgccgggccggagcgggacggcccctggcgcgtcgggctcggctgcgcgtccgcggtgcgcccggtcaagatctcgcccgccgccatgcgggtggcgatcgccccggacggggcggtgaccgtcgagaccgcccaccacgagatcggcaacggcatcaccacgctgctcgccatgggcgccgccgactggctcggcgtgccggtcgcgtcggtgacggtccgcctcggcgacaccgacctgccgccggccggcctctcgggcggctcctccaccacgacgagcctgatgaacgccctcgatcaggcctgccggaccctgcgggagcgcctcgcggcgcgagccgcggcggagggcggggcactcgcgggctgcgatcccgccggtatccggctcgcgggcgggtcgctctccgcgcccgacgggcgccgcgtggcgctcggccgggcggtcgccggacacggcccggccgggatcgagaccgtcgctcagttcgtgccggacggcggcgggccggacgatctcgcggctgtgcgggccggtcacatcgctctgggcaccgggggcggggccgccctgtcctgggccttcggcgcgcagttcgccgaggtgcgcgtccacgaggagacgggcgagatccgcgtcgcgcgcctcaccggcgccttcgcggcaggccgggtgctcaatcccctgaccgcgcggagccagctcaccggcggcatgatctggggcctgggctcggccctgctggaagagacggtggtggaccgcggcacctatccgaacgcggatctcgccgagtacctcgtcgccaccgcggcggacgcgccgcccgtgatcgaggcgatcctcgtgcgcgacgacgatgcgggcgtgaacgcgctgggcgtcaagggactgggcgagctcggcatcatcggcgtcaacgcggccatcgccaacgccctgcaccacgccaccggccgccgcctgcgccgcctgccgatccgctgcgaggatctgctctga

SEQ ID NO: 7586 - DNA, 699 bp, Methylobacterium sp.
atgagccgcctgaacaagcgccagcgtctgaaggtgcgccgtcagcgccgagccgagcggctggccgcccgcgccgccgggatcttcccggccacctcatcctccacggccaggagagcgacggccgccgagcccatccgcggccgcgcctccgaggtaatcgacaccaccctcctctggcacatggcccgtacagccccaaggatgggcgagcgcgcccgccgggccctgcgggagatcgaggttgcgacctttctgccccgcgcctccgaggtcgtggtgcgccgcggccgccgcgtcatccgccacaccccgctgatcatccgtaccgtcttcatcggcgtgcgggacgaggcgcatctggccgaggtccgctcgcagcccggcatcgccgagatcgtgtcgcatccggagaccgagggcggcccggccggaaacgtccagcagatcgtgcgccgcccggcgcggctcgacccggaggacctgcagcgctttgtcgatgccctcgcagccggcgagatcgtccagccggttggcgtccgggtcaaatccgcggtggtggtgatgaccgggccgttcgcgagcttcccggcgatcgtcgaggcgatcctgccgggcgatcgcctgcgggtggcggtcagcatcttcgggcggccgtcgcgcgtggaactcgggatggcggacgttcaggctgtttga

SEQ ID NO: 7587 - DNA, 528 bp, Methylobacterium sp.
atgtccctctacgcgctcgacggtcacgcccctgtcctcgccgacgacagcgtctgggtcgcgccgggcgcgcacgtgatcgggcaggtgcatctcggagcgcgggcgagcgtctggttcggcgcggtcctgcgcggcgacaacgagccgatgcgggtgggcgtcggcaccaacatccaggacggggcggtgctgcattccgaccccggcttcccgctgacgatcggcgacggcgtcaccgtcgggcatcgggcgatcgtccacggctgcaccatcggcgacggcacgctgatcggcatgggcgccacgatcctcaacggggcgcggatcggccgcggctgcatcgtcggcgccaatgccctggtgaaggagggggccgagttcccggacggcagcctgatcgtgggcatgccggccagatccgtgcgcagcctcgacgaggcgggggccgccgatctgcggcgcctcgccgagcactacgtcgccaacgcccggcggttcgccgcgggcctcgtccggcaggattga

SEQ ID NO: 7588 - DNA, 948 bp, Methylobacterium sp.
atgaccgcgcgcctgatcatgaagctgcgggtggccgaggccgtgccgaccacgccggacgtggtccatctccgcctcgtccatccgtcgcgtcccgagcttcccgcctggacggccggcgcccatgtcgacctgcgcctgccggacgggcgggtgcggcagtactcgctgtgcggagaccccgccgaccgcgggtgctacgagctcgcgatcaagcgcgagacggccggccgcggcgggtcggcctgggtccacgggaacctcggcccggacgcgacggcgcatgtctcggccccgcgcaacaacttcccgatcgtgccggaggcgcgccggcacatcctcgtggcgggcggcatcggcgtgaccccgctcctcgcgatggcgcgccagctcgccgcgtcgggggccgatttcgcgctgcatctctgcgcgcgctccgccgcggaggcgccgctcctgcgggccgcgcacgcggtctgcggccggcgcctgacctgctggttctcggccgagggccggcgcttcgacccggccaccatcggggagcccgcggacggcacccacatctatgtctgcggcccccagcgcctgacggacgcggtccggtccgcgctgacggcgcggggctggccggacgggcggatccacagcgagcacttcgccccgctcgacgacgcgaccttcaagccggagcctttcgaggcccggatcgcctcgaccggacaggtgctccacgtcccggccgagcgctcgttgctcgacgtgctgcggggggccgggttcgccatgccctcgtcctgcgaactcggggtctgcggctcctgcgagtgcgggtaccgggacggcctcgtcatccaccgcgacgtggtcctcccgccggccaaacgccaggaccggctgatgccctgcgtctcgcgcgcccgggtcgccgtgacgctcgatctctga

SEQ ID NO: 7589 - DNA, 1077 bp, Methylobacterium sp.
atgaagacctacaccatcgccgccatcccggccgacggcatcggcatcgaggtcatcgccgccggcatcgaggtgctcgatgcgctggccgagaagaccggaagcttcagcttcaagttcgatcacttcgactggggctcggactactacaagaagcacggcgtcatgatgccggcggacgggcgcgagcagatccgcaaccacgacgcgatcttcttcggcgccgtcggcgcgcccgacgtgccggaccacatcacgctctggggcctgcggctcgccatctgccagcccttcgaccagtacgcgaacgtgcgcccgacccggatcctgccgggcatcaccagcccgctgcgccatgtctcgggccccgagctgaactgggtgatcgtgcgcgagaactcggagggcgagtacgcgggcgtgggcggccgggtccaccagggccatcccaacgaggtcgccaccgacgtctcgatgatgacccgctcgggcgtcgagcgcatcatccgcttcgccttcaagctggcgcagtcgcgcccgcgcaagctgctcacggtcgtcacgaaatcgaacgcgcaacgccacgcgatggtgatgtgggacgagatcgcggccgaggtggcgcgggactttcccgacgtgacctgggacaagatgctggtcgatgccatgaccatgcgcatgacgatgaagcccgagacgctcgacaccatcgtcgccacgaacctgcacgccgacatcctgtcggatctggccgccgcgctcgccggctcgctcggcatcgcgccgaccgccaacatcaacccggagcgcaccttcccgtcgatgttcgagccgatccacggttcggccttcgacatcaccggcaagggcatcgccaacccgatcgcgaccttctggacggcgtgccagatgctggagcacctcggcgagcagcccgctgccgaccggctgatgcgcgccgtcgagcgcgtgaccgccgatccgaacctgcacacgccggatctcggcggcagggcgacgacccgccaagtcacggacgccgtcatcgcggccgtgcagggcgacaacgagtaa

SEQ ID NO: 7590 - DNA, 1860 bp, Methylobacterium sp.
atgaagcagctcggtcgcctcaacgaggagaaccggcgcaaggcgcggaccttcgccaagcagcagaaggcggccgagcgcatcgccgcagcgacggctcagctcgccagcggcgtcgcggaggcctcctcggcggccgaggagctgcgccgcgccatggagcagatcgcggcgggcgccgagcaggccgcgagcgcgtccgagcagtcgcagcgcgccgtcaccgtggtctccgaggcgatcggcaccgcgcggagcgaggcggaagtgtcgcggcagaagagcgagggcctccaggaactgatcgccggtgtcggccagcagatcgcggccagcatcatgtcgatctcgaccgcggccgaccggcaagcggcttccgtgacgatgatcgtcgagctggagcgtcaggccgccaatatcggcgacatcgtccgggccgtcgcccgcatcgccgaccagaccaacctgctcgccctgaacgcggcgatcgaggccgcccgcgccggccagcacggcaagggcttcgcggtcgtcgccgacgaggtccgcacgctggccgagacctccgagaagagcgcgcaggagattcaggaactcatcggccgcatccaggcggacgtgaagatgatcgccgacggcatcaaccgctcggccgagagcaccctgcaggaggtcgagaagggcaaggccatcacggcgcagctcggcagcgtgcgctcggccatggtcgaggtgatgaagggtgccgagtcgatcgcccgcaccgccgtcgaatccgagaaggccgccatcgaggctcagaagggcgtcgagtcgatcgccgcagccgcggaggagcaatcctcggcctgtcaggaatcgctgaagaccgtcgagcagcagaccacggcgctcggccagagcgagcaggcctcgggcgagctctccgccctctccgaggagctgcgcaactcgaccgacatcgccaagagttcggaggaggttgcctcggccgccgaggagctgtcctcggccgtggaggagatcaatcgcgccgccgcccagatcatgacggcgctcgaccagatcaaccgcggcgcgcagcagcaatcggccgcctcgcagcaatcggccgccgccatcgcccagatcgagaagggcgcgctgctctcgcaggagcgggcgcgggaagccctggagcgtggcgacctgatcaccacgcagctgcaggagaaccgtcaggcggtcgacgagctggtgcgcggcgtcggccactcgctcgacgagaccaataagagccgcgagcagatcaacgccctggagggcgtgagccggaagatcgacaagatcgtcgacgcgatcaccacggtggcgatccagacgaacatgctggccgtcaacggctcgatcgaggcggcgcgcgccggcgagttcggcaagggcttcatggtggtctcgactgacatccgcaacctggcgcgggactcctcggagaacgccgagcggatcaaggacctggtgaaggcgatccaggaccagatcgtgttcgtgcgccgcgacctggaggagatctccggggccgccgccgcggaggtcgagaagaacaaggccattacccagaacctcctgaccgcggcggaggacatgggcgccgtgctcgcgggcaaccgccagatcctcgaagggacgagcttgatcgtggacaatctgggggaggccaagaagggcgtcgaccagatctccgcggccgcccagcaggccgggcaggccgcggtcgaggcgcagcaggccgcgcgcgagcagtcgaagggggccgaggagctcgccgccgcgatcgaggagatcgcctcgctcgccgacgagctgcagaaccaagactga

SEQ ID NO: 7591 - DNA, 1107 bp, Methylobacterium sp.
gtgagcccccgcccctacatcctgatgagcgccgacgcgctcggcggcgtctggccctacagcctcgacctcgcgcgtgcgcttcgcgagcgcgggctcgaggtcaccgtggcggtgctggggcccgccccgacgccggagcgcgcagccgcggccgccgccgccaccggcgcgcggatcctgccgaccgggctgcccctcgactggacggccggtcggccggaggaggtccgcggggcggcggccaccctcgcccggctcgcgggcgcggtcggcgcggacctcgtccacctgcacgccccggcgctcgcgctcgccgacttccccgtgccggtcgtcgcggtctgccattcctgcgtcgccacgtggtgggaggcctgcggcgcggggccgatgcccgccgacctcgcctggcgggcgcgtctcgccgccgagggctgccgcgccgccgacgcgctgctcgcccccaccgaggccttcgcggcggcgaccgctcgcgcctacggcctcgccctggcgccacgcgtggtgcgcaacggccgtgaccgcccgaccgccgcaccggagcctggactcgctgcccacgccttcactgccggccggctctgggacggggccaagaacgccgccgccctcgaccggatggccgcgcgcctcccctgcccggtcctggcggccggccccgtcgcggggccgaacggcgcgcgggtccatctcgcgcatctgcgcctgctcggccggctggacgaggccggcatcgccgcgcggctcgccgggcggccggtcttcgtctcgctcgcccgctacgagcccttcggcctcgcggtgctggaggcggcgggcgcgggcagcgccctcgtcctctccgacatcccgagcttccgggagctctgggacggcgccgcgctcttcgtggatgcggaggacgatgccgccgcggccggggccgtcgcgggcctgatggccgagcccgccccccgcgccgcgctgggcgaggccgcccgcgcccgcgccgcccgctacggcgtcgccgcgatggcggagggggtgctggcggtgttccgggacctgctcgcgggcggctccgcaggacggagcgccgcatga

SEQ ID NO: 7592 - DNA, 1533 bp, Methylobacterium sp.
atgtcccacgatccccacagcccggccgagccgggcgaccgatcggccgcgtccgccacggcgcggcaattcgtgaccttcctgatcgatcgcgagacctacgcggtcccgctggccgaggtgcaggagatcatccgcctgcccgagatggtcgacgtgccgctcgccccccagaacctcgctgggctcgcgaacctgcgcggcacggtgctgccggtgacgagcctgcgccgcgtcttcggcctgcccgagcgcgagcacgacgacgccacccgggtcgtcgtcgtcagtcagggcacgcccttcggcttcgtggtcgaccggatggcgagcgtcgtgacgagtgagtcctcggagatcgacggcacggaggggcttcagagcaccgtcgacaccgacatgctgtcgggcatcatccgccgggcgggcggcatggtgatgatcatcgacccggcccggctcatgcagcgcggggccggctcccgcttgtccgagcgcagggcggagcgggccgacatcgccgccgaggccggctccacgcggtccgcgacggcggtctcggacgagatccagctcgtctccttcgggctcgccggccaggaatacgcgctgccgatcgagcacgtgcaggagatcgtgcaggtccccgacctcgtgagcacggtcccgcgcgccgacgcctccgtgatcggcgtgatcaacctgcgcgaccggctgctgccgctcgtgagcctgcgcaccctgttcgggctcgcggagacgggtctctgcgagcagagccgcatcgtcgtggtttcctggggcacccacggggccgcgcgctcggtcggcatcgtcaccgacacggtgaaggaggtgctgcgcgtctcccgcgccatcgtcgacccgctgccggacctgctctcgggcggcggcgcgctacgggaggtcgaggcgatctgccggatcgaccagggcaggcggctcgtctcgatcctctcggccgagcgcctgttcgacgcggccacgcggctcgatggatcgatcgtggatcagacggagacggtggagggcgagcgcatgagccagaaggccgaggacgaggagcagttcgtggtgtttcgcctggccggcgaggagtacggcgtgccgatcgatgccgtccacgagatcgtgcgggtacccgagcagctcacccgcgtgccgcggaccccgcacttcatcgagggcgtggtgaacctgcgcggcgcggtgctgccggtggtcgatcagcgtcgccgcttccagctgccggataccgagcgcaacgaccgccagcggatcatggtgttcctgatcgagggcgtgcgcaccggcttcatcgtcgacgcggtctcggaggtgctgaagatcccccgcgcggcgatcgggccagcccctgatctcggccaggacgggggcggggcggtcgagcgcatcgccaacctcgccgaggccaagcgcatcatcatgatgctcgacgtcgcgcgcctgctcagccggagcgaggtcgcggacctgcgccaggcggcctga

SEQ ID NO: 7593 - DNA, 651 bp, Methylobacterium sp.
atgaccgacaaggacctgcgccgcaacgtgctcgacgaactcgacttcgaccccagcctggacgcggccgagatcggcgtcgccgtctcgaacggggttgtcaccctgacgggtcacgtcggcagctacgccgagaaggtcgaggccgagaacgccgtgcgccgggtgaagggcgtgagcgctatcgcccaggagatccaggtccggtacgccgaggccaagaagatcgaggacgaccagatcgcggcgcgggcgctcgccatcatcgactggtcggtgcacctgccgaagcaggccatccaggtgaaggtggccaagggctggatcacgctgaccggcacggtgacttggcagtaccaagcgatgggggcggaggccgccgtgcgcaagctctccggcgtcgtcggcgtgtcgaacctcatcgaggtcaagccggaagttcggccaacgctggtcaaggacaaaatcctggaggcgttcaagcgcggcgcaatgttcgaggccgacgggatcaaggtccgggtcgagggcgacaaggtcacgttggagggcgccgtaacggcctggtctgaacgcgaggcggccgagcgcgcggcctggtcggtgccgggcgttcgcgccgtcgtggaccacatcgtcgccctgagctga

SEQ ID NO: 7594 - DNA, 2547 bp, Methylobacterium sp.
atgctcgcgccgacgccgaccttcagcccacgcctgctcgtgcgcctcggggcgcagcccgcctcgaaggaggcggcgatccgcgaggccgcccagcttctcaccgctgcgggctgcatcgacgccggctacggcgagagcatgctggcccgcgaggcggtggcgaatacctatctgggccacggcgtcgtgatcccgcacggcatggtcgacgaccggcatctggtccgcgagagcgggctcgccgtgctgcaggtgcccggcggcatcgcgtggcacgatggccagacggcgcatctcgtcgtggcgatcgccgcgcagtccgacacgcacatcacggttctgcgccgcctgacgcgcctgatccaggacgaggcacggctggcgcagctgcgcaccaccgcgcgggaagccgatatcgcggcggcactcagcgaggacgcggcggcgcccggcgccgccggcccggcgacggacctgcgccagcgcttcgactggaccgtcgactacccgaccggcctgcacgcccggcccgccgcgcactgggtcgaggttgccaagacctgcccggcccggatccaggtccggcacggcgcccaggtcgccgacgccaagaacctgatcgcgctgctgcagctcggcctgcgctgcggcgacgcggtgacgatctccgccgagggcgacgacgaggccggggcgctggcgaagatctgcgccgcggtcaccggcctcagcgcgggcgagaaggcggcggcgcagcgggcggcggaagcggcggcgcgggcggccgccccggtcgccggctggaacccgtccgacaagccgcacaccgtcgccggaatcggcgcgagccccggcatcgccatcggcccgatccacgtgctggcgagcgccgagatcgcggtgcccgacgagccggagccgctgaccaccggcgcggaccgcctgcaccgggcgctgtccgcgacggccgaccagctcagggctctggccgacgacacggagcggcggctggggaagcaggatgcgggcatcttccgggcgcaaggcgagctcatcgccgacaccgacctgatcacgctggcctgccagctcatggtcgagggccacggcgtcgcccatgcgtggcacgccgcggtggagcgcctcgccggccagctcgccgcgctcggcaacccggtgctggcgggccgcgcggcggacctgcgcgatgtcggccggcgggtgctggcccagatcgacccggccctgaagaccgggcacgacctgccggacgtgccctgcatcctgctggccgccgacctagcgccctccgacaccgccgggctcgacccggcccgggtgatcgggctggcgaccgcgcagggcggtccgacctcgcacaccgcgatcctggcgcgcacgctcggcatcccggccctcgtggcgggcgggcgggggctgctggcgctcgccaacggaacgcgggcgatcgtcgacggcaccacggggcgcctctacctcgacccgagcgcggccgacatcgcgtcggcggaagcgtggcgcgagcggcagcgcgcccaggccgaggcggaggcgcgcgagcgggcgctgccggcgcagacccgcgacggacaccgcatcgcggtcggcgccaacgtcaacaaccccgagcaggtcgccttcgcgctcgaccagggcgccgagggcgtcgggctgatgcgcaccgagttcctgttcctggagcgcggcgacacgccctccgaggacgaccagtacgagacctattccggcatgctgcgggcgctcggcgggcggccgctgatcgtgcgcaccctcgacatcggcggcgacaagcaggtcgcccatctgcggctgccgcacgaggagaacccgttcctcggcgtgcgcggcgcccgcctgctgctgcgccggccggacctgatggagccgcagctgcgcgcgctctaccgcgccgcccgcgaccacgtgccggccgatgcgccggccggcaaggatgccccgctctcgatcatgatgccgatgatcacctcggtccccgaggtgctgcggctgcgcgcggtcgccgagcgcatccgcgccgagatcggtgcgccgccggtgccgctcggcatcatgatcgaggtgccggccgccgcgatccaggccgacgccatggcccggcactgcgacttcttctcgatcggcaccaacgacctgacccagtacgcgctcgccatcgaccggcagaacacggagctggcgccggaggccgattcgctccacccggcggtgctgcgcctgatccacatgacctgcgagggcgcggcccgccacgggcgcttcgtcggcgtctgcggcggcatcgcgggcgatcccttcggggcctgccttctggcgggcttgggcgtgcacgagctctcgatgaccccgcgcgacctcgcgggcgtcaaggcgcggctgcgtgccgccgacatgggcgcgctgcgggcgctcgcccgccgggcctgcgagcaggaggacgccgccgccgtccgggccctggacgataagggaggggcggcgtga

SEQ ID NO: 7595 - DNA, 915 bp, Methylobacterium sp.
gtgagccccgcgcgctccgacgcggacgggaccgccggggaggcgggcttcgttctcctgacggtcctggccgtcctcggcgtcgtcagcgccgtgctcgtcgccgcgatcctgcagggacgctcgggcgcggcgctgacgggcgcgcgcgccgacgtggcccgcctccagggcatggcggacgggctcgcgcgcctcacggcctacgatctcggcgtccgccggacctaccggctcgccggtctcgacctgccggaggacggaaccgtcgtccgctgccgcctcgacccgcagcgcaccgccttcctgtcgcttcaggatcaggggcggctgatcgacctcaacgcgacgccgcggccgatgatggaggaagccttccggctgctcggcgtgccggaccggacggcgctcgcgatcgcggccgagatcgtcgattaccgcgatcccgacgacgtgcccgagcccggcggcggggcggagctgccgcagtaccgggcgcgcggcctcagccggggcccgcgcaacgcgccgttcgtcagtcccgacgagatcgagcggctgcccgcgatgacgcccgagacggccgccatcctccggccggcgctcacggtccacaaccagggcggacgcttcgacctcgcagcgctgatccgccgggtcaggccggcggcggtgccgtccctgcccgaggcgggcggcccggtcccgtcgccgcgccagtacttccgggtctcggtggtcgtcgccgagcgccggacacgggccggacgctcggcgatctacgggctgggcggcacgcgcaccggcaccgacttcctcgactggctgcccaccgtcgcgccggagcccgccagcgtgaccgaccatccggcctgcccgacgatcgctgccgccctcgggaccgcaggcccgtag

SEQ ID NO: 7596 - DNA, 975 bp, Methylobacterium sp.
gtgctgcgccattccgcccgtctgctcgcgctcgtcgccggcaccctcctgcccctgtccgcggccgtcgcgcaggaaccggcgaaggccgccgggccggccgccgtcaaggccgaccccagggagagcccgctcgtctcgaccgagtggctggagaagaacctcgacgccaggaaggtccggatcgtcgaggtcagtgtcgagcccggcgtgttcgagcgcggccacatcccgggtgcccagaacgtcgtctggcacaccgacctcgtcgagacggtgagccgcgacatcgccggcccggagaagttcaccgccctggtgcgccggctcggcatcgatcgggacaccacggtggtgctctacggcgacaacaacaactggttcgccgcctggggggcgtgggtcttcgcccagtacggcctcgtcgacaacgtgaagctgctcgatggcgggcgcaagaagtgggaggccgagaagcgccccctcgacacgcggagcgccgaggtcgcggcctccggcttcacgccggcgccggcctcgcccgccctgcgggcccgcttcggcgacgtgctggcggtggccaggaaggagcgcgacgagcagatcctcgacatccgctcgcccgacgagttcagcggcaaggtcatcgcgccggcgggcgtccaggaactcgcgatccgcgccggccatatcccgggctcggtcaacgtgccctggggcaaggcggtgaacgcggacggcacgatcaagtccccggccgagctgaaggcgctctacgcggcggccggcatcgacggcaccaagccgatcatcacctcctgccgcatcggcgagcgctccagccactcgtggttcgtgctgagccggatcctgggctaccaggcccgcaactacgacggctcgtggaccgagtacggcaacgcggtcggcgtgccggtggtgaacctcgccgggacggtctggggcggcaagtga

SEQ ID NO: 7597 - DNA, 1236 bp, Methylobacterium sp.
gtgacggaccgcctcgcggagggggctctccccctcccccggacttacgcgcccgccggctccgccgcgcgggcgctcccgcgtcggctcgtgccagccgccatcgccgccggcctcgcgggggccgcgtggtggctcgcgggggagcccgggggcacgcggctcgccctgtcgctcaccttcggcgccctgttcggcttcgtgctgcagcgcagccggttctgcttctactgcctcgggcgggacttcctcgtggcgggagacccgcgcgggctgctcggcatcctgtccgcgctcgccgcggggctcgccggctacgcggtcgtcctcggggcctggatgccggatcccggcggcacgcgcctgccgccggacgcgcatatcgggccggtcgggccggtgctggtgctcgcgggcgcggtgttcggggccggcatggcggtgtcgggctcctgcatcagcgcgcatctctaccgcctcggcgagggctcgccgacagcccccttcgcgctcgtcgggacggcgctcggcttcgtcctcggcttcgcgacgtggaacccgctctacctcgccagcgtgtccgagatgccggtgctctggctgccgcgccatctcggctatgcgggcagcctcgcggcggcgctcggcctgctcgccgtcctggcctgggcgctgctgcggcacctgcccgagcctgagccgcggccggcggtccggctcagcccagtgcgggccgtcttcaccgggcgctggccggtctggctcggcggcctcgcggtcggggcgatcggcacgctcgcctatctgcgggtcggcccgctcggggtgacggccgagatcggcggccgctcccggcaggcggcgggcgcgctcgggcttctccccgagcgcctcgaagggctcgacagcttccggggctgcgccaccgccgtgcgggacgccgtactgacgccgaacgggctgttcgtcggcggcctcgtgctggcctccttcgcggcggctctcgccgccggtcagttccgcccggcccggccgacggggggccatgtgctgcgcggcgtcctcgggggggtgctgctcggctggggcgccatgacgggcctcggctgcagcgtcggcacgctgctctccggcatcatggccggggcggtctcgggctgggtcttcggcctcgcgatgttcgcgggcgcgggcctcacgctctggctcgggcgccgcacggggctgctggcctga

SEQ ID NO: 7598 - DNA, 477 bp, Methylobacterium sp.
atgccgggagagggggcccgggccccgggccgggcgcgcggggcgggagcgggcggcgcggcgggcttcacgctcgtcgagatgctcgtcacgctcgcggtcctggccctggccctcacgctggcgtcccgctccctgggcggcatcgccgcgggccagcgcccggcccggctctcgggggcgatcgccggcgagatcggcctgctccgggcggaggccctgcgcacggggcggagcgccagcctcgtcttcgacgcggcgggcggccgctttctcagctcccgtccgggcgcggccccgatcccggcgcccctgcacgtcacggtcgaggcggcgggccgggagccgggcgagatccgcctcctgcccgacggcagctcgacgggcgggcgcatcgtcctgcgggacgccgccgcacgatccgtcgtctcggtgagcgccctgaccggccgcgtgcgacgcgacgagacccggtga

SEQ ID NO: 7599 - DNA, 390 bp, Methylobacterium sp.
atggcggcccgggacgacaccggcggggaggacggcttcacgatcgccgaggtgctcgtcgccttcatgatcgcggcgctcggcacgatcctggcgctcgagatcgccggcatgaccgcgggcggggtccagcgcctcgagaggcggcggatcgcggccgacgagagcgagggggtggtcctgcgccgcgtcgcggcgggggccttgcgccccggcctgacccggggccgcttctcggacggcacggcctggatgctcggggtgagcgacgcccgcccggcgctgggcctcgggcgggcgccgccgctctggcgcttgcggctgacccaggacggcccgtccggcgccctgctctacacgacgctcgtgccgggagacccggatggttga

SEQ ID NO: 7600 - DNA, 603 bp, Methylobacterium sp.
atggttgaggaacggcaggccgggttcacgctcgtcgagatgctggtctgcctcgcgctcgcggcgctgatcgggaccctgctggtcaacgccgtgcggatcaccggcaccgcctcagccgcgatgagccgtgcggcggcggccgaggaggtgcagtcggtgcgcgaccacctgcggcacacgctcggcagcctcgcccgccgccgcgccgagggcgcgcggcccgctcttctcggcggccccggcgcgctctcggccgtgatcgggcccgaccggagcgtcgagcgccccgccgaactcgtcgtcgcgctcgcggccatcgaccgggcggacggcggctacgacctcgtggagcggcgcgcggcgccggatgcgcccccggaggacgcgccggatgcgcggagggaggttctgctggagcgcgtcgcgggtctcgcgatccgctacttcggcgcgccggcggagggcatgcggccgggctggcacgcggcctgggcctcgcccgaccgccagcccacgcttctggagatcgaggtgacgttcgcggcggcggaccggcggcgctggccgccgctgctcgtcgcgctcggtgaccggccgtga

SEQ ID NO: 7601 - DNA, 480 bp, Methylobacterium sp.
atgccgtccgcctcctggccggcgtggctgcccgtcctgctgcccctgccgctcaccctggccgcggcggcgatcgatctgcgccgccggatcattcctgatctcctgaacctcgccctgctcggtctcggtctcgcggtggcggcctgggcggatccggatccgcccgccctcgtcggacggctcgcggaggtggccctcgccttcgggctgttctgggccttgcgcgcgctccatgcgcggctgcgcggccgcatcgggctcggcctcggggatgtgaagttcatcgcggccgcgacggcctggatcggcctcgtcggcttgccgctcctcatcctgaccgccagcctcgcggcgctcgccggggtgctcgtcgcgcacctgtccggcggccgggtcgaccgcgccacccgcctgcccttcggcccgttcctggcgctcgggctgcacgcggcgctcgcggccgagcgcgcgctctga

SEQ ID NO: 7602 - DNA, 1335 bp, Methylobacterium sp.
atgagcgcgtcggccctgtccgcggccgacgaggccgacgacccggaggtgccgagccccgccgtcggcccctccaagccgcgcctgctcagggtcctcggccccggccttatcaccggcgcctcggacgacgacccgagcggcatcgcgacctatgggcaggccggggcgcagctcggctacggcctctgctggaccatgccctacaccctgccgctgatggcggcggtgcagatggtctcggcccggatcgggcgcaccaccggccacggcatcgccggcgtgctgcgcgagcactactcgaacggcctgctccagggcgtggtgctgcttctgctgtcagccaacatcctcaatctcggggccgatctcggcgccatggcggacgcgctgaacctgctgctgcctggcccgcgctggctctacgtcgtgctgttcgccggcatctgcgccttcatgcagctcgtcctgcagtacacccgctacgttgccgtcctgaagtggctgacgctgagcctgttcgcctacctgggcgtggtgatcttcgcccgtgtctcgtggatcgatctcggggtagccatggcgctccccaggattgacctcagcggtggcggcctgaccacgctggtggctctcttcgggaccacgatcagcccctacctgttcttctggcaagcggccgaggaggcggaggacctgcacgcctacccgcgccggcgcgacctcctgcacgcgcccgagcaagggggcgccgcgctccaccgcatcgaggtcgacacgctcgtcggcatggccttctcgaacctcgtggcgctcgccatcatggtcacaaccgcagcggttctgcacccacgtggcatcaccgacatccagacctcggcgcaggccgcggaagagctgcgtccgctggccggccccttctccgcgacggtcttcgcccttggcatcgtcgggaccgggctgctggcggtgccggtgctcgcgggctcggcggcctacgcggtcggggaagcgcggcgctggcctgtcggcttcggccgccgcctgctggaggcgcgcgccttctacgggacggtggcgctcgccacgctggtgggcatgatcatcagcctgggcgcggtcgacccgatccgagcgctctactggagcgcggtcgtcaacggcgtcatcgcggtgccggtcatggccgtgatgatgctggcggcgacccgctccgacatcatgggcgccttcgtggtgcgcggtccgctcaggctgctcggctggatcgccacggcctgcatgctgctcgccgtcctcgccatgctggccacggccgcactgcccttgatctag

SEQ ID NO: 7603 - DNA, 1164 bp, Methylobacterium sp.
atgaacgcgaatgtcaatctcaacgatctcgaagtcggcttcgatgttcccgccctgccgggcatgcgcatggacgacatccagaccccgtgcctgatcctcgatctggacgccctggagcgcaacatcaggaagatgggcgactacgccagggctcacggcatgcgccaccgcgcgcatggcaagatgcacaagtccgtcgacgtgctgaagctccagatggagctcgggggggcggtcggcgtctgctgccagaagatctccgaggccgaggtcttcgcgcgggccggcatcgaggacatcctcgtgtcgaaccaggtccgcgacccggtcaagatcgaccgcctcgcgcggcttccccgctacggggcccgggtgatcgtctgcgtcgacgatcccgccaacgtcgttgacctgtcggaagccgcccagcgccacggtacgacgatcgcgtgcttcgtcgagatcgattgcggggccggccgttgcggggtcaggacgaccgaggccgtgatcgagatcgcgcgggctgtcgacgccgccgcggggctgcggttcgccgggctgcaggcctatcagggcgcgatgcagcacattgccggattcgaggatcgcaaggtcaagctcgacgcggccatcgcgcaggtccgcgagggggtcgacgccctgaaggcgatcggcctcgatcccgaactggtttccggcggcggtaccggatcatactatttcgaggccggctcaggggtctacaacgagctccagtgcggatcctacgccttcatggatgccgattacggacgcatccacgacaaggacggcaagcgcatcgatcagggcgagtgggagaacgcgctcttcatcctgacatccgtgatgagccacgccaagccgcacctcgccatcgtcgatgccggtctcaaggctcagtcggtcgatagcggactgcccgtcgtgttcggccgcgacgacgtcgcgtacatcaaatgttcggacgagcacggcgtcgtcgaggatctcggcggcgtcctcaagatcaacgagaaactccgcctcgtccccggccactgcgatccgacctgcaacgtccacgactggtacgtcggcgttcggaacggaaaggtcgagacgctctggcccgtctcggcccgcggcaaggcttactga

SEQ ID NO: 7604 - DNA, 696 bp, Methylobacterium sp.
atgaaggacggaccggtcgtggccgcggtggcggccctcctcggcgacccggcgcgcgccaacatgctgaccgcgctcatggacgggcgcgcgctgaccgtgagcgagctggcggcctgcgccggaatcgccctgcccaccgcgagcgggcacctcgcgaagctcgacgcggcgggcctgatcgccgccgagcggcaggggcggcaccgctactaccgcctcaccggccacgacgtcgccgaggtgctcgaagggctgatgggcctggcccagcggaccggcgcggtgcgcgcgcgaacgggtccccgcgacgcggcgctccgcgaggcccgggtctgctacgaccatctcgcgggcgcgcgcggcgtcgcgctgatgcaggggctcgtccgccgcggctggatcgacgatcccgccgcgcccgccctgacgccggagggacgcgcgggcctcgcagggatcggcctcgacgtggcggcgctggagcgcgggcggcgcccgctctgccggacctgtctcgactggagcgagcggcgggcacatctcggcggcgcgctgggcgccgcgatcctcgaccacgtcctggcgcgccgctgggcgcgccgcggcgcgggccgcgcggtcgccttcagcccggccggtgccgcggccttcgccgagatctgcggcgtcgccgaggggccggacccgcggtga

SEQ ID NO: 7605 - DNA, 390 bp, Methylobacterium sp.
atgccgctgatccggatctccctgcgggcgggcaagtccgccccctaccgtgccgcgctctcggagggcgtctacgccgccctgcgcgcgaccttcggggtgcccgaggacgaccgcttcgtgctggtccaagagcacgggccggacgacttcgcctacggggccggctatctgggcatcgcccgcagcgacgacctcgtgatcgtgcagatcacctgcaacgacacgcgcgacctcacgcagaagcgggcgctctaccgccgcatcgcggacaatctcacgcacgatcccggcctgcggccggaggacgtcttcatcaacctcgtcgaggtgaaggcggagaactggtcgttcggcaacggactcgcgcagtacgccgaccgcgcctga

SEQ ID NO: 7606 - DNA, 207 bp, Methylobacterium sp.
atgcgggtcgccgtcctgcttttcggcgtcgtcctgggtgtcgcgacgatcgtctggttcttctacctcgtcccgctgggctgcgcgatgaacacgaccggctgcagggagcggttcaccgtgtggagcggcatcggcctgctccacttctgggcgccgttcctcgtcgcgatctcggccgtcgcctacggggcgggaagatcctag

SEQ ID NO: 7607 - DNA, 456 bp, Methylobacterium sp.
atgcgcaggtcggcaccggacccggcgatcgaggcgcggcgtcggggagaggtcccggcggagaccgacccgcgcatcgaggcgctggtgcacgacatcatcggcaaggtcgccgacaagtggaccctgctgatcctggaggcgctggaggagcacggcacccttcggttcacgcagctcggccgggcggtgggccgcatcagccagaagatgctgacgcagacggtccggcagatggagcgcgacggcctcgtgcgccggaccgtgcacccggtgatcccgccgcacgtggactacgcgctgaccccgctgggcaggagcctgggcgccgccttctgcggcgtctggatctgggcggagacgcatcacgccgagatcgagcgggcccggcaggccttcgccgatgcggggcggtccgaggtcggtcccgcaccggcggagaccggaggggcctga

SEQ ID NO: 7608 - DNA, 2139 bp, Methylobacterium sp.
atgccgagacaggccccggtccccattccgtggcgcgccgcccgcgcggccgcgcgcctcctcggggccgcccgcctcgctctcgtcctgccgatcctggccattccgatcctggccctgccgatcctggcgggaccggcccgcgccgcgccggaggccgcgcccttcgccgacaacgccgactcggtcgcggtcgtgatcggcaaccgcagctacaagcagacggtgccggtcgattacgcccacaacgatgccgaggcgatccgcgcctacctcgtcgaacgcctgggctatcgcgagagcaacgtcttcgtcctgaaggacgcgacgctcaacgagttcaaccaagtgttcggcacggagcgcaacccgcaatcgggccggctctggcggagcgtgcgcgagggccgctcgaacgtcttcgtctactattcgggccacggcgtgccggatctcgccacgaggcagcccttcctgctgcccgaggacggcaacccgaaccagggcgagagcggctattctctcgagaccctctaccgcaacctcgacctcgtgaagcgccgcatcggccccgagcgccagctcgtggtgatggtcgatgcctgcttcaccggcgagaccggccgcaagggcgagagcctgctcgccgtctccgcccccggcttcgcgccagcccggccgaaagccgagagcggcatcgtgcgcgtggtggccacctccggcgcgacgcccgccaactgggacgagccgaacaagctcggcctcctcaccagccgcttcctgatgggcgtctcggggctcgccgacgcccgggaccagcagggcgacggcgacgggcaggtctcctgggcggagctgaagcgctacctcgcccgcgaggtcgaggaggcggcccgccgggcgtccggccgcgcgcaggtgccggaggtggacgacgcgccgatcgtgctgaaggcctcgctccccgtcgaggcggtgtccaagggtgtggcctcggtccgcgacgaggcggcgtggcggcgcgccgagacgctcggcacccgcgaggcgatcgaggcctatatcgggggctgcggcgagacctgcgcctaccggccccaggcgatggaccggctgctcgccggacggcgccgtgacgcggcggcgatcgaccaggaaaactgggccaagttcggccatacccggcagtaccaggcctatctggattcctgcggtgaggtctgcgcctaccgcggcctcgcggagggctatctcggcgggcagaacccgagcgccgacccgcgcgtgaaacgctgcgacgaactcgccgccggcaccgacgaccccgaccggccgaacggcgtcacgggggtgaggctcgggcggatcgaggcttcggccgcgatcgaggcctgccgcggcgcgtcggccgcctatccgcagctgcgccggctcgcctaccagctcggccgcgcctacgaccgggccgaccgctccaaggaggcgttcgccgcctacgacagggccgccaaggccggcagcgtctcggcgatgaacaacctcgccacgctctacgagaacggccagggcgtgaagcgccagcaggcggaggccctgcggctctaccggcaggccggcgagggcggcaacgtggtggcgctcgccaacgccgcccggatgctggaatacggcaacggcgtcccgaaggacgaggccgccgcggtggcgctctaccggcgcgcggtcgcgggcggcgacgtcgcctcgatctcgaagctggtgccgcactacgccaccggcgcccacggcttcccgaaggacctgcgccagggcttcgacctgttccggcaggcggccgacaagggggaccccgtcgccatggccacggtggcgacgctcatcgacaacggcttcggccgctacttcccgggcgtgcgcgccgccgacatggtgctgcgggccctgaagcggggcgagctcggcgcggcctcggtctcggccaccgacaccgcggcccagaagctgaagccggacaccatccgcaccgtgcagcgcgccgtgaaggaggcggattactatacgggcgcgctcgacggccgcttcaacccggtcttcgtgcgggcgctggaccagtacgcccgggcgaacgaggtggaatga

SEQ ID NO: 7609 - DNA, 309 bp, Methylobacterium sp.
gtgagccccggcgctctcgcggcgccggcgcgcgcggggcggcgcgcgctccgcgtcctggccctgctcgtctggctgccggccctgctcttcgcgtccggcttcgcgctcgcccacctgaccggctgccgggtctccgaggcgaccacctatccctgtgaggtcggcgggctcgacatcggcggcctgctctacgcgctgctgatgatgggctggctcctcatcccgctcctgcccttcatggggctgacgctgatcctcgtcctccggctggggctgcgggcgctctaccgggcgtggcgggcgtga

SEQ ID NO: 7610 - DNA, 1029 bp, Methylobacterium sp.
atgcgccggatggggcggctcgacagcatcgacgatcttcgcgtcttcgacgccatcgtgcgggcgggcagcctgtccggtgccgcgcaggaactcgacgtctcgctcaccgtggtttccaagcggctcaagcgcctggaggcgcagctcggcgtccggctgctccagcggacgacgcgccagctcggcctgaccgaggagggccaggaattcctcgggcgctgccggatggccctcgacgccatccaggcggcggaggaggtctgcggcgacggtgccagcggcgtcgtccgcgtgacggccacggcgggcttcgcgcagcggcagatcgcgccgcgcctgccccgcttcctcgcccgccaccccgacatctcggtccagatcctgaccagcgacgacgtcctcgacctcgtggagcgccgcatcgacgtggccatgcggcaggcgcccctcgccgacagccgcctgatcgcccgcgccttcgtgccggacgcgcgcgttctgtgcgcctccccggcctatctcgcgaaggccggtacgccgcgcgatcccttcgacctcgccggccatgcctgcctgacggtgggcgatccggcgccgagccagtggcggctgtggcgcggcgaggaatcggtcgagatcccgatccgctccgtggccggcggcaacgacggcgagatctgccatgtcggcgcgttggcggatctcggcatcgcgatgaaggcggcctgggacgtggccgacgacgtgcggaccgggcgcctcgtgcgcatcctgccggactggtggggtgggacggatcggtgggtccgcatcgtctacccggcgcgtctgcaccagccccggcgggttcgcgccttcatcgccttcatggaagacgagatgacgacgtccctggccgagagcgcggatctcggcctgttcgaggctgcggcgctggcgaagctgcagccgcgcatcgacgccgtgcggcgccgtcccgagcctcgacgcgccgagtccggactcgccgaggcgaaacccgcctga

SEQ ID NO: 7611 - DNA, 273 bp, Methylobacterium sp.
atgcgccgcgccctgcctcgtctcgctcctgcctgcctcgtcctgctgcccctcgcggccccggcccgggccgaggatttcacgggcttctacgccggggtgaacgcgggctacgccttcggccgggatggcagccggggcctgagcctcgcgccgggcgcgcccggggcggccgcgcccggcaacgatcttcccccgagcgcggcgggggccgcacggcagatgcggagcgcgccgcgcgccgcgagcgacgctccgcgcctgccgcgctga

SEQ ID NO: 7612 - DNA, 1545 bp, Methylobacterium sp.
atggccgaggcgaccgagatccgtcactcgctggagaagatccccctcggcggcatggtcgaggcggcctcgggcgaggccaaggtgctgttcgtccgggacgccgaaggcgtgcgcgccttccaggccaagtgcccgcacctcggcgcgccgctcgccaagggcgagatctgcggcggccggctctactgtccctggcacaaggccgccttcgcgctcactgacggcgggctggaggaaccgcccgcgctggaggcgctgacgcgctaccccgtccgcatcgagggcgaggaggcggtggcggtgttggagccgctggcccgtttcagcccggctccgcgcggggaggggacgcacgtcctcgtcgtcggcaccggtgccgcggcggtcgcctgcgtgacgagcctgcgccgcctcggcttcgcgggcgcgatcacgatggtcggccgcgaggcgcacccgccctacgaccggaccaagctctcgaagcagttcctggccaagcccaccccggccgagaagacgctgctcgaacccgacttccacgccgctcaccgcgtcgaacacgttcatggcacggtcgcgcggatcgagccggaggcgcgccgcgtcaccctggaggacgggcgcgcgctcgttgccgacgcgctggtgatcgccaccggcagccgcgccgtggtgccggacttccccggcgccgatctcgacggcgtccacaccctgcgcagcctggacgatgccgtcggcttgagcgcggcggcggagggcgccaagcgcgtcgtggtgatcggggcgggcttcatcggcctggaggccgccgccttcctgacgaagcggggcctctcggtcacggtgctggcccgcgaggcggtgcccttcgccaagcgcttcggcgaggcggtgggtgccgcgctgaagcgctaccacgcgggcaacggcgtgcagttcgcgcaaggcacgatcgcgcggatcgcgggcgccggccgcgtcgaggcggtcgagaccgaggcgggcgagcgcctgcccgccgacatcgtgctgatcggcgcgggcgcggcgccggagaccggagcgatcgcgggcgccccgctgcgcgaggacgggggcgtcgcggtcgggccggacctgcgtctggccccgaacgtctggctcgctggcgacatcgcggccttccccgagcgggcgagcggcgagagcgcgcgcatcgaacactggcgcctcgcccagcagcacggcacgcacgtcgcccgccagatcctcgacgggacgggcccgttcgccggcgcgccgttcttctggtcgaaccagggcgacaagcggctcgattacggcggctacgcgccgggcttcgaccgcgtcgtcctgcgcggcagcacggacgatctcgacttcatcgcctactacgtccgcggcgagcgggtgacggcggcctgcagcatcggccgcaaccccgaattcacggccttcctgcacctgctcggcgagggccgggcaccgagcgccgccgagatcgaggcggggacggatccgcgcgcgctcatctga

SEQ ID NO: 7613 - DNA, 894 bp, Methylobacterium sp.
atgatcgaagccgtgatgctctggaacgagcccaacaacaagtcgcactgggatccggagctcgaccccgactggctgctcttcgccgagatggtgaagggggccgcccgcgcgatccgcgcggtcaacccgagcctgccgcgggtgctcggcggcatctcgccgatcgacccggtcttcatccgccacatggcggcccgcggcgtgctggatcacctggaggcggtggcggtccacggcttcccgctcgactggaacctctggcagatccacgaatggcccgggaagatcgccgagatccgggcggtgaccgccctgcccgtctgggtctcggaggtcggcgtgtcgagcttcggtgccgaggaggtccaggcctggggctgcggccgcacggcggaactcctcaagggccaggcgcctcgcatccactggtacagcctctacgacctgccgcgggaatgggaggccaccacccggcacaaggaggccgagggctcctcctattaccgccacttccacatgggcctgctgcgccaggacggcacgccgaagccggcgctggaggagttcgcccggcacaccccggatctcggcctgtgccaatggttccacttcgaggaccaccgcctcgacgcggcggtcgactggatgaagcgcctcggcgtgacgcatctgcgcaccggcctctcctgggccgacagctttcggccgaacgccctcgactggttcgaccgccagatggcggccctgcgggacttctccgtgacgctgaccttctgcttcacgcccgagcaccggggcatcagcccgcatcacaccagcccgccgctcgatccggccgagtacgccgccttctgcgccgagatggtgcgccgctacgcgccggcgggctga

SEQ ID NO: 7614 - DNA, 786 bp, Methylobacterium sp.
atgagcgccgccgccccgagcccgggggacgaccggggggcgctggcccgcgagatcgcggccctggcgccctggttccacaacatcgcgatcgacgggatcgcgaccgcgcccgaccacttcctcggcgactacccggcggtgaaatgggcccgcttcgcccacgccatcccgcaggacctcaccgggcggagcgtgctcgacatcggctgcaacgccggcttctacagcctggagatgaagcggcgcggcgccgcgcgcgtcctcgggctcgattcggacgcgcgctacctcgcgcaagggcgcttcgccgccgcgcggctcggcctcgaggtcgagttccgcaacctctcggtctacgatgtcggggcgctggccgagcgcttcgacgtggtgctgttcatgggggtgctctaccacctgcgccacccgctgctggccctcgacctgatccgtgagcacgtcgcggccgacctcttcgtgttccagtcgatgctgcgcggctcgcccgcgatcgagccgctggccgaggattacgacttctgggagatggacccgttcgagcgccccggttacccgcggctgcacttcgtcgagcgcgaatacgcgcatgactggaccaactggtggatccccaaccgcgccggcatcgaggcgatgctgcgggcgagcgggttccgcatcgagagccggcccgaggccgaggtctatatctgccgcagcgccccgctcccctacgcgccgggggcggtctatccggcccgcgctgccgagggagcccgatga

SEQ ID NO: 7615 - DNA, 603 bp, Methylobacterium sp.
gtgaggcaggtcttccttctccgccacggcagccacgaccggctcgaccggatcctgtgcggccgcatgccgggcgtccgcctcagcgagaccggcctcgccgaggcgcgggccgccgcgcgcctcgtcgcgagccgcctcgacggcggcgcccgcccccacctcctcgcgagcccgttggagcgcgcgcaggagaccgccgccgccgtcgcggaggcgctcgggctgacggtcgagatcgaggaggccctgcacgaggtcgatgtcggtgcctggaccggccgcccgctggccgagctgcacggcgagcctgcctggggccactggaacgccgcccgcggcagcgcccgcccgcccgagggcgagagcgccgccgagatcgccgcccggatgggcgccctgctcgaccggttccgggaggacgggccgcccgtgatcctggtgagccacgccgagccgatccgggtcgccgggctcgcgctgctcggcctcgggctcgacgcctacgacagcctcgcgctgtcgccggccgggctctgcgaggtcgcgctctggcccggcggcggtcggctcgtcgcctggaacgaacggagccccgcatga

SEQ ID NO: 7616 - DNA, 1098 bp, Methylobacterium sp.
gtgagcatcatggcacgcgcgcccatacgggtcgggatcgtcggggtcggcaactgcgcctccgccctggtgcaggggctgcgccactaccgcgaggccgggccgggcgacgacgtgccggggctgatgagcccggatctcggcggctaccgggtcggcgacatcgccgtggtctcggccttcgacgtctcggccagcaaggtcggccgcgacctcgccgaggccatcctggccgagccgaacaacacccaccgcttctgcgaggtgcccgagaccggcgtcaccgtgcggcgcggtcccaccctcgacgggatcggccggtacctcgaggagatcgtgccggaggcgcccgagcgcccgggcgatgtcgtcgaggaactccggcgcaccggcaccgaggtgctggtctcctacctgccggtgggttcgcaggccgcgaccgagcactacgccgaggccgcgctggctgcgggctgcgccttcgtcaactgcatcccggtcttcatcgcctcccaccccgaatgggcggcgcgtttccgggaggccgggctgccgatcgtcggcgacgacatcaagagccaggtcggtgccaccatcgtgcaccgggttctggccaatctgctccgcgagcgcggcgtgcggctggaccggacctaccagctcaatttcggcggcaacgccgacttcctgaacatgctggagcgcgagcggctcgaatcgaagaagctctcgaagacccgcgcggtgacgagccagctcggcgccccgatgccggcggagaacatccatgtgggcccgagcgaccacgtgccctggctcaccgaccggaaatgggcgcagatccggctggagggctccggtttcggcggggtgccgctcaatatcgaattgaagctggaggtctgggattcgccgaactccgcgggcgtcgtcatcgacgccgtgcgctgcgcccgcctcgccctcgatcggggcatcggcggcccgctcgtgggcccgtcgagctacttcatgaaggcgccgcccgagcagttcaccgatgccgaggcgcgggcgcggacgctgcgcttcgccgcgggggaggccgagccttcgtga

SEQ ID NO: 7617 - DNA, 2598 bp, Methylobacterium sp.
atgaacgacctgctcgcccagttcatcctcgaggcgcgcgaactgctggaactcgccggcaccggcatgctggagctggagaagtcgcgcagccccgacgcactcaacgacatcttccgggcggtccataccctgaagggcacgtcggggctgttcgacatcgcgccgctgacgcacctcgtccacgcggccgaggacctcctggtcgagatgcgcgccggcagcctcgacttggcccccgagatcgtcgacgggctgctcgacagcctcgacctcgtcggtcactggatcgacgccctggagacccgggagagcctgccgacggatgccgaggccaccatggtggcgcgcgtcgcagccctacggcgctggctggcccccgaggccggtgcagacgcgtccgggcagtcgacccgatccgccgacgccgctcccgcctggatcgccgagttgccggaggccgagcgccgggcctgctatcgcgcggccctggtctcgggcgcgccgctcgccgcttggcgctaccggccggacgccgcgtgcttcttccgcggggacgacccggcccatctggtggccgggtcgcccggcctcctcgccgtggcggcgcggacgcgggagccctggccggatcccgcttcgctcgatcccttcgtctgcgccctcgagttccacgcactggccgccgccacgccggaggcgcttgccgagcacctgcgctacgtgaccgagcaggtcgagatcgcggcgatccgccccgatgacctcgcggtgccggtcggacgcaccgacccggccgagatgttctcggatttctcgatgcaggcccgcgccctgctggccgccggcgaccggacggcgctcgtccagtcggccggagcgctcctcgcgatcgtggccgacgatacccggcaggcctcggccctgcgctggctcgccgaggccgtggaggcgggcggcgatgcggacctgctcgcccacctcgtcgccgcggtgggcagcctcgcggatgaagttgcgccgcggccggcgcgtgagcccgcggcggcctcgggcttggccgacgagacagcgctgcggatcctcgcgagccaggccgagatgctcgcgagccccgtggaacccggcctcgtggcgggccgcctcgaatccgcactgacggtcctgcgccgctgcctgccgcatctcggcgaggctggtgcggcgctcgggcccgtgatcgcggcagccgcccgcgacggcgacgcggccgccctgctggccgccctcgctgcgatcaccgcggcaacggctgtgccggagacgggccggccagagctcgtctccggcacagccgccgcggaggcgccgcccgcccgcctcgaaccggcctctctggcctccacgcccgtgccgggctccgccgaggccgcggacggcaagggcccgacccgcatgctgcgggtcgagcagggcaaggtcgacgccctgatgaacttcgtggccgagctcaccgtggccaagaacggcctcgcctatctcgccggccgggccgagcaggtcagcggctcgcgccagctcgggcgcgagatcaaggagcagtacgccgtcatcgaccgcatcgcccagagtctgcaggtcggcgtcatggccatccgcatgatgccggtcagccaggtcttccagcgtttcccgcgcctgacccgcgacatctcgcgcaagctcggcaaggaggtcgagctggtcatccagggtgaggacacggaagccgacaagaacgtcctggagagcctcgccgacccgctgatccacatggtccgcaactccctggaccacgggatcgagatgcccgccgaccggcggcaggccggcaaggcgccgcacggcaccctgcggctctcggcccggcaggagaacgacaacgtcatcatcgaggtcgccgacgacgggcgcggcatcgatccggcggcggtgcgcgacaaggcgctgcgcgtcggcctgatcacgccggatcaagccgcgcagatgtcgccggaggaactcgtcaacctcgtcttcgcggcgggcttctcgacgaaggagcaggtctcggacctctcgggccggggcgtcggcatggacgtggtgcgctcggccgtgcgcaaggccggcggcgacgtctggctggcgagccgcctcggccagggcacctgcgtgaccgtgcagctgccgctgaccatggcggtgacccggatcgtcacggtcgaggcgcgcggccagcagtacggcgtcgccatggaggcggtggccgagaccgtgaaggtgccgcgcggccagatccaccggatcaagcagcgcgagaccttcgtgctgcgcgacgcggtgatcccgctggtccggctcgccggcagcctgggcctgccggcgcaggcgttcgagccgcccgacgaggaggccgtgatggtggtccggatcgggcgtgagcgggtcggcatcgtggtggacgggttccgcgagcgcatggaggtgatcgtccgccccctcgacgggctgctctcgggcctctccggcttctccggcacggcgctgctcggcgatggccgcgtgctcctcgtcctcaacctgccggatctggtctga

SEQ ID NO: 7618 - DNA, 1101 bp, Methylobacterium sp.
gtgagcgcgggcgaggccatgccgggcggcgaccgcccggtcctgatcaccggcggggccggcttcatcggcgccaacctcgccgaccggctggccggcgagggacgcccggtcgtcgtctacgacgcgctggcgcgggcgggcgtcgcggcgaacctcgcctggctgaaggcgcgccatccgggccgggtcacggcggtcgtcgccgatatccgcgacgcgggcgcgctcgcccgcgcggtgcgggaggccggggcctgcttccacttcgccgcccaggtcgcggtgacgacgagcctcgccgacccgcgcgccgacatggaggtcaatatcggcggcacgctgaacctcctggaggccgtgcgggcgctgcctcgcccggtgccggtgctcttcgcctcgaccaacaaggtctacggcggcctgccggacatcgtcctgcgggaggaagccgaccgctatctgccggaggacgaggcctttcgcgtgcagggcgtcggcgaggcgaggccgctcgacttctacaccccctacggctgctccaagggcgcggccgaccagtacgtgctcgactacgcccgctcctaccgcctgccggccgcggtgatgcggatgagctgcatctacggcccgcgccagatgggcacggaggaccagggctgggtcgcccatttcctgatccgcgcgcgggagggccggccggtcacgatctacggcgacgggcgccagatccgcgacgtgctgcacgtgcgggacgccgtgaacgcctactgtgcggcgctcgggcggatcggcgcggtcgcgggccgcgcgttcaacctcggcggcggccccgccaacgcggtcagcctcctggccttcctcgatcatgtggagcgcctgaccgggcgcccggtggcgcgcgccttccgcgactggcgccccggcgaccagcgctactacgtctccgacacgacccgcctgcgggcggccctcgacctgccgcccttcacaccctggcgcgagggcgtggccgacctcttccgctggctgggggagacgcggtccgccgcgccggcccgttcccggaccgctgcggctcttgcgggagcggccgaatga

SEQ ID NO: 7619 - DNA, 1296 bp, Methylobacterium sp.
atgagagtcgccctcgtcaacccgtcctgggactaccgcaacagcatctatttcggctgccgcgagccgcacctgccgctggagctcggctacggcgcggcgcttctggaggccgccgggcacgagaccctgacggtcgacgcgcatctcgaagggctctcgcacgcggaggccgcccggcgggtcgccgccttcgcgcccggcatgacggtggtcgcgaccgcgcccacctacctgttctggcgctgcgccccgccggagctgcgcgtgccgcgcgacttcctggacgcgctgggaacggccggcggccgcaccgtcgcggtcgggccgcacggctcggcgacgccggggccgacgctggccaagctcggctgcgacgccgtggtgcgcggcgagtgcgaggagatcctgccgcggctcgccggcgcggacgacctcgcccgggtgcccgccctcgcctaccggcgcgccgacggcacgcccgctctgaccggcggcccgcacgcgagccgcttcaccgacctgccggccctccgctggccggaggcctggatcgcccgccaccggcaccaccaccaccgcttcgacgtggagccggacgggccgggcgccgaggtcgaggcctcgcgcggctgcccctacacctgcagcttctgcgcgaagatcgattttcgcgacagataccgcaagcgcgacctcgggatcctgctcgacgagatcgacgggctgatccgccagggcgcgacctatctctacttcgtcgacgagatcttcctgccgcaggcgccgcttctcgacgcactcgccgctcgcgatatccgcttcggcatccagacccggatcgacctctggaagcccgacctgctcgaccggctgggcgcggcgggctgcgtctcgatcgaggccggcgtcgagagcctgacggaggagggccgcgcggcgctggacaagcgctgccgcgcctcgaccgacgacctcgccgagcgtctgatccatgcccgccggacggtgcccttcgtgcaggcgaacctgatcgcggtggcgggcgacgacgccgacatggtggcagcgtggcgcgagcgcctgcgcgcgcagggcgtctgggcgaacgacccggtgccgctctacccctatccgagctcgcccgattaccgccgcctctggggcgagcccgacgacgaggcctgggagcgggcgcacgcccactacctcggccagttcgagcgcttcagcgacattcaggcagagcgccccctgcccttgcgcgagctggaggcggcctgcggatgccagtga

SEQ ID NO: 7620 - DNA, 1131 bp, Methylobacterium sp.
atgaggatcgcctacttcacccactcgctcgaatcctgctggaaccacggcaacgcgcatttcctgcgcggcgtcctgcgcgagctgatcgggctcggccacgcggtcgaggccttcgagcccgagggcgcctggagcttggccaacctcctggccgaccacggcccggcgggcctcgacgcctaccgggcggcctatccggaactcgccgccacccgctacggcgcggtcgagcccgtcgtcgagcgcgcggccggcgccgacctcgtcctcgtccacgagtggaacgagccggccctcgtcgcggcgctgggccgggcgcgcgcggcgggcgcccgcttcacgctgctgttccacgacacccatcaccgcgcggtgagcgctccgcacgagatgcgccgcttcgacctctcgggctacgacggcgtcctggccttcggcgagaccctggcggaggtctaccgcggctggggctgggggacccgcgtcttcgtctggcacgaggccgccgacacccgcctgttccggccgcccccggatgagagcgcgcgcgagggccggcgggaaggcctcgtctggatcggcaactggggcgacggcgagcgcaccgaggagctcgacgccttcctgttcggccccgcccgcgaggccggcctgcccctcgacgtctacggcgtgcgctatcccgagagcgcgctggcgacgctcgtggcccgcggtgcgcgctaccgcggctgggccccgaacgcggccgccgccgggatcttcgcccgccaccgcgcgacggtgcacgtgccgcgccgcttctacgtcgagcgcctgcccggcatcccgacgatccgggtcttcgaggcgctcgcctgcggcatccccctggcctcggccccctggagcgacgccgaggggctgttcacgcccggcgccgactacctcgtggcccgggacggggctgagatgacgcgccacctgcgggccttgcgggccgatgcgggcttccgcgccgcgctcgccgcccacgggctggccacggtccgggcccgccacacttgtcgccaccgggccgaggaactcctcgccatcgtggccggcctccgcttgcccgctccccgatccctggaggccaccgcgtga

SEQ ID NO: 7621 - DNA, 1116 bp, Methylobacterium sp.
gtgagaatcgccttctacggctccagcctgctctcggcctactggaacggcgcggcgacctactaccgcggcatcctctcggcgctggcgggccacggccaccgcatcaccttctacgagcccgacgccttcgaccggcagagccaccgggacatcgaccccccggactacgccgaggtcgtggtctacccggcgaccgaggcgggcctgcgccgggtggtcgccgcggcggcggacgccgacgtggtggtgaaggcgagcggcgtcggcgtgttcgacaccgagttgctcgatggcctgctcgcggccgcgaacccgggcgcgctgctgatcttctgggacgtcgacgccccggcgacgctcgccgagatgcgggccgatccgggccacgtcctgcaccgggcgctgccgcaactcgaccgggtgctgacctacggcggcggacccccggtgatcaccgcctacgagggcttcggcgcgcgggcctgcatcccggtctacaacgccctcgacccggcgacgcatcacccggtcccgccggatccgcgcttcgcggccgatctcgccttcctgggcaaccgcctgccggaccgcgaggcgcgggtggagcgcttcttcctggtcgcggccgcacgcttgcccgagcgcgcctttctgctgggcggcagcggctgggagacgcgcggcctgccgccgaacgtccgggccatcggccatgtcggcacccgcgaccacaacgtcttcaacaccggcccgcgcgcggtgctcaacatcgcccgcgacagcatggcggcggtcggcttctcgcccgccacccgggtcttcgaggcggcgggcgcgggcgcctgcctgatcaccgacgcctgggagggcctcgacctcttcctgaagccggacgccgaggtgctggtcgcccgcgacgggcgggacgtcgccgatcacgtcgcggcgctgacgcccgagcgcgcccgcgccatcggcgaggccgcgcgcgcgcgggtgctcgccgggcacacctacgcgctgcgcggcgtggaggtggacaagatcctgcgcgcggcggcggccgagaaggcggagcgcggcgtcctctccctggagcggagcaccgcatga

SEQ ID NO: 7622 - DNA, 1056 bp, Methylobacterium sp.
atgacgaagctcctgatcgtcgacgattccgccctcatgcggaagcatctgcgcaccgtgttcgaggaggccggcacgttcgagatccgcaccgcccgcaacggccgcgacgcgctcgagcagatcggtgccttcgagcccgacgtggtgacgctcgacgtcaacatgccggagatggacggcctgacctgcctgggcgagatcatgaccagcgcgccgcgcccggtggtgatggtctcctcgctcaccagcgagagcgccgccgtgaccctcgaggcgatgcagctcggggcggtcgactacgtcgagaagccgggcggcacggtctcgctcaatatcgacgcgatccgccgcgagatggtcgagaaggtccgagtcgcggcgcgcgccaagccgcgccgcgcccggggcctcctcgaccgggtgcgccgcacgcgcacggccccgcccgccgcgccgcgccggacagccgcgctcgggcgcaccgaggggctcgtcctcatcggcgtctcgaccggggggccgcgcacgctggaggagatcctgccggaattgccggccgacctgccctggccggtcgtcgtcgcccagcacatgccgggctcgttcacgggccccttcgcccagcgcctcgaccggatctgcgccctcgacgtcgccgaggtcgcggggccgacgccgctgacgccgggccgcgtctatgtgggccggggcgacgccgacgtggtggtcgagcgcaagctcgggcgccacgtcgtcacctgcgtgcccaccgatccgcagatgcgctggcatccgagcgtcgagcggctggttcgctcggcccgcgccgccttcccgccggaggctctggtggccgtccagctcaccgggatgggcaatgacggcgcggcggccatggccgagctccgcaaggcgggcgggcgcaccatcgccgagtccgaggagacggcggtggtcttcggcatgccggccgagctgatccggctcggcggcgccacggtcacgctgccggcccgcgccgtccccgcccagatcctgtcctggctgtcctga

SEQ ID NO: 7623 - DNA, 1710 bp, Methylobacterium sp.
atggcccaattgctggcggtggtcggaggcgcggacctccccacccacgccgtcctcgccctcgaggccctgcgcaaggccgcaggccgccgcaaccagccgatcgccctggaactgcacggcgccaacagcggcaacccgctgccggagaccgcgatcggcgaggcgcgggccgtgctcctcgtcggctccggcgatctcggcgagggccgtttcggcccgctcgcgacggcgcgggccgcgatcgaggaggtgctggccgacgcgggcgccgtgctcgaccgggcgctggcgggtgcgcccgcttccgctgccaccccggcgggtacgagaaggatcgtcgcggtgacctcctgcccgaccggcatcgcccacaccttcatggcggcggagggcatccaggccgccggcagggcgctcggccacgacgtccgggtggagacgcaagggtcggtcggcgcccgcgatgcgctgaccgccgccgagatcgccgcggccgacatcgtgctcatcgcggccgacaagggcgtcgaccgggcgcggttcagtggcaagcgcgtctacgcggccggcaccaaggcggccatccgcgacggcaagggcctgatcgcgaccgccctcgccgaggcgcagatgcagccggcgggcggcgcggccgagaccgagggccccgcccgcccggcggcggccgaggccagggccggcgcctacaagcacctgatgaccggcgtctccttcatgctgcccttcgtggtggcgggcggcctgttgatcgcgctggccttcgcggtcggcggcatcgacgcgatggcgccgggcaatgccgggaccctcggctacgccctggccgagatcggcgccaaggcggccttcgcgctgatcgtgccggcgctggccggctacatcgcctactcgatcgccgaccggcccggcatcgcgcccgggatgatcggcggcatgctggcggccaacctccaggcgggcttcctcggcggcatcgcggcaggcttcatcgcgggctacacggccgctttcctgaacaggcacatccgcctgcaccggaacctggaggggctgaagccggtcctgatcctgccgctcatcgccaccgcgatcaccggcctcctgatgatctacgtggtgggcgtgccggtggcggccgtgctggccgcgctgaccggctggctcaagggcatgcagggagcgagcgccctggtgctcggcctgatcctcggcggcatgatggcggtcgacatgggcgggccgatcaacaaggcggcctacgcctcggccgcggcgctgctctcctccggcgtcgatgcgccgatggccgcggtgatgctcggcggcatgacgccccccctcgggctcgcgctcgccacccgcctgttcccggcccgcttcaccgcgccggagcgcgaggcggggggcgccgcggcggtgctgggtgcggccttcatcaccgagggcgcgatccccttcgcggcggccgacccgctcagggtcatccccgcgatggtggccggatcggccgcggccggcgcgctcgcgctcagcctcggcgtgacgctgaaggtgccccacggcggcctgttcgtcctgccgatcccgaacgcggtgacgaacctcccgggcgccgtcgtcgccctcgtcgtcgggaccgcgatcacggccgtgctggtgggaatcctgaagaagcgggccgcctga

SEQ ID NO: 7624 - DNA, 951 bp, Methylobacterium sp.
gtgagcccgatcctcaccctcaccctcaacccggcgctcgaccagaccgtagtgctcgacgcgctggtgccgggcagcgtgcaccgggcacaggcggtgcggacccatgcgggcggcaagggcgtcaacgtcgcctgctgcctcgccgactggggcctgcccgtggcggcaaccggcgtgctcggctccgacaacgccgcgcccttcacccaactcatggcccagaagggcatcgccgaccgcttcgtccggatcccgggcgagacccggaccaatctgaagctcctcgacgagagctccggcgacaccaccgacatcaacctgcccggcctcgccgtctcgcccgataccctcgacaccgcgcgcgcggtgctgctcgacatggcaggctccgggagcctcgcggtgctggccggcagcctgcccggcaccctgccgcccgagacctaccgcgacctcgcggcgcggctgcgggcgcgcggcgcccgggtggtgctcgacgcctccggcggcccgctcgccgcggccctcgccgcgccggcggacgctctgccctacgccgtgaagccgaaccggcacgagttggaggaatgggcgggccgcgcactgcccacgctcgccgacctgctcgacgccgcccggggcctgcgggatcggggcatcccggtggtcgcggtctcgctcgggccggagggcgcgctgttcctcaccgaggccggcgccgtccacgcccgcccgcccgcgacgcggatcacgagcacggtcggcgcgggcgacgcgctggtggcagggctcgtcgccggcctgcacgaggggctctccccggagaacatcgcccgcctggcgctggccttcgcggccgccaagctcgcccgcgagggcgccagcctgccgccccgcgcggaggtcgaggccattgccgcgaccgtgggggtggaggcgctggggtga

SEQ ID NO: 7625 - DNA, 651 bp, Methylobacterium sp.
atgacccgcctggatcgccagcagcatgtgctggatctcctcgtgccgcaactggaggaggacggatactccgtcttcatccagccgccccgctcgctactcccgaagttcatggcggagtatcgtcccgacgcggttgcgatgggcaagccgaagaacctcgccatcgagatcgtgcagggggaggccccggccgcgcggctcggcagcctgagcgagcgtttcgccgggcggccggactgggaattgcgggtctactactaccagccggaccgggacgacgaggccctgccgcctcccgggcgcgaggcgatcgaggcggcggccgcgacggtggagggcttggtcgccgcaggtcagccggaggccgggctgctgatcggctggtccgcgctggaagcgctcggacgcttcctgctgccccagaagctcaggcggccgcagacggcgggccgcctgctggaatcgatcgcgcaggcgggtgtcgtgacgcccgacgaagccgagcggctgcgcgcgctgcaggccatccggacccgggtcgcccacggggatctcggggccagcgtgcggccggagcaggtcgcggatctcgtcgcgatcctgcgcgcggccctggcggaagcggggcccgtcgaagccgcgccgtga

SEQ ID NO: 7626 - DNA, 294 bp, Methylobacterium sp.
atgtcctggcaagccaagagggctgcggccaagcttcgctggaaggagcatgtccgcgaagcgagttcggtgggcttgccggacggccatttcgcgaccgagggccggctcgccgtgaccctgttctacttcccggccgcgcgcgagggcggcgacgtggacaacatcgtcaagctggtcctcgacgcgctggtcggccacatctacctcgatgacgcgcaggtcgagcgtatcgtcgtgcagaagttcgcgccggacctgccctccccttcgtcgcgccggatggcatcctga

SEQ ID NO: 7627 - DNA, 873 bp, Methylobacterium sp.
atgcgcttctccagcaaagccaagccgggcgcggacctcgcggcgctgcgggccgagatcgaccggatcgacgccgagatgcacgccctgctgatccagcgcggcacgatcatcgaccggctgatcgccgtgaagggcaccaccgcctcgggctcggccttccggccggggcgcgaggcctcgatgatgcggcgcgtcgccgagcgccaccggggcctgctgccgctcgataccgtcgaggggatctggcgggtcatcatcgccaccttcacctacgtgcaggcgccgttctcggtccacgccgacgtctcggcgggcgacccggcgatgcgcgattccgcccgcttccatttcggcttcacggtgccctaccggccgcacccgacctgcgcggcggtgatcgaggcggtggcggcctcccgcggcgacctcggcatcttccgcttcgagagccgcgccccgaagggcgccgcgcacccgccgaagggcgaggcgtggtgggagggcctgatcggcgagggccgcccgaaggtgatcgcccgcctgccgttcatcgagcgccccacgcatccggccggcacgccggtcttcgtggtcgccaagcccctcgacgacccgaccgcggcccagcgcgactgggtgctctacgcggtccgggccgaggcctggccggacgaggcggagcgggcgctccacgacctctacggcgaggtggtggggcgggccaaaccccggggcgagaccgagcgcctgctgctggccctgccgggcggcgtcggcgcgcggcagctgcgcgaggcgctcgaccgggccggcgcgggcgtcacgacgctggacgagaccggcagccacgccgcgcgcttccgggtctga

SEQ ID NO: 7628 - DNA, 369 bp, Methylobacterium sp.
ttgtccgaaacgggcggcctcgcgcggacgcttcggcaccggcagacggcggccgaggcgcgcctctggagcgccctgcgcaacggccggctcaacggctggaagttccgccgccagcacccggtcggcggagcggtcgcggatttcgcttgtgtcgccgccagactcgtcgtcgaggtcgatggggcgacgcacgggaccgacgctgagcggtcgagcgatgcgcggcgaaccgagatgctcatgcgatgcggcttcgaggttctgcgcatcgacaatgatgatgttgcgatgaaccttgagggtgtccgcgagacgatcctgatggagcgcgggtcccctctcccgtgcgggagagggacagggtga

SEQ ID NO: 7629 - DNA, 612 bp, Methylobacterium sp.
gtgaagcgcgacgcttccgcagttccccctcccccctctgcgggggagggtggcccccgaagggggtcgggagaggggaaccccgcttccagtaaggacgcggcgcgcgatgacgggcggcccgccaagtccgccccgcatctgcgcgccttcgcccgggagcagcgccagcttcgtaccaaggccgaggacgcgttctggcagcaggtacgcggcggccgcttccgcgggctgaagttccggcggcaggtcccgatcccgccctacatcgccgacttcctctgcgcctccgcccgtctgattgtcgaactcgacggagcgccgcacgaggcggccgggcgccgcgatcgcgatgcggcgcgcgacgcgtggctgcgcgctcaaggattcgagatcctgcgtttcccgaacgaccttgtgcttggcaacctcggtacggttctcgacgcagtaggcgcggccgtcgcggcgcggcagggtcgcgatctgtccgacaccgtcgctcccctctctgcgggacttcgtcccggccgacccggcctgacggccggcccaccctcccccgcagaggggggagggaaggcgcggcgcgcggggagccccctcccgtga

SEQ ID NO: 7630 - DNA, 612 bp, Methylobacterium sp.; identical to SEQ ID NO: 7629

SEQ ID NO: 7631 - DNA, 1299 bp, Methylobacterium sp.
atgtcctcgtccatcaccttgtccgccgcgacccgccagaacctgctctccctgcaggacaccgcagcgctcgcctcgacgaaccagggccggctctcgaccggcaagaaggtcaactcggccctcgacagccctgtgaacttcttcaccgccgggagtctgaccgaccgctcctcgtcgctgaccggcctcctcgacggcatctcgaacggcatccagaccatccaggccgccaacaccggcgcgaccaagatcgccgacctgatgaagtcgctgcagtcgaccatcgcacaggcccagagcgaggccgccgccaaccgcccgaccgtcaccggctcggcgctcgccaccgccgcccaggcgaaggcggccggcacgagcctgcgcacgaccgtgatgaacatggcgctgggcggtacgaaggcggacccgagcgagagcgccgccgggtcggtcggcatcgccggcgacaaggtcgcggtcacgctgaccgacggcgagaacaccttcaccaagacgctcgacaagaccgccacggtcggcgacctcgtcaacgccatcaacgcgtccggcctcgggtccgcctcggtcgacgacgccggcaagctaaccgtcaccgggaactccgacaccctcaaggtcggcatcggtgggggcgccgacgcggccgccgcgctcgccaaggccaaggacggcgacggcaacgacgagctcggcctgacggccgccgcctacacgacgggcctgtcgagcaacaagacctcggccgcccgtacctctctcgcgacgcagttcaacgacctgcgtgaccaagtcgaccagatcgccaaggattccggcttcaacggcaccaacctgctcggcggcgacgcgctcagcgtgatcttcaacgagaagaccggctcggaccagtccaagctcaccgtcaccgggcgcaagctcaccgccgacagcctcggcatctcgaaggcggtcaacgggaccgccggggccggcgagttcgacatccagaccgacaagggcctggcggcgatgcaggacacgctcaagacggcgctggcgagcctgaagagcctgcagtcgtcgctggggtcgaacctctcgaacgtgcaggtgcgccaggacttcaccaagcagctcagcgacatcctgaacacgggcgccgccaacctcgtgaacgccgacatgaacgaggaggcggccaactcgcaggccctggcgacgcgccagtcgctcgcgacctcggccctctcgctggccaaccaggccaaccagggcatcctgcagctcctgcgctga

SEQ ID NO: 7632 - DNA, 732 bp, Methylobacterium sp.
atgcagagaacccttccggccgccctcgcgggcctggccgcgctgacctgcgcggcgggcgccgccgacctgccgcggcgggccgtgcccccgccgctcctgccgagcctgccggtcttcacctggacagggctctatgtcggtgtgaacgcgggctacggttttggcggcggcggcggcttcaccgatccggcctacggtaccgtgacggggggtggcggccgcggcggtttcgtcggcggcggccagatcggctacacctaccagctcgcgccgggcgccggatgggtgctcggcgtcgaggccgacatccagggcacggcctttggaaaggcggacgcggcctatctgggcaccacgccctattacggcgtgcggccgagcctcgacacgttcggaacggtgcgcggccgggtcggctacgccttcgaccgggtgctgatctacggcaccggcggcttcgcctacggcgacggcgcgcgcggcgctcacgcggcggcctatcccgccaccctgccggagcgcttccgcaccggctacgcggtgggcggcggcgtcgagtacgccttcaccgagaagctctcggccaagatcgagggtctctacgtgaacctgcgccgcagcttctcgggcgcgaccttctacgacgccggcaccgcggcctattacggcggcggccgcgatcccggcgccttcggcctcgtgcgcgccggcctgaactaccggttctga

SEQ ID NO: 7633 - DNA, 450 bp, Methylobacterium sp.
atgatcgccgcagtcaccgaccgccccgtgcggggcatcaacacgatcgtcctgagcgacggctgggagatccatctcgacgacgtcgccacctcggccgaggggcaggcgatcctcgacgacgtcgaccagggcatcgacgccatcgagcgtcagctcaccagtggcaccggcccaaatgatccggactggcgccgccgcgccgagctcgccctgaagaggaagcgccgcagccggcctcgcattcagcagcggatcggtgagctgcgacgggccgagcggcaggcggccccgctgccctccggcaccacctcgcccgcggacggcaagcgcaaggccttcgtaaaggcggcctacgaggttctgggccatgaggtctgcacggaggtgtgggcccgcgctcaagagatgcggccggagatcttcacggacgggcaggtgccggcatga

SEQ ID NO: 7634 - DNA, 267 bp, Methylobacterium sp.
atgaccacgacgaccaaggcggtgatcctcatgctcgtcggcgcgggcctcctcggcgccgcgcaccccgtccgcgcggaggaggccgcgccgcgcggcaaccaggagttcgtcggcgtcgatctcgatacgggcggcgtctactacaacggccgcaactcgggccggtactgcctctaccgcacggtcgacgtgttcaaccgctacaccggctatgtcgaggcacggcgggtgcgccgctgcggccgcggcctctacctgccgtga

SEQ ID NO: 7635 - DNA, 285 bp, Methylobacterium sp.
gtgagcgacgaggcccggctgctggccgagatccacgccgcccgcgcgctgatgcgggccggagcgcgggcggaggccgctgcccggccgggacatgccgcgctctgggcgcacgcgacgcgggctcccggtgcgccgatcgacctcgccgtggcgcgcgcgctccggagcgatgccgataccgcgcggcgctaccgcctgatgctgggggcgcaggccctcgcgcacgcgccgctcgcggcggcggcctcggacggtgccctggcgcggcgccgggtcgggccg

SEQ ID NO: 7636 - DNA, 1212 bp, Methylobacterium sp.
atgaccctgcgcacgatcctcatcgtcgtcccgaccaccgccgggccgctgcgcctgcggagcctcgcgccgcgccccggcctgccggccccggccgccttcgcggacggggattaccgccccctgccctggtcgggcgattacgcccggctctgtgcggcgggcggccccctctcccggctgatgacggagggcgccctgccgccgcacgagctgcgcctcaccggctccttcgatgccgggcgctcctgggaggtgccggtctgcctcgcgcacgggctcgtcgcgcgggggtaccgcctcgccgcggagccggcccgggccgacctgatcctctgggcgaccggtgcggtcgatctcgatctcgcggtgctgcccggcgactacgcgctcatcgacaagatcgagcgctcccgcaccctgctggcggaagcgccggacgcagccctgatggtgctgcttccggaggggccggagcggtcgcgagccgaggcggcgttccgcgccctcgggcgggtgccgcacgtgctgcccgcggagaccgtgccggcagccctggcggcggccctggcgagcctggcgcggccggcggcggcgagtccgtcggtcgcatcgatgctgcggcgccggcctcgcctcgccctgtcggcgggcgccgtcgtggggctcggcctcgcggccgtcgtcgcactcggcgcccggcatgcccccgtttccggcccggccgggcccccggcgggggaaccgcgtccgtccgacgccgcggagcccccgccgccgccgagaccctcggagcccgcacgcgcggcggcggcggccgccccgcccggcaccgatccggccgggccgcccgggatccgcgtcgaggagttgcgcgcgacctccggctcctcctgccgccgcgtcgccttcggcgccgacccgcccgagcgccgtcccgtgccggtggaggccggagagcgcctcgttccgacccggctggctccggatctgtgcgggctcgcggtgcgcgccacggggatgcgggtgacggtggggccggagctgcgcgccgccgccctgcctccggtgcggctggcggacggagcggacgcgtacttcctgcgcgagggcgcgcggcagaacctcgtctacgccgtccaggccctgccggaggcgggtgcggacgccggaacgcccggttcccgcctcgtccacgcgctgacgcgctga

SEQ ID NO: 7637 - DNA, 993 bp, Methylobacterium sp.
atgaccccgattcgcccgagagcccccaatgccgcggtcgcggccggcctgctcgtcgcgctcgccgcggccggtccggcccgcgcgcagagcgtcggcttcgatcccgccgattacggccgggcgcaactcccctcgcgccagaccacgggcgacgcggcggcctatgtcgaccagaacaagggcgcgttcgagccgatcgccgagctcgacccgaaggacgggctcgccgcgctggcccgcccgatcggccgcgtcgacatcgtgctgaagaacgcccgcaccggccagcaggtcggcgcctcctgcaccggggctctgctgcccggcgactacgtgctgaccaaccaccactgcctgccgcaaggcggcgacctcacgcccgtgaaggcgtcgatcctgatggattacctgacgctcgacggcaaaggctcgcgccgcttcgcgatcgacccgaagcccgtcgagcacgacgcccgcctcgattacgcgctggcccgcgtcgccgggaacccggccgccacctacggcaccgcccggctctcgggcgaggccgtgccgggcaaccgctcgatgctggtgatccaccaccccctcgggcgcccgaaggtgatgagccgcttccgctgcttcgccctgaaggagcaggccgagggcgtcgacctgcgccatcgctgcgacacgctcggcggctcctccggctcgctgatgttcgacgcctcggtggccggcatcgccctccacaaggagggcggtctcgatccgaaggacccgacgagcttcaacagcgccacccggctctcggccatcctgggccggagcccgatcctggcccggatcgcggcggctcagggacggcctgtcgcggccgcggaccccgcgccgcagccggggccacggccgggacagccgccggggccgcctcccgccgcccagcccgcggacgggccgctcgatccgggtcggatgaacgcgatcctgcgcgggcgctga

SEQ ID NO: 7638 - DNA, 978 bp, Methylobacterium sp.
atgccgctcgtccgtgccccggccttccgcgccgcgatcctcgccgctctgctctcggccggcctcgcctgcctcgccggagcatcgcccgtccaggcgcaggcccgaggttcggcaaagcccaacatcgtggtgatgggcgaggatgccgacgaggattcggtgccgcgcggcaaccgcatcttccagcgggtgatcaccgaactcgccgagacgatgaacctgcgcggctacaacgtctacgacgagaccgcggtggcgatgggcttcacccaggccaaccgcgtgcggcggcgcgacgccgagctgatcgaggtggcccgcgcggtgcagaacccgcccctcgacgtggtggcggtgttccagatctacgccgccgcgtcgaaatcggcctattcggacatcgtgcggccggaggtgcgcatccccggccggctcctcaacgtccgcaccggacagtcgctcggcgccttcgaggttgcgggcgtgcaactgccgcccctgccgcaggggtgcgaccgcgagtgcctgctggagcgggtcggcacggaggcgaagaccgttgcgggcgacgtggcggcggcgctctcggccaagctcgacggggtgatcgcgcctcggcgcgccgatgccggcgcgccgccccccgacacggcagcacccacgcctgcccccggcgcagtcgcggcgcccggagagggctgcggcggcctgccgagcgcctacgtggtgcggctcaacggcttctcggcccaggaagtccaggcggccgaggagtacatggcggccttccgctgctacgagcaccaccgcccggtgcggtcgagcggggccggcgccgagtactggtacgagacccgctccgactccgcccgcctcggccgcaacctgcgcctgatgctggagcacatgagtgcgccggggcaggtccagttctccggcaacaccttcgtgatcagccgcgtggcgacccgctag

SEQ ID NO: 7639 - DNA, 969 bp, Methylobacterium sp.
atgacggacctgacccggcgccacctcgcggcggtcgcgccgctcgcgcttctgggcgcatcgacccgtgccgttgctgcgacgtccgggctcgaggccgcgacgcattaccggttcgccctcggggccttcacggtcacgatgctcctcgacgctgccgggctgatcgacgggccctggccgatcgtcggcgaggaccggccgcgcgccgaggtggagcaactgatgcgcgagaaccgcctgccgccggaccgattccagccgggcttcacgcccgtcctcgtcgagaccgggcgggagcgcgtgctgttcgacaccggcaacggggccgtcggattcgtgccgcggcccgcgggcgggcggctcgcggcgcggctgcgcgccatcggcatcgagcccgagacgatcacccacgtggtcctgacgcattgccacaccgatcatatcggcggcctgatggaagaggggcgcgccgtcttcccgcgggccaccctcgtggtcggcgccgcggagttcgacttctggcgggcgccggagcggctcggggtgtcgccggaggactacgcctaccggtcggcacaggtcttccgcagccatctcctgccgctctcggagcgcgcgcgcctcgtcgcggacggcgccgagatcgtgccggggatccgcgcgctggcggccccgggccacacgccgggtcacctcgcctaccatgtcgagagcgggggcaagcgcctgctcgtctggggcgactgcgcccaccacgaggtcgcgtcgctcgcccggcccggctggcacgccctgttcgacatggacaaggcggagggcgcgcggacacgggagcggatctacgacatggccgcccgcgagggactgctggtcgcgggctaccacaccagcttcccctccctcggttacgtggtcccggccggcacgggctaccgctggatcccggtgacctaccagctgctctga

SEQ ID NO: 7640 - DNA, 1107 bp, Methylobacterium sp.
atgaggctcgtcgtcctcggcctcagcctcagctcctcctggggcaacggccacgctaccacctaccgggcgctcctcaaggccttcgcggcgcgcggccacgacgtgctgttcctcgagcgcgacgtgccctggtacgccgcccaccgcgacttggcccaaccggatttctgcagcctcgcgctctaccccgacctcgacgccctcgcccgccaccgcacggcgatcgctgaggccgacgcggtgatcgtcggctcctacgtgccggacgggatcgcggtcggcgaccgggtgctcgcctgggcagggggcacgcgcgccttctacgacatcgacacgccggtgacgctcgccgccctggaagccggcacctgcgcctatctcggcccccggcaggtcgcgtcctacgacctctacctctccttcacgggcggcccgacgctggcgcggctggagcggagctacggctcgcccgccgcccgcgcgctctactgctcggtcgacccgcaggcctatccggcgcttcagcgcgcggcgcgctacgatctcggctatctcggcacctacagccccgaccggcagccggcgctggagcgcctgctgctcgagccggcccggcgcgcgccggacctgcgcttcgcggtggccgggccgcaatacccggccgacctcgtctggcccgacaacgtcgcgcgcatcgagcacctcgcgcccgccgaccacccggccttctacgcggcgagccgctacaccctgaacgtcacccgcgccgacatggtgcgggccggctggagcccgagcgtgcgcctgttcgaggccgccgcctgcggcacgcccatcctcagcgaccgctgggacggcatggccgacgtgctggaacccggacaccagatcctgacgccggagggccccgacgccgtcctggagatcctgcgcgcgcggccggagacggagcggaccgcccaagccgatgccgcccgcgcccgcgtgctcgcgcaccacagcgccgcctgccgggcgcgggagctcgaagaccatcttgccggcgccccgcgccgcgcggccgggccggcgcgcccggccgatctcgcatgcgtccccggttga

SEQ ID NO: 7641 - DNA, 780 bp, Methylobacterium sp.
gtgcgggcgggaggcgcggccgtgaccgcgcgggtcatcgcggtctcgaaccgcaagggcggcacggccaagaccaccaccgtggtcaacctcgccgcggcactcggcagccgcggcgcccgcgtgctcgtggtcgatctcgacagtcagggacatgccggcctcgggttcggggtccgcgccgcgcccggggatacgacggtgcacgacctgttccaggacccgggcacatcgctcgccgacggggtgcgccgctccgcctacgcgaatgtcgacgtgctgcccgccgaccgcagcttcgcgggcgtgtcggcggtcacgccgccgctcggtctggcccgcgcgctcgccccgcttggcccgtcctacgaggcgatcctcatcgacacctcgccctccgccgacgcgctcctcgtgagcgcgttggccgcggccgaccacgtcatcgtgccgaccctgctgcatcacctcgccgtcgacggcgtcgggcagttcgcgcggtcatacctccgggtcgcgtcggggctcaacgcgcgcctgcgcggcctctctctgctgcccgtccaagtcgacctccgcgtgacgatgcagcgcgaggcgcacgcccagctcgccgcccgtttcggcaccgagcgaatgctcaccgggatccgtccggacgttgcgctcgccgaagcgttcggccagcaacagcccgtaaagtattaccgccctagaacaagatctgccgccgagttcgaatcgatctgcgaccaccttcgcgatgtaatcctacattga

SEQ ID NO: 7642 - DNA, 423 bp, Methylobacterium sp.
gtgctcgtcgcggagccgcaggcactgccgggcatgtggctggaggatgtcctggccgacgccggctgtgccgtcagcggcccctacggcacctcccaggacgcggctgagagcctggaccgaaagccgccggacttcgcggtggtcagcgtcgatctcaatcggggttccggcttcccgctcgcctgcgccctgcgccggcgcggcatccccttcgccctgatcgccggcaacgcgcgagtgcccggtgccttctcggacgtgcccatgttcgaccggctgttcgatgcccgggacatggtctcggccgtggccggtcgctgcagggttccgggctgcccgcggacctgcccgatgctcggccggatcgcggccggggaggaggttgcgctggatcaatgcccgaccgcttgccgcgcgtaa

SEQ ID NO: 7643 - DNA, 714 bp, Methylobacterium sp.
atgacgcgcgcgaccgcacccgccgccctcgccgtcgaaggcctcgaccagcattacggcagcgcccagatgctgcgcggcgtcgagctcgcgatcgagccaggcgcctgcctcgccgtgctcggccgcaacggcgccggcaagaccaccctgctgcgctgcctcaccggcctgatcccggcgagccgcggcgcggtccgcctcgacgggaccgacctgacgcgcttaggccccgaccggcgcgcgcgcgcagggctcgcctacgtcccgcagggacgcgagatcttccccgatctgacggtcgccgagaacctgcgggtcgccgcccgcgcgcacgggctggagcggaccgacgcggtggacgagtccgccgccctgttcccggcgctgcgcgacctctgggggcggcccggcggcaatctctcgggcgggcagcagcagcagctcgccatcgcccgcgcgctggcgacccgcccccgcgcgctcctcctcgacgagccgacggaggggatccagccctcgatcgtcgcggcgatcgagaccgtgatcgctgggctgaagggccggatcaccgtgctcctggtcgagcagtacctcgatttcgcgctctcagtcgccgacgccgtggtggtcctctcccgcggcagcgtcgtcgagcgcggcgcgcgcgggaccctgagccacgccgacctctcgcgccacatcgccgtctag

SEQ ID NO: 7644 - DNA, 342 bp, Methylobacterium sp.
atgcgtcgatccctgcacacggacgaggagatcgccttcctgctaggcgaggccgagcgcggtatatcgatcgcggagatctgcgcgagcgcccacgtctcgctcggcaccttctatcgatggcggcggcggctcggcggcctaaagcccgcgggcgtcgcccggctcaaccgaacggagcaggagaacgcggccctgcgagcggaggtgcagcgcctgcgtgcggctttggcggcgcggtcgtccccggccgaccggacgtcatcgccgcggcccggaccgcgccatcgcggggcggaggcctgcatcggccgcttcgcgttcgtccggacggcgaattga

SEQ ID NO: 7645 - DNA, 711 bp, Methylobacterium sp.
atgagcgcgctcgtcgtcgacgccctcaccgtcgccttcggccgcttccgggcgctcgacgcgctctcgctcgccgtcgatcccggcgaggtccgtgccgtgatcggcccgaacggggccggcaagaccaccctgctcgacgtgatctccggcatcaccaagccggtctccggccgggtgatgctcggcgaccggctcgacctcacgcggatctccgaggccgcgatcgcccgggccggggtgcggcgcaagttccagaagcccagcgtcttccccgcgctcaccgtgcgcgagaacctcgcgatcggctgcgggccggagctccgccctgaccagcgtgcggcgcggatcgcggcggtgctcggcgaggtcggcctcggcagccgcgccgcggtgccggcgggcacgctcgcccacggcgagaagcagtggctggagatcggtatggtgctggccgccgagcccaggctcctgctcctcgacgagccggtggccggtctctccgacgccgagacccatcgcaccgccgagctgatcgggcgcctgcgccggcccgaccgggcgatcctggtgatcgagcacgatatgggcttcgtggaggccgtcgccgacacagtgacggtgctgcacgagggccgtaccctctacgagggcgggatgcgaggtgcccgggaggatgcccgcgtgatcgaggtcttcctcggccgatga

SEQ ID NO: 7646 - DNA, 201 bp, Methylobacterium sp.
atggcaggcgagcgcggcgatccggaaacgacggtgcccgaggaggccgactccgagaagaccggtggagataccgagagcggcatggcgcgccccagcctctggaaacgcctcaagccgcttcatgacaggatcgcggcgcggccatcgagcggtctccttgccgacaaggccttctacgacagcctgaacgacgagtag

SEQ ID NO: 7647 - DNA, 495 bp, Methylobacterium sp.
atgccgacgatctacgaggcgcacagcttcgccgcgctcgcccatgcgggccagctcgacaagcgcgggcagccctacatccgccatctggagcgggtcgctaacctcgcgctcgcccgggccgggcacgcgcgcagcgtggaccggctcgatatcgacccgcagatggtgatgcaggtggcgctcctgcacgacgtcctggaggacacgccgcgcgaggccgcggacctgcgggcggcggggttctccgaggcggtggtcgcggcggtgcgcgtcctgacgaagcccgccgcgcggatcccctacgcggagcgaatcgacggcgtgatcgcgcggggcgacctcgcggcgatcctcgtgaagatgtccgacaacgaggacaatctcgcccccgaccgggccctgccggaggcgggcttcctgcgcgagcgctacgcggcctccttcgcccggctgaaagcggccgccggggcgctcggctacacgggccgctga

SEQ ID NO: 7648 - DNA, 180 bp, Methylobacterium sp.
atggagccggacgaggcagcacccggcacggtcgaggcatgggaggcgatcgcgccgatccggccggacaccgcccatgtccgcgcgccgcgcttcttggacgtggccggtgagctgctcgtcggcttcctgatcgtcgccgggggcgtgctcgcctacggccacctgccggtcgcgtga

SEQ ID NO: 7649 - DNA, 258 bp, Methylobacterium sp.
atggcaacgcccccgctcgccccgcgtccggccaagcgccgtcccttcacgggcttctacgctgctccttccccgactctcatgcccgacgaggccgcccctggcaccgtcgaggcatgggaggccaccgcccccgtccggccggacaccgcccacgtccgtgccccacgcttcctggacgtcgccggcgagatgctggtcggcttcctcatcgtcgccggaggcgtgctcgcctacggccacctgccggtcgcgtga

SEQ ID NO: 7650 - DNA, 795 bp, Methylobacterium sp.
atgacctatcggaaatctctcgccgccgccctcgtggccacgaccgtgctgggaggcgctgcgctggccgctgaccaggccgtcgcgccggcggcgatccacgagacggccgcccagaaggctgccggcacggaggccggcaagctctccaaggacggtgcccaggccttccgcgacatgcatctcgcccgcgtcgccatcttcgacgccgacccgagccaagccaaggatctgatcggcaaggcccaggccgcgctgactaaggcaaagactgacgaggccgtgttcatgaaggcggaggccgacctcaggagcccggccgacatgcacgctgcggcgaagggcgcgacgaacaaggcggccgccgacgccgctggccagcctgccgcgaaggacaaggtcgcgtggctgcccgtcgacgcgcaactgacgctcggcgaggacttcgtggcgacgcccgagaaggccgcggcggtgaccgacgcgaacacgagcctccggaagggcgacaagcaagccgctctccagaagctcaagcttgccggcatcgacgtgaacttcacgatggcggtgctcccgctcgacaagaccacggccgacgtgaatcaggccgcgacgctgatcggccagggtaagtattacgaggccaacgcgctgctgaagacctccgaagaccggatgcgcttcgacgtggtcgatgccgtggccgttccgaaggccaccgcgcaggcgacgggcaccaagaccgcgccggacaagacgggcacgacacagggcggtagcccggccaagtga

SEQ ID NO: 7651 - DNA, 210 bp, Methylobacterium sp.
atgacgaaccgcgagatggtgaagggtgcgctggaacacggcgatgcgggccagcaccccaacgacaaggccctgccgccgatgccggcgcccgaggacagccccacccccaccacccgcgaggagccgatcgactcgccacagccgaacgccagcgccaagcgccggccgccggaggcgggcgagatgggcctgacgacgcggcgctga

SEQ ID NO: 7652 - DNA, 1278 bp, Methylobacterium sp.
cgcgccaccgccgccctcacccccttcctcgacgcggtcgccgcctgcgccgggcggcccgacctgacgctcgccgtggtcggcgtcgagccggggcagacggcgctctcgcgcgagcaggccgaggaggtgcgcctcgccgtcgagagccggctccaggcgacgggccgggtgaagctcgcggcggccgccgacgtggtgcggatcaaggcgctcagcgagggcaccaccggcctctcgggggcggaggcggaggcgcagatccgtgcggccttctcgggggatgccagcgtcttcctggtggaggcgcgccgggccggcgagaccgccgcgctccggctccaggcgctcacgcggagcgcctcctgcaaggcgacgagcgagccggtgatcgtgccgatccgcgtcggggccggcgtcgccgacgtggacgcggtgatggagggcgccgtggaggccttcgggcaggccgcgccgggcgcgggcgccgtcgaggtctgccccttcgtggccgagggcggacactcgacctgcgcgggcgcgctcaccgaccgcctcctcatcgccctcgacgccgaggcgcgctcggccaaccgcgtcctgaagggcgcccgcctcgacgtgcgccgcagcccccccggcaccgcctgcaccggccccgtcaccgcgcgcggccgcttcctcaccgaccgggaccgccgatcctggatggaggtggagttccagcgcgacggcgcggtgatcgctccgaccggacgccgccgcatcggcatcgaggggctcggctgcgacccgaccccccgccccttcctcgaccatctcgcggcgacggcccgcacggatgcgggccgcctcgcggtggcggccgccgccacgcccttcgcgcccggccagcggctggacctgcgcatcgagtcgcgcgcccggcagagcctctattgctgggtggtcgcgccggacgagaccgccttcgtggccctgccggtgcgcgggaatggtgcctcgctcgcgcccctgaagcccggcgaggcgaagcgctacccgcgcggctacggcctcgacgagatcgtggcgggcgagcccttcgagaacctcttcgcctgtttcggcgtcgagggcggcctgccgccggaactggccgcgcgctggctcgccgcggcgccgggcgcggacggggaggccaggctcctccagccgcccgacgtgctcgacctcctcgagcggatccgggcgacgcccggcgtgaccgaggccaccgcccggatcgtggtgcggtga

SEQ ID NO: 7653 - DNA, 1389 bp, Methylobacterium sp.
atgagcgggggatacgacgagcgctgcgcggccgacctcgcgggtgtcggcgagggccgcgacctctcccgcgccgatcgggcctggctcgcccgcgtggtcgccggggccgtgcgcccgaaccgcgacaagccgctctgggatctcgcccacgcgctggccggcctggcccgggcgacgggcgcccgcgacgggcgcggcctcgtcaccctggcgctcgacccgaacctcgccacggccggcgcggtcgaggcgcgctttgccgggagcgacgccgccgacgcgcgcggcctcgtcctcgacggcggctggcgtaccggctgggccgggctcgcgcggctgctggcgctcgccgagttcgtgctgacggcggaggatctggcgcagttcgcggccgtgaccggctggctcgacgagctcgccgccgcgcccgatccggagggcgccgccttcctggccaagcgcctcgcccggcacctcgccgcctaccgcaacgcccacctgccgctggcgccgctggaacggcgcttccgcgcgctcctctggttcctcggcgggcgccgcgccttcgcggacgacgacatcctggccttctggcgcgccgagatggcggcgggcgagcggccgggcttccgcaccgtggccgagcatttcgtgaccttcgaggccggcgcgcagctcctcggcggcctggatggcctcgccgcccccgcctccctcgacgcgcatgcgggctgggaggagcgcctggatgccgcgctcgccgatctcgtggcggccgagcccgccgagacgctggccggcctgctcgccgactggccggagggtccgaagatcctcacgggcgccgagcgcgaggacctcgccgacttcctgcgcctggacccgttccaccggacgcggccgctgacgacgctgcgcgccgcgagcttcgggcgggtgcagtccggcatcgccaaccgcctgcggcgcggcgggggcggcgccgacatcgccgagcgggcgacctgcgcggaggccgagagctacgcggcgctggcagcccgggccggggcgctcgccgtccatctcggccggatgctgcggatcgcggcggccctgcgggtctcggagcgcgacggcctcggcccggaggcgcgggccgtgctcgatgcggcggaggcggacctgcgccgggtgcgccgtgccgggttcgaggatcgggtcgcactcgccgcgggcttcgccgccgcggaagccgcgctcctgcgcgtcgcggcggaggcggagcggctggatcgtgcgctcggcgtgctcggacggcagcgcccgctcgacgcggccttcgcggcggaccgcgcggtcttcgccgaatccctcgcggcggcctatgcgggggaggcggcgtga

SEQ ID NO: 7654 - DNA, 549 bp, Methylobacterium sp.
atgagcgtcgatgtgggggagcgtctgcgcttcgtccggatgcggcagggcctgtcgcaacggacgctcgccaagcgcgccggggtgacgaactcgacgatctcgctcatcgagtccaaccgggtgaacccgtccgtcggcgccctgaagcgcatcctcgacggcgtgccgatcggcctcgcggagttcttcgccgtcgagcccgcgcgcgagcgcaaggccttctacgcggcggaggagctgaccgagatcggcaagggcaagatctcgtaccggcagatcggtgagacgctgttcgggcgccagctccagatcttgaaggagcgctacgaggtcggcgccgacacgggccgcatcctgctctcgcacgagggcgaggagggtggaatcgtgctctcgggccggttggaggtcacggtcggcgacgagcgccggatcctcggtcccggcgacgcctacgccttcgacagccggcgcccacaccgctttcgctgcgtcggaccggccccgtgcgaggtcgtcagcgcctgcacaccaccgagcttctga

SEQ ID NO: 7655 - DNA, 594 bp, Methylobacterium sp.
atggctctcgtccgccccaaactcgatcgcgtcgcgcccaccgcgtcgccgtccgtgccgacgctcgatgcggcgagcgccgcggcccgccggcaagcggcccgcgcgagggccgccgacccgggtgccgcggacgcgctggccgcgcgcttaggtgtcgaatccgacgacagcgtgcgcgaggcgctcctcgcggcgctcggcacgctcggaacgcccgaggcggtcgcctacctgttcgccctgctcgattccgaggacgtctggctgcgcaacgccgcgatcgagacgcttcagggcctggatgcggccgtgctcgacgccctcgagcggagcctcgaacatcccgacagcgaccaccgcatcttcgccgtcaacgtgctgacgagtctgcgccacccggccgccgccgacctcgcgctgcgggtgctggaacgggacgcccacgtcaacgtctgcgccgccgccctcgacgtgctcgcggagatcggcaggcccgagatggcgccggcgatcgcgggcgcggtcgagcgcttcgcggacgagcccttcctgcgcttcgcggccaaggccgccctgcgccgcatcgcctga

SEQ ID NO: 7656 - DNA, 372 bp, Methylobacterium sp.
atggcccgtatccttgtggtggacgacgccacgaccgtacgcatgtactaccgcgacgtcctcgaggaggccggcttcgcggtggatgaggcggccaacggcttcgagggcctggagaaggccatggagcaggccttcgacctcgtgctcgtcgacgtcaacatgcccaagatggacggctacgccttcctcaggcagggccgggcgatgtccgagcttcaggcggtgccggccgtgatgatctccacggagagcgggccggaggatcgggcgcgcgcctacgcggtcggcgccaatctctacctggccaaaccggtgcgcccggacaccctgtcccgggtcgcggccctgatggcgggaggcacgcgatga

SEQ ID NO: 7657 - DNA, 387 bp, Methylobacterium sp.
atgaccgctccctcgccacggcggtccggaaccctcgcactgggcagcctgctcgctgccttcgtcggctccccggtcatggccggtgggatcgaggaccaccgcgttcgtggctggaccattgccacgcagctctgcagccagtgccacgtcatcggccgcgggtcgcaggcgggcgagttttccggccccgccttcctgcgggtcgccaacatgctttcaacgacggggccggccctcgcagttttcctgcagtgccaccacgagcggatgccgagcctgcgcctcgaccgcgatgagatggacgcggtcaccgactacatcctcagcctgaaagggcctcagcctcacgtccgtgagtctgggacatttacggagcggccgtga

SEQ ID NO: 7658 - DNA, 240 bp, Methylobacterium sp.
atggcggacgtccacgtagccgaggagctctggaccacgggcatgcttcccgagggcatcgtggagcggtggctcgtcgcggacggagcgagggtgaaggccggcgaggccgtggccgccgtgcgcatcggcgaggccctgcacgacatcgtctcgcccgccagcgggcgcttggcggtgctggcgccggcgagcgaggtcgtcgaccccggctgcatcatcgccgaggtccacgcctga

SEQ ID NO: 7659 - DNA, 291 bp, Methylobacterium sp.
atgagagggttcgcgctcggcgtgctgttggcggcgagcccggccgcggcgcagccgcgcccggacgtcaccgcgatgacctgcgccgaggccggcgcactcgtcgcccgctccggcgcggtcgtggtcacgacggggcccgcgacctacacccgcgtggtgcgcgatgtgagcttctgcgtgatcgagaaatccacgcggccggatttcgagcagacccgcgacgtaccgaactgcttcgtcggctaccgctgcgtcgatccgttctcggaaggccgcgacgggccctga

SEQ ID NO: 7660 - DNA, 210 bp, Methylobacterium sp.
atgaccatgacccgtacccccgagatgaccgctgctcccgcgacgttgagcttcctgacggcggtgaagcgcatcgaggcgttgacgcaggagatccgccgcgagggtctcagtgcgttcgagaaggccgagacggcttacgccgaggtgcaggacctgcgcgccattctgaacgcacgcatcgccgatctgcgtcgccgcaacgcgtag

SEQ ID NO: 7661 - DNA, 210 bp, Methylobacterium sp.
atgtcgaacgaggacaccggtaccatgtcacatccccccgagacctcgagcttcctggcagcggtcaagcgcatcgaagcgttgacccaggagatccgccgtgatggtctggccgccttcgagaaggcggaagccgcctatgccgaggtgcaggatctacgcgccgtgctgaacgcgcggatctccgagctgcgccgccgcagcgcgtaa

SEQ ID NO: 7662 - DNA, 1500 bp, Methylobacterium sp.
atgatgccgaccccgtcccccgcgccgcgtccgatcctcgacacgatccgcaccgggtccggccgtgccctggtcggcttcctctggttcaacgccgccctggtcgcagcgacgaacctcgcctggggcagcgctcaggttccgaccaccctgggaggtgccgtggtcctggccggactgcccacctggcactacctgcgcaaccccaccggacggacgacccggatcgccagcagcattgcgctggcgggactcgtcgccatgctggtggcggcctttcggcaggaggggggcgggcagaccctgcaggtggacctgcacatgtacttcttcgcctgcctcgccgtgctcgcggcctggctcgactggcgggccctcgtcgcctacgcggccgtcgtcgccgtgcaccatctcggcttctcgctgctgatgccgagcctcgtcttcccgaacggcggcggcctcggccgcgtcgcgctccacgccgtcatcctggtgctgcagacgggcgtgctggtctggctcgtcgcccgccttcaggccggactcgcggcgagtgaggcgctccagcgcagcgagagcgaccgcagcgaggccgaggtgctgcgggaagaggccgaggcggccgcccggcgcgaggccgagcggggcgcgcaggcacgccagcggatcgaggccttccgcgtcgccgtcgccgggatcgtgggcgcggtcgagggggcgctcgccgccctggaggcgagcgcggcgggcctcggcggctttgcggagcggaccgggcaggaggcgacccgggcgaccgacgggacggtgcgggccgtcgcgaccatcgcggcgacgaccgaggcctgccgcaacctcgttcaggcggttgacgagatcggccggcatctcgccgccaccgacgcgatcacccgcgcggcgacggaggacgcgcgccgcaccggcgagacggtggccgcactcaccggcgcggtcgagcggatcggctcggtcgtggccacgatccggtccgtggccgatcagacgaacctgctggccttgaacgccacgatcgaggcggcgcgtgccggcgaggcggggcgcggcttcgcggtcgtggccgcagaggtgaaggaactcgccggccagacggcccgcgccaccgaggagatcgccggccagatcgccgatgtcgagcgcgcgacggcctcctccgccgcctcgatgcgctccttcgccggccgaatccacgagatcgagggcagcgccgccgcgatcgtggctgcggtggaccgccagcgcggcgccctccgggacatggacgcccacgttgccgccacggcgcgcgaggccgaggccgcgtccggccatgtgcgcgccgtctccggcgtgctccacaccacgtcggagatcgcgggctcggtgcaggacgcgaccggggcagtgcggggacaggttgagagcctccgcggcgtcacggccgggttcgtgcgcgacctcgacggattggcggcctga

SEQ ID NO: 7663 - DNA, 840 bp, Methylobacterium sp.
gtgagcgctgccgtcttcgccgcggtgctcgcggcggcctgcatgcatgccggctggaatgctctggtcaagctgcggctggagccgatcctgaccatggcgctgatcgccgcggcagcgggtctgatcgcgctgccggcactcgtctggctcggcctgccgccccccgcggcctggccctggctgtgcggctcgatcgtcctgcatctcggctactacgtcgcgctgacggaagcctatcgccaaggcgatatgggtcaggtctacccgatcgcccgcggcagcgcgccgcttctcacgacgctcgcctccctgatcgtgctcggcgagccggtggcgccgctggccgcgggcggcgtcgcgatcctgtgcctcggcgtcggcctgatggccttcggcagtcggagccgccgtctcgaaccgcgcgcgctcgccttcgccggtctcaccgccctgatgatctgcggctacaccctggtcgacggcatcggcgcccgggtcgcgggcgacgcgcacgcctacgcggccgccctgttcgtggtggacggcatcccgctcgccgccttcgtgctgtggcgcaggggtacgggcgtcctgcgccagatccggggcgtcgcggtgccgggcctcgtcggcgggctgttctcgctcggctcctactggatcgcgatctgggcgatgaccgtcgccccgatcccactggtggcggcgttgcgcgagaccagcgtgctcgtggccgcgctgatctccgtgacgatcctcagggagccgctgctcgccgcccgcgccgtggccgcgctcgtgatcctcgtcggcatcgccgccctgcgcctcggctga

SEQ ID NO: 7664 - DNA, 1029 bp, Methylobacterium sp.
ttgcgcgacatcgccctcttcgtggaggtcgccaagcggcagagtttcagccaggccgccgccgcactcgacatgccggtctcttccctctcccgccgcatcacgcagttcgagacggcgatcggcctgcgcctcctcgacaggaccacccgcaagatcgcgctgacggcctatggggcggcctacctcgcccaggcgacgcgcgtcgtcgaggaggcgcagcgcagcttcgacgagctcgtcgcgcaggccaaggggccgagcggcttcctcaagatcgcggtgccgacagattactgggcggtgcggcacctctccgagatcgtctccgccttcgcccagcagcacgagcacgtccacgtccacctcgacctgcgcgcgagccaggtcgatctcgtgcgcgagaactacgacctcgccatcttcaccgaaacgccgcgcgaggcctctctcatcgtgcgcaagatcgccgtcatcgagaacggactgttcgcagcgccgtcctatctccaggcccgtggacgccccgaggaaccgtgcgatctcgcccggcacgagattctgatgccaacggcggcagagagcacgacgtggcagttccggcgcggcaccgagaccgtaccggtgaccgtgagcggccgcgtatcctgcaacagcctcagcgtggcgcgtcgcctcgcgatcaccgggcgcggcatcgccgcggtcagcgtggtcaatgtcgagcgcgacctcgaccggggccgcctcgaacccgtcctgcccggctggagcatcccgccgaccagcgtctacatcgtgacgacgtcgcgcctgatcccggccaaggtccgccgcttcatcgacttcctgacgcagagcctgagcgcactcttctccgaggtgccgagcctcgccgaccggatcgcgccgccgagcgccgccggcatccgcgcggccgcagcgggcgcgcaaggctggccggctgcccgtcggtcccaccgcccgctcggcgccacggagtgccggaccgcgtcccggagcgactga

SEQ ID NO: 7665 - DNA, 990 bp, Methylobacterium sp.
atgggcgggaagcgcgcactcatcacaggtgtgacaggtcaggacggagcatacctcgctcagctgcttcttcagaacggttacgccgtccacggcgtcgtgcgccggtccagccacgccggcatcttcgatcaccgcctgagatggctcggcatcgccgacggcgtcgcgctgcatgacggcaatctgctcgacctgtcgagcctggcgcgcatcatgcaggacgttcagccggacgaggtctacaatctggcggcccagtccttcgtcacggcttcctggcagcagcctctgctgacggggcacatcaccgggctgggcgcggtcaacatgctggaatgcgtgcggatgctgcggccgaaggcgcgctactaccaggcctcctcgtccgagatgttcggcctgatccaagagagggttcaaagcgagagcacgcccttctacccgcgctccccgtacggggtggccaagttgtacgcgcactggatgacgatcaactaccgggagagtttcggcctgcatgcctccaacggcatcctgttcaaccacgagagtcccctgcgaggggtcgagttcgtgacccgaaaggtgaccgacggcgttgcgcgcatcaagctcggcctggcgaacgagcttcgcctcggcaacatcgacgcgcaacgcgattggggccacgcgcgcgactacgtgcaggcgatgtggatgatgctgcagcaggacgagcccggcgactacgtcatcgcgaccggcagaaccaccaccgtgcgcaggatgtgcgagatcgccttccggcatgtcggtctcgacatcgacgactacctcgtcatcgatcccgcgctgttccgtccggcggaggtcgattgtctccagggcgatccggccaaagcccgggcggccttcggatggcaggctcggatcaccctggaggccatgatcgaggagatggtcgatgccgacctcgcacgcttgcgcagcggtcagtcccattga

SEQ ID NO: 7666 - DNA, 633 bp, Methylobacterium sp.
atgacgacgctctcgatcctcgacctcgacgccgtgcgggccgcgcccgtggcccgcgagccctacgcgtggacgctcggccagaacgtgctcaggcccgacgccatcccggcgatccgcgacgattttcccgacatcgccaagcccggctatctcacggtggacgaggtggcgctcaagggccgcttcaaggccctgatcgacgagctggagagcgacgacttctcccgaatcctcggcgagaagttcggcatcgacctcgtctcctgtccgcggctcaccacgatcatgcggcgcagccagccgaaatacggctcgatccacacggacgggccgtccaaggtgctcaccctcctcgtctacatgaacgacgcctgggacgcgccggccgccggccggctccgggtgctctacgacggaaagaactacgagcccttcgcggtcgaggtaccgcccacgatgggcacgatgttcgctttcctgcgggcggacaattcctggcacgggcacgagcccttcgagggcgagcgccgcgtggtgcaggtggcgtggctgaaggacgcgtcggagctggagcgcaagaagaagcgcaaccgcacggcgcagttcctgaagggcatcttcgggcgctga

SEQ ID NO: 7667 - DNA, 258 bp, Methylobacterium sp.
atgccggccatgaacgacccgagcccctccccactctacattcctgatcatcccgccgccgtccggctcccgcgcgctctggagcgcgccggcctgtggacgatcggcaccgtcggcggcctcgccacgtgcggcctgctggtcttcgcggtggcgacccagagcagcgccgacgcggagcgcatcgccgcgaacagcgactacgccgccggtctggtcgccgcgctcgcgaccgcgcaggcccgcggcggccgctga

SEQ ID NO: 7668 - DNA, 1209 bp, Methylobacterium sp.
atgagccacctcgccaacatcgccgcgaaggtgcttaaccggccccttctgttgcatcccggcaagctcgcggtggtagccgcggtgcttgaaggccgtatcggtatcgatgccgccggcctggcgccggatgccagccgcttcgtcggctcggccgttgatgccgaccccgctaccggcacccgcgggggcctgccctaccgccgaaccgccgagggcgtcgcaatcgtttcggtgcttgggagcctggtcaatcgcggagcgtggatcggcgcgagctcgggcctggtttcgtacgaaggcctcaagttccagctagcgacggccgccacggatccgcgaaccaagtcggtcctgctggacatcgagagcccgggcggtgaggccatcggcgcctttgaggcggccgacatcgtgcgccaggccgccgcgcggaagcccgtggtggcagtggtgaacggcatggcgtgcagcgccgcctatgccatcgcgagcggggccacccgcatcatcaccacgcccagtggcatcagcggcagcatcggcgtcgtgatgctccacgccgacgtgtcaggtgccctggctaaggccggcgtgaagccgaccctgatttacgctggtcgccacaaggtcgatggcaacccctacggggcgctcccggaaggcgtgaaggccgagcttcaggccgagattgagcagttctactcggccttcgtcgcgtgcgtcgccagcggccggcagaacctgtcagccgctgctgtccggggaaccgaggcgcgcaccttcctgggcgcccaggcggtcgctgctggcctggcggatgcggtcggcaccttcgagagcgcgttggcagacctgaccgccggccgcatcaccaccacaacatcccaggttcatcccagcatgagcacacccacccgcgcccagggcgcttcggccagcgcgatgtgggacgacatcgccgccgagatcaacgcgaagcttccaccccaggccgtcttcgcacagcagggcgcccctggggtcgcagccggcgccatgcaggccgatcaggccaccgcctcgcatgccgccccggaacatcgtccaaccgctggccaaccgccttcctcgggcgccatcgactgggccgacatcgccgcggagatgaaggccaaaaatccgaatgccgtccagttctcgcgcgcggagccgccgtaccatggctaa

SEQ ID NO: 7669 - DNA, 678 bp, Methylobacterium sp.
atgcccgtcacgatccacgccgtccccggcggcagtctcagcgaggccgaggtcgcgcgctggcgcgcggtgccggtagcggtcgcggccgacctcgcccgcggggccgaccagatcgatcccgcgatccggccgctcaacccgccggggcgtcagccgcgcctgttcggccgcgcggtgacggcgctctgcgagccgccggatttcggtgcggtgctgcacgccgtcgagcggatcggcccgggcgacgtcctggtgatcgcggccggcgggcgggccgagacggcgatgatcggcgagatcgtgggcggacacctgcgccgccggggcggcgcgggcctcgtctgcgacggggcgatccgcgacgtcggggttctggcgggctggaccgagctctccgtcttcaccctggcgatcaccccgcgcggtccggcctccgccgagcgcggggcggtcaacgcggcggtggtcgtcggcgggcggctcgtcgcgccgggcgacctgatcatcggcgacgacgacgggctcgtcgcgctctcgcccgccacggtgcgggcccgcatcggcgacgcggaggcgaagctcgctcgggaggcggagtgggaggcgagcctcgccgccggccgctcggtctgcgagacgttcgggatcgcggcggcgatcggaggggcggcgtga

SEQ ID NO: 7670 - DNA, 567 bp, Methylobacterium sp.
atgccgcccacctacgtcaccgcctccggcatgccgcgctacaacggaatcgcgcaggccctgcactggctgaccgcgctcctcgtcgccgcggtgctgccgctcgcctgggtggcgacgagcctcgcccgggacgcgccggccaagggcgacatgttcgtgctgcacaagtcggtgggactgacgctcttcgccctcgtggtcgtgcgcatcgtctggcgcatcctccatccggcgccgcccgagcccaggatgcccacggcgctggcggtgctggggcggatcaaccactggctgctctacgcggtcttcctgatcatgccggcgagcggctacctgctgagcgcgctggcgggccgcgcgacgccgtatttctggctgttcaccgtgccgggcctgccgaaggacgaggggctgcagaagatcttccagtccgtccacctcgccgggcaatgggcggtctaccttctggtcggcctgcacatcctggcgaccgtctggcacgtcgcgatccgccgcgacggcctgcacgagcgcatgatgccggtgcaggatcaggtcgggtag

SEQ ID NO: 7671 - DNA, 1005 bp, Methylobacterium sp.
atggagcgcctgtcgatgaacccggccgacctcgccgcgcacgcccatcaggttctgcaggaggcggacatcgccgagctgccgaaccgctaccgcggcaaggtgcgcgacaactacgacctcgcggacgggcggcgcatcctcattaccaccgaccggatcagcgccttcgaccgggcgctcgccgcgatccccttcaagggcgcggtgctgacccggaccgcgcgcttctggttcgagcacacgaccgacatctgccccaaccacgtcctcgcctatccggacccgaacgtcgtcgtggcgaagcgcctcgacatcctgccggtcgaggtggtggtgcgcggctatctggcgggcaccacctcgacctcgatcctgacccgctaccgggccggcgagcggacgatgtacggtcacagcttcccggacgggatgcgcccgaacgagcggctgccgcaggccatcatcaccccaaccaccaaggccttcgacggcggccacgacgagccgctgaccgaggccgagatcctggagaagggcctgctcaccgcggagcagtggcgcacggtgtccgaggcggcgctcgccctgttcgcccgcggacaggcgctcgcggccgagcggggcctgatcctggccgacaccaagtacgagttcggcaccgacgcggacgggcgcatcgtgctggccgacgagatccatacccccgacagcagccggtactggttcgccgagagctatccggagcggctcgccgccggcacgagcccggagagcttcgacaaggacttcgtgcgcaactgggtggtggcccgctgcgacccctaccgcgacccgatccccgagatccccgccgaggtcgtgctggggacggccgccgtctacatccgcgcctacgagaccatcacgggcgaccgtttcgcgctgcccgacccggccgagatcccgctggagcgcgtccgccgcaacctcgcggcggccgggctgctgggcgagccggcctga

SEQ ID NO: 7672 - DNA, 1011 bp, Methylobacterium sp.
ctcccggacgaggcgccgccggtgccggtgacgtgcgatccgcaggcgatcgcggaggcccgcaacaccctgaccgagctcgagccgttcttcgcgatcgtcgacctgcagctgcgcagcatcgtcgcgcagaccgaggaggcggccgaggggttgctgacccagctgcgtacgctcgacgacgcgctcgccgatgcgacggccttcatcggcacgacccggcagcgcatgggcgggctcgtggagcacggcgacacagcctacgcggctctcgccgccgccctccaggcctatctggcgacgcgcctcgcggagacgcgctccgagcgcgagcatctggcggcgatcgccgatcagatgaaggagctcgacggcctgacgcatgtactggagcaggtgggcaacgcgaccaacatgctggcgctcaatgccagcatcgaggcggcgcgcgcgggcgagaccgggctcggcttcggggtcgtcgcgcgggagctccggaccctggcgcagcgctctcgcaccgcggtcgcggatgcgagcggcaaggtgagcgcgatgaaggactccatcgaggggaatttgctcgcagcccgcacggaggcccgcacaaaggccgagcaggcgagcatcgagcgccttctcgccgaggtcgccgcgctgtcggaagccttcgcggccgtgggcgccgcacaggcggaactcggcgcgatcgacgatcggaaccacacgatcacgctccagatcatgcaggccgtcggcagggttcagttccaagatgtcgtacgtcagcagatcgagggaatcggtgtcgcgatgggcctcctgcaccgcatcctcgacgatcagcgggatgccttgacggggatgcagacggcacggtcggcaacgccggccatgctcatggagcgtgtccgctccggctacgtgacgcagattcagcatgagaacgatctgcgcgcccggggccaaatgtcggacgccgccgctctgcccgacatcgagctcttctga

SEQ ID NO: 7673 - DNA, 969 bp, Methylobacterium sp.
atgccaaacgccttgctcgaccggcgcgtcgtcgccctcgcctatgacgggctctgcaccttcgagttcggcatcgccgtcgaggtcttcgggctggagcggcccgagatggggccggactggtaccgcttcaccgtggcgggcgtggagcccggccccttgcgggcgaccggcggcatccgcatcgccgtcgatggcgggctcgatctcgtggccgaggccggcaccatcgtggtgccgggctggcgcggcgccgacgcgccggtgccggagcccctgtgcgcggcgctgcgggcggccgccgcccggggcgcccgggtgatctcgctgtgctcgggcgccttcgtgctcgccgcggcgggcctgctcgcgggccggcgcgccaccacgcactggcgctatctcgacgccctggcgcgggccgcccccgatgccgtgctggtgccggacgtgctctacgtggacgagggcgcgatcctcacggctgccggcagcgcggccggcatcgacctctgcctgcacctcgtgcggcgggatttcgggtgggaggccgccaacatgatcgcgcaccggctcgtggtgccgccccaccgcgaggggagccagaggcagcgcgtcgcgcggccggttccgaccgcgcgggagggtgcgcggctctcgccgctcctcgaccgggtccggacccggctcgaccgtccgcacacgctggtcaccctcgcggccgaggccgggatgagcccgcgcaccttcctgcgccgcttccgcgccgcgaccggcacgaccccggccgcgtggctgctggcggagcgtctggcgagcgcccgagccctcttggagaccggcgcccagccgatcgacgacatcgccgccgcctgcggcttcggcagcgcggcgacgctgcgccaccatttccggacccgcctcggcacgagcccggcgcgctaccgggcggggcaggtccccgcctga

SEQ ID NO: 7674 - DNA, 375 bp, Methylobacterium sp.
atgtcccaggcaggtatgcggaccacgccaacatcgggctggggcagggacgagatcctgatcggcgcgatagaacacgcggccggtaccgcgctggtgctggccgcctgggtcctggtcttcgccgaccaaggcccggctgccttctcggcgctgctcccgggcctgctgatcctcgcgctgacgggggtcaaccagatccgtttccgcccgaccttcgagcgcgcggtcgcactcgccggggcatggacgatcctggcgccgtggctcctcgggttcgcggccaacgacgccgcgacctgggcgcacgttaccacgggagccgtcgctatggccgccgccgtgacccgcctcaggatcgcgagggcttcatga

SEQ ID NO: 7675 - DNA, 297 bp, Methylobacterium sp.
ttgaccgttcacgccaccgaaacggcccgccgcggcgatgtcgccgcgatgatccgggaccgcaaacctgacgggagcgacgcgatgagcagcaccacggacaagatcaagggcctggccaacgaggctgccggcaacgtcaagcagggcatcggcaaggcgaccggcaacgagaagctgcaggccgagggcaaggcgcaggagctgaagggcgagacccagcgcgccgtcggcggcgtcaaggacggcgtgaacaacgccgcgcagaaggccgcggacgccgtcaagggccgctga

SEQ ID NO: 7676 - DNA, 480 bp, Methylobacterium sp.
atgagaacccgtccgcgctgcgccccgcttgccgggcatctgtccggcctcgccgcggtgctcctcgcgggcgcatccgccgtggcgcccgcgatggcggaggagggggcgccgctctatctgcggatccgcccgccggaagcccgcacgacggagaccgggacgggcgggtccgtccgcgacgacggcgctgcggcacctgacggcgctcctccccatgccctcaccgacgcggaagcgatccgccgggcccggtcagcgcgcgaggcggtctgggagcgcagcaacgcgcgcgcgcgcgtcgtcatcgcgtcggtctgcaccggctgcatgaagccgatgccgcccgcgccggtttccgcggatccggaaccggctaccgcaccgcgacccgcggagcccggcgcggccggggcgctcgccgccctgacgccggaccccgcgccccatcgatcccaagctcaggaggacagcccgtga

SEQ ID NO: 7677 - DNA, 780 bp, Methylobacterium sp.
ttgtacgaacctgctgcgccgcgcgaggcggccctcggcccgctctggcacgtggccggcgcccacaccctcttcgccgggccgctgcgctacaacgcggcgcaccagcacggcgcgcccgtcttcctcgccgggctctacgggcccttccgcatccgggtgtggggccaggactgggcgcggtgccggacggccctcgtcccggcgggcctgctgcacgagctcgatgtcggcggcgagccgctgggcgtcctctacctcgaacccggggcgaccggcccggacgcgctcgccgcgctgctcggcggaacgaccgaatccggcggcgctcttctgggcgcggacggcgcggtcgcgcctctgcgcgccctctgggaggcccgggacgcgccccgctgggccggggacgcgctcgccgatctcaccgccttctccggacggcgccgcggcgcgggcgcccgcgatgcccgggtcctgcgcgtggtcgcgagcctgacagcctgccccgacgcggaccagtcggccgcgcgcctcgcgcaagcagtcggcctctcggaatcgcgcctgcagcacctgttcacccgggaggtcggcgtgcccttccggcgctaccgggcctgggcccggatgcgccgggcgatcgaggcggtggtggcgggcgcgaacttcacgggagcggcgcacgcggcgggctttgccgaccaggcgcatttcgcccatgatttccggcggacgttcggagccccggcctcgaacagcctgctcgacatccgacgctga

SEQ ID NO: 7678 - DNA, 1677 bp, Methylobacterium sp.
gtgtccagggtctggcgcatgaccgacgagcgcccccgggcctacagctacatacgcctctcttcggaccgccaactgaagggcgacggcgagcggcgccagaccgagctccgagatgcgttcgtcgaccgtcatgggctcgtcctcgacgacaccctgcgcgacctcgggatctccgcactcgatggctccaaccggcataagggcgccttggggatcttcctcaagaaggttgaggcaggggaggtgccgcgaggcagctacctgctcgtggagagcctcgaccgtctgagccgcgagcacgtcctgactgcgctacgcttgttcctgacgctgatcgatgcgggcatcgtggtcgcgaccctgggcgacgaccgcgtctactcggaagagagcatcaacaacaactggaccgagctcatcgtgtcgctggctgtgatgagccgggcgcacgaggagagcgcccggaaggttcaaaggcttcgggccgcctgggttcgcaagcgcgagcgcacggacgtgaagatgacggcccgctgccccgcctggctcgaactcctcccggacaggcgttcgttcaagcccatcgacgagcgcgtcgaactcgtcgagcggatgctggaggagctcgccgctggcattgggcgcgacaaaatcgccaggcggcttaacgccgaggggaagaggccctggggccacggccgggagtggcacggcgggacggtcacgaaatacacggacaaccccgcgctgatcggcttcttccagccttgccggaaggagataaccgtggcgaacggcattcggcgggagcgccgcatccctgtcggcgacccgatcaccgactactatccccgcgtcatttccgatgacctctggcaacgggcgcgccgggcctccgacaagcgggcgaggcagggcgtcgccaacccgggtggcaggaagggaacggtctacagcaacctcttctcggggctggcggtctgcgacgcgtgtggaaagccgatgaactaccgggatcgaggggtccggagcacgccggtcctacgatgcagcgggaatcggaatggctcgtgtaccaacacggcttacccccgttacgcgcctctggagcgggcgatcatgtcctgggcgcttctgtccgacaggtcgcctcaggctcctgtgcctgccgacgacgctgccgtcgctgccgccgtggaccgccgcgacagggtgcgggcactcgtcgacaacctaatcgatgccattgagaagggcgcggcgctggacgaccgcttggccattcgccaggccgaactcgcgcgtgccgaggaagatcttgtggtggcgcgccgagaggcgagtgccgcaccaccaatctcgacaccggaggtcgcccacggcatcctatccgccattgcgcaccttgacggcatgccggcggacgagcggtacgcggctcgtgccgccgctgcgcaggaacttcgagatcttcttacggaaatccgctgccatgccgatggcagcgtcacggcctgggtcggggatatgggcttccgcatccacctgaagggcgacgaggcccagatcgaaggcggcttcgaaatcaagcccggggagtgcttggtgatgcggtgggagaccaggagcggagtggtgacccagccctccctgccgatgcggaatcatgcttga

SEQ ID NO: 7679 - DNA, 222 bp, Methylobacterium sp.
atgagcgacatcccggccttcccctacaaactgctctggggcgagcgctcggtgcgctcggtggcgaacctgacccgcgaggacgcccgcaccttcttcgagaccgtgctgcaagccggcatcgtcacccgaacgcgcacctactcgctcgccgaggccaacgcggccatcgccgcccaccggtccgggacgcttcacggcgcggccgtgctggtgccctga

SEQ ID NO: 7680 - DNA, 201 bp, Methylobacterium sp.
atgaccctggtgcttcgaaccacttacatccagacggtgcgccgcgtgcgggtgcctgtcgggctggcgcggcgggacgacgcgggtccccggttcatcgcggatggctgtcgctaccggagcatcggaagcctgcaggccctggccctggccattgcggcgtcggcggtgacgccggcgctgctctggctcgccctctga

SEQ ID NO: 7681 - DNA, 786 bp, Methylobacterium sp.
atgctgctctacgagcacccgctctcgtcctacgcgcagaaggtcaagatcgcactgcgcgagaagggcctggatttcaccgccgcgctgccggaggatttcggcaccgggcgccgggaggggcccttcgccgaggccaacccgcgggccgaggtgccggtcctcgacgacggcgcggtgacgctcttcgagtcgacggtgatcctcgaatacatcgaggagcgctggccggagccgccgctgctgccgcgcgagcccgccgcccgtgcccgggcgcggctcaccgaggaggtctgcgacacgcagtacgaggcggtgaactggggctacggcgaggtgctgtggttccgccgcgccgccggcgacctcgccgaccggctcaaggcgcgggccgcgcgccagaccgccgagcttcaggcctggctgacggagcggctcggcgggtccgactggttcggcggctccgacttcggctgggcggacgccgcggcggccccggtggtcaaccgctccgtgcattacggcctcgggccggtcgcgagcagcccgctcgcccgctggcacgcgcgcatccgcgagcgtccctccgtcgccgcgaccttcgcggagttcgaggccgcggccgctcgcatggcggcggcctccgagcactacacgacgggcgggcgccgccgggagtaccgcgaccaccggctcgaatggatggtgaagtccggcggcgtcgaggtggttctggccggcctgcgcgacggcaacatccgcttctcctggccgcacggcgattga

SEQ ID NO: 7682 - DNA, 1341 bp, Methylobacterium sp.
gtggcccgccgcgcggcagtaacgggacggccaccggccgccatccgcgccgccctgccgctggcgcgcccctcgacggcggccggggtcaacacggcccccgccggcagcctcgatacccagagcgccgccccgcaatggggcgtgctcggcaatttcggaggtgtgcgcgacgacctcttccgcgccggcatccgcatggacggcagcttcgactatcagacatcgaccaatctccagggcggcccctatcaatccctgcgcggcgcaggtcagctcgccgtccgttcggccgtcgacatggatcgcctcgccggcctcgccggcggcaccttcaacgtcgctctcacctaccgcttcggccgcggcctcaccgcggaccagcacttcggtgtgctccagcagaccgaggagatcttcggccgcggccggttcccgcgcctgactcagctctcctacacccagcgcttcggcgagttcatcgatctcaagttcggccgcctgccggtcagctccgactttgccggcttcgcctgcgaattccagaacctcaccttctgcggcaaccagcccggcaacctcgtcggcaattactggtacaactggccggtctcgcaatatgccgcccgcctgcggctcggcaacacgagcaccggctatctgatggccggcgtctatcaagtcaatccgcgcgaccttcaggacggcttcaacttcgacccgtccggcgcggcgggcgcactggccatcgtcgaggccgcagccttcccgacgcttccacccttcgcttatcccggcagctatacggtcggcgcgtggtaccagaccggaggtgggcccgacctcttcctcaaccgcgcaggcctgcccctagcgctggccggaggcgtgccgatcgcggaccgcgagcgcagcggcctctacggcgtggccgtacaggaactctaccgtcccaaccccgccaacccgttgagcagcctctccgccttcgtccgcgtcacgatggccaattcctcgacctcgttcatcgacaggcaggagaccatcggcttcgtctacaaaggcttctgggctgcgcgcccgttcgactggatcggcttcggcatcggccagtcgcatgccagccacggcttggcgcagagcatccaactcgccaacctgctcgacggcggcgcccgcccgatccccggatacgagcgcgcgctggaggtcttctacagccttgccctctctcccgacgtggtggtccggcccaacatccagttcatcaatcgtcccggtggcgtcgccggacggaccgacatcgtcgtcttcggcgtcaagagcggcgtcacgttctga

SEQ ID NO: 7683 - DNA, 1386 bp, Methylobacterium sp.
atggaccgttccacgaaccgttctgtcggcatcgccgaatccgagagcgacaccaacctgaccggccgccgcgccgcctggcaggcccgcagcctcgacggcgagacgcgggacctcctcgcccgcgatgcccgcgctttcttgcaccagtcggtctcgacgccctgcctcaacgccgtcgcgaaggccgagggcatctggatcgaggatgtggcggggcgccgctacatggatttccacggcaacaacgtccaccacatcggctacgggcatccgcgcctgaagcgggcgatcgccgagcagatggatgccttgcccttcgcgccgcgccgctacgcctgcgccagcgcggtcgccctggccgagaggctcggggcgatcaccccgggcgacctcggcaaggtgctgttcaccaccggcggctcggacgcgatcgaggtcgcggtgaagatcgcccgcgcggcgacgggacgccacaagaccctgtccttctgggacgccttccacggtgccggcaccggcgcctcggcgatgtcgggcgagatgctgttccgctccgggcctgccggaccgctggttgcgggggcgctccacgtggcgcctttcggcggctaccgctgcccctacggaacggacggtgccgaggcgagcggccgggcctgcgcccgcatgatcgactacgtgctcgcccgtgacaccgacgtcgccgccctcgtcgccgaaccgacccgggccgtcccctacatcccgccgtcaggcttctgggcggaggtgcgccggatctgcgaccggcacggcgtcctcctgatcttcgacgagattccaaccggcctcggcaagaccggccggatgttctcctgcgagcatgatggcgtcgttccggacatcctcgtgctcggcaaggggctcggcggcggcatcctgccgatcgcggccgtggtcgccgaccggcgcctcgacgtcggcggcgactgggccttcgggcactacacccacgagaagaatccggtcaccgcccgcgcggcgctggagaccctcgcgatcatcgccgacgaggatctcgtcgggaacgccgcccgggtgggagcgctcgccctcgagcggctggaagcgatgaaggcgcggctgcccgcgatcggcgacgtgcgcggccggggctgcctgatcggcatcgagctggtgcgcgaccgcgcgacccgcgagcccgattccgacctcgccgaggcggtgctttaccgggccctcgatgccggcctgtcgttcaagacgacgatgggcaacgtgctgacgctgacgccgccgctcgtggtgagcgaggcgcagatgggcgatgccctgaacattctggaggcggcgatcgccgatgccgcagggggccgggcatga

SEQ ID NO: 7684 - DNA, 486 bp, Methylobacterium sp.
gtgaggctctgccgctgggccgcaaggcttctgccggccgtgctggcgctcgccgccccggcggcgcgggccgaggagggcctcgcgccctacacgatcgtcggcgacgcgatccccgaatccctgaccggcgcgccgggcgacccggcccgcggccgggcgatcgtggccgaccgcacccgcgggctctgcctgctctgccatgccggtcccttcccggaggaacgcttccagggcaacctcgccccggacctcgctggcatcggcgcccgccggagcgcgggggaactgcgcctgcggctggtggacgggcgggcgttgaacccggacaccatcatgccatcctattatagcctcacggggctcgcccgcgtgggccgggcgtggcagggccgcccgatcctgagtgcgggcgagatcgaggacgtcgtcgccttcctggcgaccctgcgcgagcccgaggggagcccggaggagcagccatga

SEQ ID NO: 7685 - DNA, 471 bp, Methylobacterium sp.
gtggaacggacgggcgtgctcgaccggcggcaggtgctcgcgggggcggccggcacggtgctggcggtcgcgctgcggccggccgcggcggcggcgctgccgcacaccgagacgacggaatccgccatccggcgcttcgcgggcgacaacccgatccggccgggccgggtcaccctcgatctgcccccgctcgtggagaacggcaacacggtgccgctcggcgtcaccgtcgagagcccgatgacgccggaggaccacgtgcgccgcatcggcgtgttcaacgagaagaacccgcagccgaacgtcgtgacggtgcatctgcggccgggtgccggccgtgcccaggtcgcgacgcgcatccggctcgcggacacgcagcgcatcaccgcgatcgccgagatgagcgacggcacctactggtcggcgagcgcggacgcgatcgtcacgctcgccgcctgcctggagggctga

SEQ ID NO: 7686 - DNA, 321 bp, Methylobacterium sp.
atggcccgcaccctgatcaacctgcccaagaccgccagggccggcgacgtgatcgcgatcaagaccctgatctcgcacccgatggagacgggtttccgccccggcgcggacgggcgcatcctgccgcgcaacatcgtcaccgagttcgtctgccgcttcgaggacgaggagatcttccgggccgagctattcccggcctcggcggcgaacccctacctcaccttcacctgggtcgcgacgcggagcggccggttcaccttcacgtggcgcggcgacgacggcttcgaccagacggagttggcggcgatcacggtggcctga

SEQ ID NO: 7687 - DNA, 792 bp, Methylobacterium sp.
gtgacgcgccgtccgggctccccgctgccggccgtccttctggcgctgctgctcaccggcgcgccgtccggggcggagccgatcgcgcccgcggaccggcgctccggcttcgaccagatgggccccgagatccaggcgatgcagcgggacgacgacgccaatcccggcatgctcgcggtcgcggacggggccgaactctggacgaagccgccgccctccggccgccaggcttgcgccggctgccacggcgaggcggcggcctccatgcgcggcgtggcggcgcgctacccggcctgggacgcgcggaccgggcgcccgatcgacctgcaggaccgggtcaacgcgtgccggcgcgagcaccagggcgcggacccgctcgcctacgagagccccgacctcctggcgctgacggccttcgtcgccgcgcagtcccggggccagccgatcgccccaccggacgatccccggctcgagccggcgcgggcgcagggccgggcgttgttccaggcgcgccagggccagctcggcctctcctgcgcgatctgccacgacgaccattggggccgccgcctcggctcggcggtgatcccgcaggggcagccgaccggctacccgctctaccgcctggagtggcaggggctcggctcgctgcagaggcgcctgcgcaactgcctcaccggcatgcgggccgagcccttcgggtacggcgccccggactacgtcgcgctcgaactctacctcgcgacgcgggccgccccgctgccgctggaagcgccggccgtgcgtccctga

SEQ ID NO: 7688 - DNA, 1344 bp, Methylobacterium sp.
atgacgccggagccgcctcaggtcgatgcgcgcctcgcgcacgacaccgtccgcacggtgaccctgcggctgatgccgctgctcgggctgatgtacctgatcgcctatatcgaccggcagaacatctcctacgccaagctccagatggtcggcgacctcggcctcagcgagagcgtctacgggctcggcgcgtcgctgttcttcctcgggtacttcctgttcgaggtgccggccaacgtcatcctggagcgggtcggcgcgcggctctggttcgcccgcatcatgttcacctgggggctgatcacgatcctgctcggcttcacccggaacaccacgatgttctacgggctgcgcttcctgctgggcgtggcggaggcgggcttcttcccgggcgtgctgttcgcgctgaccctgtggttcccgcaggcgcaccgcgcccggatgatcggctggttcatgatcgcgagcgccttcgccaacgcggtcggcgcggcgatcggcggcgcgctgctcgacctcgacgggctcctcggcctgaaggggtggcagtgggtcttcgtggcgaccggcctgccggccctgatcctcacggtggtggtgctgcgcatcctgccggacgggcccgagcgggcgccctggctgtccccggacgggaaggcgtggctctccgcccgcctcgcccacgagcgcgagagcggggggcaggtggagcaccacaacccgttcggggcgctgctcgaccggcgggtctggatgctggcctcggtctacatcgccttcccgctcgcggcctacgggttgagctactggctgccgaccgtggtgaaggggttcggcgcctcgaacaccgccaacggcttcatcaacatcgtgccgtggctcgtgaccgccttcgcgctgtggtgggtgccccggcgcgcggcgcgcaccggcgaccagctctggcacgtcgtggtgccgggcctcgtggcggcggcggcgctcgtgctcagcgtcgtgctgccgggcgcggcgctgaagttcgcctgcctgtgcgtggcggcggcgggcgtgttctcggcccagcccgtgttctggtccctgccgccgaccttcctgaagggcgcgagcgcggcggccggcatcgcggcgatcaactcggtgggcaatctcggcggcttcatcgcgcagaacgccgtgcccttcatccgcgaccgcagcggcagcgacctcgcgccgatgtacttcctggcggcctgcctcgggctcggcgcgggcctgatgttcgtggtgctctccgcgctccgaagggacgccgcccggcgcggggccccggtcgagccggtggccccgcgcccggcgtga

SEQ ID NO: 7689 - DNA, 1209 bp, Methylobacterium sp.
atgaagggtacgacgatcacgcgcgtctcgacgctgcgcagcgccctgcagccgaacctgctgtgggtggagatcgaggatgccgacggcgtcgtcggcctcggcgagaccttctcgctggccgagacggtggaatcctacatccacgagggcgcggccgactacctgctcggcaaggatgcgggcgacatcgccggacactggacgacgctgttccgccagcgcggccgctccggcatcggcgccgagacccggggtgcggccgccatcgacatcgccctgtgggacctgctcggccaccgcacgggcctgccgctgtggcagctcctcggcggccgctcgcgggagcggatccgcgtctacaacacctgcggcggcccgaactacgtgcgggccgcggcggtggcggggcggcaatataccggcgacttcgtgcgcgacccctacgacgacctctggggcttcatgaacgagcccgagcggctcgccgagagcctcctcgccgagggcgtgcgccacatgaagatctggccgctcgacgacatctcggtggtgaaccaggggctgcacatctccgcgtcggagctgcgcacggcgctcgcgcccctcgcccgcatccacaaggccttcgagggcgagatggaggtcgccctcgagatgcacgcacgctggaccgtgccggtggcgagcaagatcgcccgggccgccgagcagtaccagccgatgtggatcgaggacccggtcaagctcgacaacctgcgcgccatcgacgaggtctgccgcgcgacgacgatcccggtcctcgtcggcgagacccagggctcgcgctacccctaccgcgagatcctcgaacgcacgggggtcggcatcatcatgtccgacccgtgctggaccggcggcgtcaccgagctgcggcgcatcgccgacctcgcggccacctaccagcgcgcgttcacgccccacgactgcaccggcccgatcgggctcgccgccggcgcgcatgtcgccctgcacgccgagaccgcgatcttccaggaattcgtccgcgccttctatcacggctggtaccgcgaggtgagcgagggcctgccgctgatcgagaacggctggctcaccgcggccgaccgccccggccacggcgtcacgatccccgaagaggtccgcaagcgccccgaatggtcggcgcgcacgagccggaagggagcctga

SEQ ID NO: 7690 - DNA, 546 bp, Methylobacterium sp.
atgatcttcgtcacgaacgctgccggaaaggcgatctacatcggcagggaatggaccgatttcaccggtcagacgctggcggaggcggtcgattacggctggatccgcgtcctgcatcccgaggatcgggccgtggtgcgcagcatcgtggccgaggcgatccggcgggaagagcctttcagcgtgcgctaccggctgctgaatcccgcggggcaccacatctgggtgctcggaggtgccgtaccctccttcggaccgccgggccggtgtttcctgggcttcctcggcgcgatcgcgcggatcccggatcccgacgaggcgcgcgcacgggggacgatcggatccttcgatccgtcacaggaccgcgctttggaaaccgcacgatccagcctggagatggcggccgaccacctgatcgcggcgcacgcgcttctcgatcggccgggcggcgcacacctcctgacgggcttgcgcacggtgctctaccaagtgggcctcgaactcgcgaggagcgacggggcggacggctcggaccaagttcactga

SEQ ID NO: 7691 - DNA, 1293 bp, Methylobacterium sp.
atgcacgacatcgagagccacgccctgatcggcggtcccacacggttgcggccgggagtcctgcgcctcctcgtcgccggcatggtggtgctcgcgccgcaggccggacaggccgcctaccgtctggcgccgggtgacagcttggcgatcgaggcggtctccgttccggagatgaaggcgtccagcgtgatcagtgtggacggccaggtctcgatgcccttggtgggccaagtgcaggtggcgggcctcacgctcgcggaggcgcagtcgaagatccaggcgcttctcccgacgaaggagtttcggcgccgcacgaacgagggacgcgagttcccggtcatcctctctccgtccgagatcacggtcacggtcgacgagtaccgtccggtctatctcaacggcgacatcgcccagcccggcgagcagaagttcaagccgggcatgacggtccggcaggccgtctcgctggccggcggcttcgacctgctgcgcttcaagatggacaatcccttcctccagctgtccgagctgcgcgagaagcacaaccgggcctgggtccagtacgcgcgacggcaggcgatgatcgcgcgactgcgtgcggaactcgacggcaagaaggacatcgacgaccgggcgctgaaggatacgccgctcgccccgtcgatcacggccgaactcctggatgtcgagcgcggcatcctgaagacgaagaaccaggatgtctcccgagagaaggcatacctcacggcggccgctcagaaggagggcgaccgcgtccgcgtgctcaccgagcaggagggccgcgagaaggaaggcgtccaggccgatgcggacgagttcaagcgcagccaggacctctacgagcgcgggacgatcccgacgaatcgtctgacggagtcgcgccgctcgctgcttctctcatcgacccgggcccttcagacgacggcgacccgcgcagcgaccgagcgcgagaaggacaccttcgactatcgcctgcagcgcgtcgacgaggcgcggcggctcgaggtgatgaaggagcttcaggacgccaacgtccagttggccgaggcccgcgccacgctccagaatacgagcgagcagttgcgctacaccggcatggtcaagtcacagctcgttcgcggtctcgacggcgatccggccatcgtgatcgtccgcaaggacggcaagcaggtccagcgcatcacggcgtccaacgacacggagcttcagcccggcgacgtggtggaggtcgcgctgcagttcggcgagaccgccgacgtcccgacccgctga

SEQ ID NO: 7692 - DNA, 1401 bp, Methylobacterium sp.
gtgttcaccatgcaggtggcgatcatcggtgtcggctacgtgggtctcgtctcgggggcgtgcttcgccgatctcggccacacggtccgctgcgtcgaccgggacgcggagcgcatcgccgccctccgggccggccggatgccgatctacgagccgcatctcgacgcgctggtggcccgcaccgtcgcggccgggcggctctccttcggcaccgacctcgccgaggccgtgcgggacgccgaggtgatcttcatcgcggtcggcaccccggcccggcgcggcgacgggcacgccgacctcgcccacgtctacgcctgcgcccgcgagatcgcgggggcgctctcgggctacgcggtgatcgtgaccaagtcgaccgtgccggtgggcaccggcgaccgggtcgagcacatcctgcgcggcctgcgtccgcacggggccttcgcggtggtctcgaacccggaattcctgcgcgagggcgcggccatcgccgacttcaaggcgcccgaccgcatcgtcatcggcacgcaggacgagcgggcgcgggccgtgatgcacgccctctaccggccgctggaggcgggcacgcggatcctgttcacggggcgccgctcggcggaactggtgaagtacgccgccaacgccttcctggcgctcaagatcggcttcatcaacgagatggccgacctctgcgagcaggcggatgccagcatccacgacgtcgcccacggcatcgggctcgaccggcgcatcggcgcgcgcttcctgcaggccgggccgggcttcggcggctcctgcttcccgaaggacatccaggcgctgatcaagtcggcccaggacctcggcgcgccgacgcgcatcgtcgagacggtggcggcggccaacgagcagcgcaagcgccgcatggcgcgccggctgatcgaggcctgcggcggcacggtgcgcgggctcaccgtcggggtgctcggcctcaccttcaagcccaacaccgacgacctgcgcgaatcgcccgcgctcagcatcatcacggcgctgctcgacgagggcgccgcggtccgcgcctacgatcccgagggcatggaccaggcccgcgccctgatgccggagatcgcttgcgtccccgatgcctacgcggccgcggagggcgcggacgcgctggcgctgatcaccgagtgggacgccttccgcgacctcgacctgcggagcctgcggcggcgcatggccggcgacgtgctggtcgattaccgcaacctgatcgcgccggaggcggcggcggaggcgggcttccgccacatcggcatcggctgccgccccgccccgccggccgtccgggcccgggtcgcgcgggtccggggcggccgccgcggcgcgcgcgtcggcgcgctcgcggcggcacccgcctga

SEQ ID NO: 7693 - DNA, 939 bp, Methylobacterium sp.
atgacagatcagaacgtgcccagctcgcacgagcccgatcgcgcgcttgccccgaccggcctctgggtccgcgcccaggtccggcaatcgcgccgacaccaggacgggctgctcctcgccctcgaaccgctcgacacgcatcgcccgggccggctcagcgccgtcctcaccggcgagttcatccgccaagtcgaggcggcctccggtgtcctgctcgacccgcatcgcctcgtcggggagcacaccctgctgctgaccctggtggtcgatcccctcctcggcctgaccgggcaggttctcggcttcgagcgtggcagcttcctccaggcttggctcgagcaggatgcggacgtcaaggcctctctcgaggcgcacgggctctggggccgccagcgcagcctgccgaccccgaagaagctccggcgggtcgtgctgattgagccagacgatggcgcacctcatccgctcggcgggacgctggcgcgctggtatgatcagggtatcattgagctgatccggttgcccgtagcctacgaagagccgggctcggtcgccgcactgcacgaggccttcgggtcggctttcgatcagtgggagtggggcacgctggacactgtggtggtcgagcctggcctcggctttgcgcaccgggcgctgtccgacgagagcctcatgcgccgcatcgccgtgctgccggtgccggtgctgttccgccgagccggggcaccgacgctgctcgatgggatggccttccgcgcctgcgacaccgccgaggcgatcctgaccgtcctcaccgagatcctgcgcggcgagatcagagcgggcggtcagccgcgcctcgaggcgatcgcccgcgagatcggtgcggccccggctgcgactgtgtctgaggctccgtccgatctcgaagcttcccgacaggggccgctcttcgactga

SEQ ID NO: 7694 - DNA, 921 bp, Methylobacterium sp.
atgacacatcacgatctgcccgccgatgcggacgcgaccgcctgcgcgctcgagcccgatggcttgtgggtgcgggccacggcaagtcggcctcgccgtcatcgcgacggctggctgttcgaccttcaggcgctcgacccgacgcgcagcggtcggcttaccgctttcatgtccgctgacttcacggaccagatcgagcaggcctcgggcattctgctgcacgaggaggatctcgtcggcgaccatacggttctgctgacgctcaccgtcgatccgctgctcggcctcaccgggcgaattgtcggattggatcgcggcctgatgctgagggcttgggccgagcgcgacgcgcgggtgcgggaggcgctcgacgccaacggcctctgggaacggcagcgcgaattgccgatgccgcgccggctgcgccgggcattcctgctcgagccggacgatggcgcgccgcacgcgatcgcggatggtctcgctcgctggcacgaactcggaatgatcgcgctgatccggcatcctctcgcgttcgaggagccgggttcggtggcagcgcttcaccgcgctctcgatgccgccctcgatcaatatgagtggggcacgctcgacgcagtgatcgtcgaaccgggcacgggcttcgccttccggtccctgtcggacccggggttggcgcagcagctgtgcgagttcccggtccccatcctgacgcggcggacgcggccggtgacgctgctcgacgggctcgccttccgcagcttcgacaccgcacccgaactcgccgcgctactgatcgaaatcctgcaccgcgaactgcgtgaggccgaccggccccgcctcgaggcgatcgcccgcgagctcgaaccggcaccggcggccgaagatcggccagtcaacggggcagcgctcttcgactga

SEQ ID NO: 7695 - DNA, 753 bp, Methylobacterium sp.
gtgccgcgcgtcgggctcggggggctgccgatcgcggtgcacgggcgccgcgaggccaccgcgctgctcgtcgatctcgccctcgatcgccgggaccgggtcgagccgcccgcgatcatcacctcggccaacggtcaggttctgtcgctctgcgcgcgcgaccccgagatccggcacctgttcgaggcgagcgacctgatccacgcggacggggcgcccctggtcttcgcctcctacctgcgcgcgcgcgcgtgccgcctgcccgagcgggtcgcgaccacggacctcttccacgacgtcgcccgggaggccgtgcgcctggacctgagcttctccatgctgggctcgacgcgggagggcatggcgctggccgaggcgaacgtgcgggcgcgctacccgaccttgcggctgctcggtgcgcatcacgggtatctggacgccgcgggcgaggccgatcaggtccgcgcgatcgcgcgggcgcggcccgacatcctctggatcggcatgggcgtgccccgcgagcagcggttcgccctgcgctggcgggcggcgctggcgggcgtcggcgtgatcaagacctccggcgggctgttcgacttcctgtcgggcgcgcgccgacgggcgccggactggatgcagcgctgcggcttcgagtgggcctaccgggcgagcctcgaaccgaggcgcctgctgccgcgctacgccgtgacgaacccgcacgccctctacctgctgctgacgcggcgcggctag

SEQ ID NO: 7696 - DNA, 843 bp, Methylobacterium sp.
atgcaccgcaatgccgtgatcgcgcccgagcggcctcgtgccgcgccgcggttcgcccgcctgtcggcggcagcgacgatcggcctcgcgctgctggcagccggggccgcctcggcagcgcccttgaccctgcctctgccggaacccctgccggcggtgcgcgtgctgaccctgctcgtggggctgcacctcgtcggcctttgcttcggcctcggcggggcgacgatgctcgacttctggatcctgcgctggatgcgctggggcagcctgccgagcgagatcgcgcgcatcttcctgttcatcagcaaggtcgtcagcgtcggcatcgggctgctctgggtctcgggcctcggcttcctgatggtctacgccctggagagccccgagaagctccagaacccgaagctctgggccaaggtgacggtggtggcggtgctgacgctgaacgggctcgtcatccatgccctggtcctgccgggggtgctgcgcgatgtcggccggccgatgctcgacgggatctccggcacccgcaccggcgtgttcctcgtctcgggggcggtctccggcgtctcgtggtacacggccttcgcgctcgggctgatgcgcgagctgaacggcagcgtggcctacgggctcctgatcggtctctggatcgccggaatggtcgcggcctcgctcggcgcgtacatgttctggctgcatctgcgggagtggagcgcgcggcgacggcacaggccgcccgcggatgcacccgcggtgcgcgcgcgtgccccgctcgccggagcgcagattccggtcagtcagctcgtgccgatccacggtccgtccgcgcatcaggcctga

SEQ ID NO: 7697 - DNA, 1257 bp, Methylobacterium sp.
gtggcctcggtcgcggagggccctctcgatatccgccacatcgtcatcgccgatcgcgagggctatccctccgcctcgaacggggttcatcaagtcgctcgctccctggctctcgagcaggttcgcgcaggggacgcttcccggatcattttcgcctctgatgacccctctggcatcgccgtgccggacggtattcggctcgaccacataccgctcaccgggccgtcctttctgggacgcgtcgtggcgctcggggcctcaagccgcgaggctcttctcgctgacgtcggaccgcgcacggtgttccaccttcacggcgctcgcaagccgctcctcgtcgcgctgacgcaccatctccgagcgcgacgctatccctacggttttacgctgcacagctgcttctctcacttgttcaaccgagatggtcgggtgttgaagccgctggtcgtcttatacgctacgctcttcgagcgcgcggcactcaccggtgcccggttcgtccatgtgctcaccgatttggagcaggcagaactcggacgcatcgcgccccgtgcgcgcgcccacttgataccgaacggcgccttctccagcgcgggatctcagatccctccgccgcccgagcgagtcggtaggacggacggcaacccggtattcgggttctgcggacggctggcggtattccacaaagggctcgaccttctggtcgacggtttcgcgctgcattgccgacggaacggacgcgggcgcctcgttctaatgggaccaggtacgagtagcagtagcctcacagcgcgtgctgatgcgcttgggatcgcggatcgcgtctccgtgctggagcctcgttacgggcgagagcgggatgccgtgatccgggagtgggactactttgccgctccctcacggctggaccattggccgaccgcggcccttgaagctgcgctgctcggagtgccgtccctggccagccacgagaccggactgcacagtgtcatagctcggtacgatgccggcctgcccatcgcagacctgacgccggaggacgtggccgaaactctggcccaggccgaacgcattgagccggcgcgatggcggacgatgtcggccaatgcataccgcatggcccgcgaaatcgcagactggagcgtcgcagtcgcgcgctttcgtggcctctaccagggccggactgagggcggctcggccatccggaccgttgcgtccgaaccgtcggctgtcggtcgctccgtgaaagggcgctga

SEQ ID NO: 7698 - DNA, 1359 bp, Methylobacterium sp.
atgatcgagcccaggcgccgccgggcaagagcccgcttgagcaggttcggtctcctgcccctgtcgctcgcggtgggcggcgtccgaccgctggattcgaccaaggcatcgtatcggggagagcctctcgatatccgccacgtcgtcatcgctgatcgcgaaggctatccctccgcctcgaacggcgtccatcaggtcgcccgctcgctggcgttcgagcaaatccgcgcaggggacgcttcgcggatcatcttcgtctcggacgacccgtccggtatcgcggtgccggacggcgtccggctcgatcacataccgctttccgggccgaccattctggggcgcgtcgtggcactcggcgcatcgagccgcgaggctcttctctgcgacgtcggaccccgaacgatgttccacttccacggggctcgaaagccgctccttgtcgcactcacacgccatcttcgggcgcgaggccatccctacgccatcaccctccacagctgcttctctcacttgttcgaccgcgagggtcgggtcctgaaaccgctggtcgccttgtatgtcgcaatcttcgagcgcgcggcgctcactggagcccggttcgtccatgtgcttaccgatctggagcgggcagagctcggacgcctcgcaccccgcgcgcgggcccaccagattccgaacggcgccttctccagcgctggatcccagatcccgccgccacccgagcgggtcatagggacggatggcagtcccgtgttcgggttttgtggacgtctcgcggtgttccacaaggggatcgaccttctggtcgatggcttcgcgctgttctgtcgccagggagggcgcgggcgcctcgtcctgatgggaccgggcacggacggcggcagccttgcggcgcgggccgctgcgctcggtgtcgcggatcgcgtcactctgatggagccccgctacgggcttgagcgggatgccgtgatgcgggggtgggactacttcgttgccccctcgcgtctggaccattggccgaccgcggcgctggaggcggcgctgctcggcgtaccggtcctagccagccacgagacggggatgcccgacatagcctcgcggtacgacgccggcctgcccatctcgggccttacgcccgaggatgtggccgagaccctggcacgggccgcacgcatcgaaccggcgcgatggcgactgatgtcggccaacgcttaccgcatggcgcgcgaggtcgctgactggagcgtcgcggtcgtgcgctttcgtagcctctaccagcctgaggcagaggcgcgtccagacactcgggccgttgtgtccggagcgtcggccggcggtcgtcacgtgcaggcgcgctga

SEQ ID NO: 7699 - DNA, 234 bp, Methylobacterium sp.
gtgacctacagcatcgtcgactgcccggacgggcggttcgcggtcgtggccgtctcggcttcgggcgccgcctatcgccgcgacgggttcatgacgctcgccgacgccgagagctgcgccgagggcttgtccgccatcatggcggtctgcggcacgccgctcacgcggcaggatagcaggggtccctcgacctgtccgggcttcccctccaggccgatctggcgatcgttctag

SEQ ID NO: 7700 - DNA, 348 bp, Methylobacterium sp.
atgatcgcggtgatcttcgaggtctggcccgcgcccggccggaccggggactatctcgatctcgccgccgccctgcgggaggatctctccggcatcgacggcttcatctcggtggagcgcttccgcagcctgaccgagccggacaagctgctgtcgctgtccttcttccgggacgaggcggcggtgcgggcctggcgcgagcggccggggcaccgggccacgcaggccaagggccgggccgggatttttcgggactatcgcctgcggatcgcggcggtgatgcgcgattacggcctgaccgagcgggagcaggccccggccgacagccgggccgcccacccggcgtga

SEQ ID NO: 7701 - DNA, 681 bp, Methylobacterium sp.
gtgcgacgccagaacccggcccgccgcatcggctgcgcccggcgcctcgttgacacgttggagaccgccgtgaagtcgctcaccgcctcgatcctctgcctcgccctgtccctctcgacacctgctctggcccagaccgcccccacccgcgacccggcgcggatccagggcggcacctacattgtcgacgtcgctcacacgcaggtcggctggcgcgtctcccatatgggcttctcgaactatgccggcggcttctcggacgtctccggcagcctcgtcctcgacccgaagaacccggccggctcgaagctcgcgatcaagatcccggtggcctcggtcgcgacgaccagcgccaagctcaccgacgagctcaagggcgaccagtggctcgacgcgggcaagtaccccgagatgacgttcgtctcgacgaaggtcgcgcccgcgggcaaggacaaggccaaggtcacgggcgacctgacgctgcacggcgtgacaaggccggtgacgctcgacgtcaccctggtcggtgccggcaccaacccgctcaacaagaaggtcacggtgggcttcgaggccacgggcacgctcatgcgctccgatttcggcgtgaagacctacgtgccgctgatcggcgaccagctgcacctgaccatcgccggcgccttcgagcgccaggactga

SEQ ID NO: 7702 - DNA, 1476 bp, Methylobacterium sp.
atgttcgctgcccgaaagaccctgcaggcccgcgccaagctcgcggctctcgaccgggtgcaggcggtgatcgagttcgatctcgacggccgcattctctcggcgaacgacaacttcctggcgctgatgggctacaccctgccggagatcgccgggcgacaccacgagatcttcgtggagcctacacaccgtgcctcgcccgaatacaaggctttctggcagcggttgcgcgccgggacctttgaggcggcgcagttccggcggatcacgaaggacggccgtgaggtctggatcgaggcctcctacaacccgctgatcgggcgcgacggccggccctacggcgtggtcaagttcgccaccgacatcacgcggcagaagcaggaggacgccgaccgggccgggcagatcgccgcgatccgcaaggcgcaaggggtgatcgccttcgatctcgacggcacggtcctcgacgccaacgacaacttcctggccgctgtcggctacgaccgggacgaggtggtggggcgccaccacggcatcttcgtcgatccgcgcgagcggacgagcgcggactacgccgccttctgggcgcgcctgcgcggcggcgtctatcagagcgcgcagttccggcgcctcggcaagggcggccgcgagatctggatccaggcggtctacaacccgatcctcgacgcctccggccggccctacaaggtggtgaagttcgccaccgacatcaccgagcagatccgcctgctggagagcctgcgcacgctgatcgaccggaatttcggcgagatcgagagcgcggtctcgcattcgagcacggccgcggcgaccgcgacgcgggccgcgcacacgacctcgggcaacgtgcagacggtggcggcggccgccgaggagctggcggcctccgtcagcgagatgtcccagagcatcgtccgctcccagggcgcgacggacaacgcctacgcctgcgtgcaggccgccgacggctacaccaagcggctggccgagacggcgaccgcgatgaccggcatcgtcgggttgatccagaccatcgccgggcagatcaacctgctggcgctcaacgccacgatcgaggctgcccgcgcgggcgatgcggggcgcggcttcgcggtcgtggcctccgaggtgaaggcgctcgccgaccaggccgcccgggcgacggagcagatcaacaccgagatcagcaacgtgcaggcggtctcacacgaggtggtgggggcgctcggctcgatccgcggctcggtctcggtgatgcgcgagaccgtggtggcgaccgccgccgccatcgaggagcagagcgcggtgacccgcgacctcgccgagaacatgcagagcgcgtccggcgccgtcacctcgatcaccggcagcatcggcgcgatcgccgcggccgtggatcaggtctcggcggcggtgagcaccacgcgggacgccgcgaaggtgctggcgcggtag

SEQ ID NO: 7703 - DNA, 459 bp, Methylobacterium sp.
atgccggatctcgacgacaccgaccgccggatcattcgggttctccggatggaggggcggatcagcaatgccgatctcgccgaacgcgtcggcctgtctccgtcggcctgccaccgacgcgtgcgacatctggagagttccggcgtgattcgaggctacgcagccctgatcgatgccctgccgggcgacgggaatctgatcgtcgtcacgcaaattaccctcgatcgccagaccgaggaattcctgaaccgcttcgaggcggcggtgcgacggtgtccggaagtgcgtgactgttacctgatgaccggtatcgcggattacctcctgaaactggaggtgaaggatgcgggcgattacgagcgcctgcacaaggacgtgctctcgcgcctgccgggcgtcgcacgcctgcaatcgagtttcgccattcgagcggttgtgaacagcgcaagacatgcctga

SEQ ID NO: 7704 - DNA, 249 bp, Methylobacterium sp.
gtggacgctgtgcagcgggtggggagctacctccaggtgcaggacgaggagggctgtcggcatctcctgcgcgtgacggccgtccaggcgctctcggacacggacccgctgcgcaacgagaccttcatcacggccgccggccgtacgatccgtgtgccgcaatccctcgacgcgatcgtgggcctgatcgcgccgggcgagcgtctggcggccgatggagagccgcccgacgccgtttggccgttctga

SEQ ID NO: 7705 - DNA, 321 bp, Methylobacterium sp.
atgcgtctcgctcgatcgatcggccctgtaaccgtcctgctcctcgcagcactgcccgcagccgcacaggacaacaagcccgccgcgatccgccagcccggcccgccgcagatcgtcccgcccggtacgccgcccggagcgacgatcatccccgacgagagcggaaacagcggccccgccgcgaccggcacgcgcgcgccgacgggcctgggcgccaccacgatgaacaccgattcggcggcggccggcaacgcggcggaccccgagcggggcgtgccgaaggtgggcggcggcggtggagacgggggcggcggtcagtag

SEQ ID NO: 7706 - DNA, 4911 bp, Methylobacterium sp.
atggccatggacacccatccggaccctgcccaaggatctgttgcccaaggatccgttgcccaaggatccgttcaggagcccgccctggagaccgccaccgcgctcgccagcgcggcggcgaaatccgcccgctccgacctgatcgaggccgccgcgggcgcggccgaggggcggggcgagccgggcggcttcgtgcgcgacctgttcgggcgggtgccgccggaggatctcgccccctaccccgccgcggcgctcgccgagctcgccgcccgcgcccgcgcgcacctcgccgagccgcaccggccgggcgaggcggcgagcgtgcggctgcacgacgtcaccgtcatccgggacggacggccgcgcgacctcaccctcgtcgaggccgtcaacgacaaccggcccttcctgctcgattcctgcctcgcggaactcaccggccaggggctcgtgccgctgctcgtcgcccacccgatcctcggggtcgagcgcgacgaagggggcgccctccggcgcgtcgtcggcgagaccacggcggaggccgcgggcgggctcgcccgcgagagcctgatccagatccatctcgaccgcctggagggcgagccgcgccgccgcctcgaggccgggctcgtggcgaccttcaccgacgtcgcggtggcggatgccgaccggcccgccatgctggagcgcctggaggcgctggccgcttcctacggcgagcgcccgacgccgctgcccgcggacgagatcgacgaggcccgcgccttcctgtggtggctgctcgacgggcacttcacggtgctgggcctgcgcgagcacgggctctccgcggacgggaccgagacggaggccgagggggcgagcctcggcgtgctgcgcgaccccgcgctcgcggtcctgcgccggggccgggaactcgtcgggctcagccccgagatccgcgccttcctggccgagccgcaggcgctgatcatctcgaaggcgagcgtgaagtcgcgcgtccaccgggcggcgcatctcgactacgtgggcatcaagctgttctcggatgcgggcgcgctcgcgggcgagttgcgggtggtgggcctcttcaccgcctccgcctacacggcgcccgcccgcgaggtgccggtgctgcgccgcaaggtggcggcggtggtggcgcgcgccgggctcgacccgacgagccatgccggccgcggcctgatcgcggtgctggagacctacccgcgcgacgacctctaccagatcgacgtcgagcgcctgacccgcttcgcgctcgccatcaccgacctcgccgaccggccgcgggtcagggtgctctcgcgcatcgaccgcttcggccgcttcgtctcgctcctcgtctacgtgccgaaggaccgctacgacacccgcgtgcgcgcccggatcggcgcctacctcgccgagtcctacggcgggcggctctcggcctcctacgcggacatgccggaggggccgctcgcccggctccacgtcatcgtcggcctctccgagggcgcgcccgagcgcgacccgagcgtgctggaggcgggcgtcggcgcgctggtgcgcacctgggcggacgggctgcgggccgcgctcacggagtcccgcgacggcgcggaggcgcgccgcctgttcggggcctacgcggaggccttcggggcggcctaccgggagaacttttcacccgaggtcgcggtctcggacatcgccatcctggagcggctctcggaggccaatccccgcgccgccgatctcggccggcgcgaggccgatccggattcccaggtccgcctcaaggtgttctcccgcggcgcggcgctcgccctctccgaccgggtgccggccctggagaacctgggcttccgggtgatcgacgagcgcacctaccgggtcaccgcgccggacggggcccgggtctggctgcacgacatgctcctggagcgggcctccggcgcggcggtcgatttcgcggcgctggagcgcccgctggaggaggcgctgatcgcggtcggcgagggccgggccgagtccgacgcctacaatcggctggtgctggaggccgccctgccctggcgcgaggcggcgctgctgcgcgccctcgggcggtatctccgccagctccgcatccgctacggccaggactacctcgcggcgaccctgagccgccacccggcgatcgcccgcggcatcgtcgccctgttccgggcccgcttcgaccccgggctcgcgggcgaccgcgaggcggcccagcgcgccctgcgcgaggagctggagacccacctcgccgaggtgacgagcctcgacgaggaccggatcctgcgccgcttcgtcaacctcgtggaggcggccgtccggaccaacctctaccaggccgggccggacgggggcccgcgggagacgatcagcgtcaagttcgcctgcgcggcggtctccggcatgccgctgccgagacccttcttcgagatcttcgtctattccccccgcgtcgagggcgtgcacctgcgctacggctacgtcgcccgcggcggcctgcgctggtccgaccggccggaggactttcgcaccgagatcctgggcctcgtcaaagcccagcaggtgaagaacgccgtgatcgtgccggtgggcgccaagggcggcttcttcccgaagcgcctgcccccggcctccgatcgcgccgcctggctcgccgaggggaccgagagctaccgggtcttcatccgggcgctgctcgaactcaccgacaacatcgtggacgggcagatcgtgccgcccgccgacaccgtgcggcaggacccggacgacgcctacctggtggtggcggccgacaagggcaccgccaccttctcggacatcgccaacgcgctctcgatcgcgcgggggcactggctcggcgacgccttcgcgtcgggcggcagccagggctacgaccacaagggcatgggcatcaccgcccggggcgcctgggaggcggtgcggcgccacttccgcgagatggacgtggacgtgcagacggaccccgtcacggtggcgggcgtcggcgacatgtcgggcgacgtcttcggcaacggcatgctgctctccgagagcctgcggctggtggcggccttcgaccaccgcgacatcttcctcgaccccgatcccgatccggccacgagcttcgccgagcggaaacgcctgttcgggctgccccgctcctcctgggccgactacgacccgggcctgatctcgcggggcgggggcgtgttctcccgcagcctgaaggcgatcccgctctcccccgagatccgccgggtgctcgacatcgaccgggcggaggccgcgcccgccgaggtgatgcaggcgatcctgcgcgcgcccgtcgacctgctgtggttcggcggcatcggcacctatgtgcgggcgggagcggagaccgacgcggatgcgggcgaccgggcgaacgacgcggtgcgcatcaccggcgcggaactccgcgccaaggtcgtcggcgagggcgccaatctggggctgacccagcgcgggcgcatcgaggcggcgcgcgcgggcgtgcggctcaacaccgacgcgatcgacaactcggcgggcgtgaacacctcggacgtcgaggtgaacatcaagatcgccctgatgacgccggagcgcgacgggcggctggggggtgaggaccgcaacagcctgctcgccgcgatgaccgacgaggtcgcgcggctggtgctgcgcaacaacgaactccagacgctcgccctctcgctcgccgagcggcggggcgcgggcgaggcggccttcgcggcccgcacgatgcaggtgctggaggcggaaggccgcctcgaccgggcggtcgagttcctgccggacgacgccgtgctcgccgagcgcctgcgccggggcgaggggctgacccggcccgaatacgcggtgctgctcgcctacgccaagctcgcgctctacgacgcgctgctggcgggcccggcggtcaacgacccctatttcgaccgggagctgcagcgctacttccccggggccctgcgggagaaattccccgacgccgtgaaggggcatcgcctgcgccgcgagatcatcgcgaccgcgctctccaacatcatcgtcaaccgcggcggcatctcgctggtcacccggctcgccgacgaggcgggggcggagcccgcttcgatcgcccgcgcctacgcggtgacccgcgacgccttcgggctgatggagctgaacgcggcgatcgacggcttggccggccgcatcccgggcgcggcccagctcgacctctacgcggcggtgcaggacctgctcaccgggcgcatcacgtggttcctgcgcgagatcgacctctcgggcgggatcgcgccggtggtggcgcgctaccgcgacggggtgagcgcgctggtcgccgcactccccgaggtgctcgacgcggaggcccgcgcggcgctggaggcgcgccgggcggagctcctcgggctcggcctcggcgaggccgcggcggggcggctcgcggcgctcggccggctcacggccgcgcccgacatcgtgcgggtcgccgagaccagcggccggccggtggcggagatcgccgcgacgcatttcgccctggagcgggcgttccgcctgggcgacctcgccgcggaggccagggccgcgcccgtctccgacaccttcgaccgggtcgcgctggagcgggcggtggcgggcatcgcccgggcccaccgggcgctcaccgccgaggtggtgggcgacggcggcgccggtccggaggcggtcgaggcctggatcgcggcccggggccccggcctcgcccgcatccgcgcggcggtctcggggatcgccgcctcggggctcaccgtggcgaaggcgagcgtggcggcgggcctgctcggcgacctggcgcgggcgtga

SEQ ID NO: 7707 - DNA, 234 bp, Methylobacterium sp.
atggcgcgcatcgcgatcctggtcggcacgccggccggcacccggctcctggcggcctcgaccgagcgggaggccgcccacagggtcgagcggctgctgatcgacctcgaccgggcggccctgccggcgccgctctgggtgcagtgcgccgacgcggccctggccgagcggctgagcgcctatctggcgggcttccaggccgagctcacggccgcgcccgcggacgggacgtga

SEQ ID NO: 7708 - DNA, 231 bp, Methylobacterium sp.
atgaagccggttcagatgcggatggctcgggcggcgcttggctggggcgtccgcgaactcgccgaaaaagcgggcatcacggccaacacggtgacgcgcatcgaaaacggtgccgacgcgaagcaatccacgatcgacgctctcaagctggccctcgaaacggccggcatcgagttcatcccgcagaacgggggcggccctggcgttcgtctgcgggagcctcaggcgtag

SEQ ID NO: 7709 - DNA, 801 bp, Methylobacterium sp.
atgaccggccctgatcccggcgcggagccgccgaagccgagcgacagctatcttcagtccttcgcgcgcgggttggccgtcatccgaagcttcaacgcgtccgcgcccgcgcagacgatggccgaggtcgccgagacgaccggcctgacccgggccggcgcgcggcggatcctgcacaccctgcagacgctgggctatgtcgagctcgagggccgtcacttccgcctcacggcgaaggttctggatctcggcttcgcgtatctgtcgtccctgccgctgtggaacctggccgagcctcacatggaggatctcgtgcaggtcgttcaggaatcgagttccgtggcggtgctggagggcgcggagatcgtctacgtcctgcgcgtgccgacgagcaagatcatgacgatctcgctcggcgtcggcagccgcctgccggcctactgcacctcgatgggccgggttctgctcgcggccctgccggacgaggaggtgctggtccgcctccgccgcagcgcgctggtgccgaacaccccccggaccgtgaccgagatcgacgacctgatgcggatcatcgcggaggtccggcagcagggctacgccctggtcgacgaggaactcgagcggggcctcatctcgatcgccgttcccctgcgcggccagaacgacaaggtgatcgccgccatcaacgtcggttgccacgcgcgccggggaacggcgcacaggatccgcacggagttcctgccgccgatgcgggcggccgcggacgcgatcggccgcaagctgcggcaggtatcccgctga

SEQ ID NO: 7710 - DNA, 957 bp, Methylobacterium sp.
gtgagccgcctcccccctctcctccgcgagaacctcgccctgccggtgatcgcctcgccgatgttcatcgtctccgggcccgaactggtgatcgcccagtgccacgccggcatcgtcgggtccttcccggcgctgaacgcccggccggcggcgatgctggacacctggctcacccgcatcaccgaggagctcgccgcggcgcgggcggccgatcccgcggcccggatcgcgcccttcgcggtcaaccagatcgtccacgcctcgaacgaccggctggcgcaggatgtcgagacctgcgtgaaccaccgggtaccgatcgtcatcaccagcttgcgcgcgccggacgccgtggtgcgtccggtccacggctacggcggcctcgtcttccacgacgtcaccacggtgcgccacgccgagaaggcgctggaggccggcgtcgacggcctgatcctggtctgcgccggggcgggcgggcacgcgggcacgctctcgcccttcgcgctggtgggcgaggtgcgccgcttctacgacggtccgctgattctgtccggcgccatcaccacgggcgcggcgatcctggcggcgcaggccatgggcgccgatctcgcctacatgggcacccgcttcatcgcctccgcggaggcgaacgcggtgcccgcctacaaggacatgatcgcgggcgcgagcgcggcggacatccgctacacgcccttcttcaccggcgtgccgggcaactatctcggcccgagcatccgggcggccggcctcgacccggatgccctgccggtcgccgacaagagccagatgagcttcgccagcgaccgagcgaagccctggcgcgacgtctggggagcgggccagggcgttggcaccattccggacgtgcggccggtcgccgagatcgtggccggcctgacgcgggaataccgcgcggcgcgcgccggcctcgcggcctga

SEQ ID NO: 7711 - DNA, 801 bp, Methylobacterium sp.
atgcgccgtttcgccctcagcttcatgctcgccgtcttcgctgccggccctgccgcggccgaacaagatctgctgctcggtgccgatatgtcctcacccgccatgacgaaggccgagatgagccgcgccgacgtcgaggcgatgatccaggacgcgaacggaaagcccatcgacctgcacgacaaggcgctgtcggggctcgatctctcggggctgaatctccggggcgtcaacttacgcactgcgcgcctgaacaaggccaatctgcgcggcgccgatctcagcggcgcaaacctcgaacaggcatggctcctgaaggcagacctttccggcgccaagctcgcagacgcgaagatgttcggcatcacggcgcgggacgccaacctcagcgaggccgacctcagccggtccatgcccatcggcgatttcaagggcgccaacatgagcggcgccacgctggtcgatctcaagggcggagccgacatcaagaatcagtccatgggtctgatgcgggcggtgttcacctcggtgaacctgtcgggcgcgaacctcaggggagccaacctcggccggtcacgcctggagtatgcgaatctcaaggatgccgatctcaccggcgtggtgctgatgggatcggacttgtccggggccaatttgaccggtgctacggtcacgggcgcggacttcaagaacgtcgacgtcagcggtgcccggctgatcaacctcaagggtcagtccgaggccaaggactgggcggagagggtgaacatcgaccgtgccgtcactcaggcatccaattga

SEQ ID NO: 7712 - DNA, 1215 bp, Methylobacterium sp.
atgccgagcttcgcctaccgggcctacgcggcggacgggcgcgcccgctcgggcaagatcgaggccgagagccggcagcgcgccgtggcggcgctccgggccgaggggctccaggtcttcgcgatcgaggccgccgccgccgggccggtcgcgttctggaaccgcgacctgttcgggcgcgaccgggtgaacgacgccgcccgcatcgccttcctgcgcgagttcggcacgctgctcggcgccgggctcacggtggaccgggcgctccgcctcgtcgagcggcaggcctcggcggcgctccggccggtgctctccgacctcctcgaacgggtggtgggcggcgcctccctgtcccgggcgatggcggcccatccgcaggccttcccgcgcgacatggtggacatcgtccgggccggcgaggccaccggcacgctcaccgacgtgatcgcctcgctcaccggctcgatcgagcgccgcgacgcggtgcgccgccacctcgtctcggcgatgatctacccgggcctgctcgtgctcatggcgatcggcaccgtggcgatgatcgtcggcgtgctggtgccggcgctcgcccccctgttcgagggcagcgggcaggcgccgccgctggcgatccgcgcggccgccgccctcggcgacggcatcgcacggtggtggcccgggttgctcgccggtattgcgctcggttttctcgtcctcgtccggttctggccggcaccggccttcgcggcgttccgggcgcggctggcgctgcgcctgcccctggtgcgcgagatcgtggtggggatcgagctcgggcggatctgtcgggtgctcggcacgctgctccaggccgaggtgccgatcccggacgctgtcgcggccacgcgccccatcgccggcaaccgggtgttccgggatgcgctggcgcaggccgggcgccgcctcaccgagggcggcagcctcgcctccggcctcgccgctctgcgcccccacgcgccctcgaccctcaacctcatcgccagcggcgagcaggtgaaccggctgggccccgtgctggtccacgccgccgagatgcacgagacgcagacgcgccagcgcatcgaccgcctgctcgccctgctcacgcccctcgtcacggtcgtgatcggcggcctgatcggcggcctgatcgtctccgtgatgggggcgatcctgagcgtcggccagctcgcccagtga

SEQ ID NO: 7713 - DNA, 267 bp, Methylobacterium sp.
atggagcggctttgcgatctcctggggcgccgcctcatcatcgcgtgtatgccctgcggacgacgtggccactacgacctcgaccgcctgcggcaccgcttcgggcagcacgcctgcgtctacgaggtctacgttcggttgacccagacttgccaatatcagcaccccatcggcgcgcggcggccgaaccagtacggccgagcttgcagggcgcagctagacaccgatgagatcgggcacagccgaacgcctccctcgcgcacgtga

SEQ ID NO: 7714 - DNA, 87 bp, Methylobacterium sp.
atgctcaagggtggcctgctctggctgatcggcataccgctgccgatcatcctcctgatctacttcttcaccaactggctgcactga

SEQ ID NO: 7715 - DNA, 1479 bp, Methylobacterium sp.
gtgaggggaggccccctcgcgggcgcggcgcgcgcggccggtctcggcatggcgctcgccgcgctctcggcgcccgcgagcgccctggcgcccggagcccgcgccgaatcggcgaccccggcgggctgcccggccggtgccgtgcgggttccgccgggcgggccgatccagcgcgccgccctgagcgccggtccggggggcacggtctgcctcgcggccggcctctatcggatgcaggaggtggcgccgctcgccgggcagagcttcctcggcgagcccggcacgatcctcaacggggcccggatcctcaccggattcgagcgcgccggagcccactggcaggtctccggcatccggccgcgcaccgggggacccgggcagtgccgctccggcaccctctgcctgcagcccctcgcgctgttcctcgacggcgagccgctgcgccgggtcgcgtcgcgcgccgagctcggccccgggcgctacctcgtcgaggccgccgcggcgcgcgtcaccatcgccgacgacccgaccgggcggacggtcgaggtcgcgagcgcccggttcgcctttcgcgggcaggcaccgaacgtgcgcatccgcggcctcgtcgtcgagaagtacgattcccccgtgcaggagggggcgatcgaggcgaccggaccgggctggcgggtcgaggcgacggagctgcgctacaattccggcgcggggctcggcgtcgcctcgggcagcgcggtgcgcgactgcgcgatccaccacaacggccagctcggcgcgacggcgggcggcaccgacatcctgttcgagaacaaccggatctacgccaacaacaccgccgatttcgactcggcctgggaggcgggcggcctgaagatcaccgacagccgctccgtcgtccttcggggcaaccgcgtcgatcgcaacggcggccccggcctgtggtgcgacatggactgccgggacgtgctgatcgaggacaaccatgccgaggacaatcgcgggcccggcatcttctacgagatctcctacgccgccgtgatccgccgcaacaccctgcgccgcaacggcgatccgcgggccacgtggttctgggacgcggacatccagatcgcggcgtccgaggacgtcgaggtcagcgacaacgacatcgccgtgcggccggacggccatgccgtcgtgctggtcgaccaggcccgggagcgcgcgcagggcggcctgtaccggacggcgcagaaccgggtccacgacaaccgcttcgtcttcctgggcgccggcagtgcgggcggcgtctcggacgccgagcccgaatcgccgaacttcaaggtgatccagaccggccgcaacagcttcgaccggaacctctacgcctatcccgccgccacgccgccccggttcatctgggggcacgacatcatcgatttcgcgcatttccgagccgcgggccaggaacgggccgggatgatgaaggccgagccctag

SEQ ID NO: 7716 - DNA, 3045 bp, Methylobacterium sp.
atgccgatcgcccaagccgagctcgaggccgtcgttgccgaactggcccgccggcccggccacgagaaggtccgggcactgttgtaccgcctgctcaccggggcgctcgacgcccgcagcgagcagatcgccttcgagcgggcgctacctgaggttcgcggccgagtcgacgcgctgctcggccgcacgctcatcgagatcaaggcggacctgcgccgcgaggcggccgccgccgaggcgcagctcgcccgctacctgcccgagcgcgaggcggcgaccggccagcgctatgtcggcctcgccaccgacggcgcacgcttcgtcgcctatgagatgcgcacgggcaccctcgtgccgctcggcgcctgcgacgcacgccccactgatgcccgcgacctcaccgcatggctggaaggcgtgatcgcggtgcgcgactggctgccggccgacgctgtgggcatcacgaacgagctcggacgccgcagcgtcgccttcgcccgcacccatgccctgctgcggatcgcctgggccgcggtggcgacggacccggaagccgccctgaagcgccagctctgggagcggcatctcgggttcgtctacggcaaggcggtgggcggcgacgatctctggctgcagcacacctatctggtgatcctcgccaaggcgatcgcggccggcgccatgcgcatccacgggcactcacccgaggatctcctggacggtcgcgccttccgggacgccggcgtgcacggcgccgtggaggaggatttcttcggctggatcctgcgggcgccggagggtcccgcgatcgtcgcgagcctcgccggccacgccgcccgcttcgacctcggcagcgtcgacgtcgatctcctgaaggtgctctacgagtccctgatcgacccggagcagcgccacgacctcggcgagtactacacacccgactggctcgcccggaaggtggtgcgccgcgccctcgacgccccggccgcgcagagttgcctcgaccccgcctgcggctcgggcagcttcctgttccacgccgtgcggctgaagcgcgaggcgctggccgcctccggcatgccggccggcggggtggccgccgcctgctgcgccacggtcaccggcttcgacgtgcacccggtcgcggtgatcttcgcccgcgtcacctacctgctcgcgctgggcgaggccttgctggcgcgcggcggcgacatctcgctgccggtctatctcggcgacgcactgcagtggaacgtccagcgcgacgcggccgagcaggatctcgtcatcgaggtgccgcgcgcgcccggccgccgcggcggcgggccggtgctgcgcttcccgctcgcgctctgcgccgatccgggccggttcgaccgggtggtaggcgcgatgcacgacgcgagcgaggcgggccgcgacccggacgccttccagcgccagctcgtcggctacggcgtgccgacgggcgaggccggaaccctgcgggcgacctatgcggcctatgataccctgcggcgggcgggccgcgaccacgtctggggcttcgtcgcgcgcaacctgagccgtccggtcgctctatcggacgggggccgggtcgacgtggtgctgggcaatccgccctggctctcctaccgctacatgtcggccgcgatgcaggcccgcttccgcgacacggcccgccgccttggcgtctgggtcggccccgacgaggcccgcctcgtcacgcagaccgacctcgcgggcctgttcttcgtgcgctgcgccgagctctacgcccggcccgcgggcttaggccggcgcggcggccggctcgccatggtgctgccgctggccgccctcagccgcggccaataccgcgcctttcgcacgggcgactgggcgggtgtgagcgtcgcattcacggaggcctggagcctcgacaaccgggcgatcgccccgctcttccgggtgccgacctgcgcgctcttcgcggaggtcgccggggcagcccgaccgacgcccgcccgcgtcaccgtcttcagcgggcacctgccctcgaaggacgcgcccgaggcactggccgaccgccacatccggacggcagacgcccccgccccgcgggtcgcggggcccgccgcctcgccctaccgggggcgcttccgcaacggcgcgacgctctatccgcgcatcctctgcctcgtcgagagggccgagcaggctaggatcgggatcaacccgcggatgccgctcgtccggagcgaggcgtgcgcgcggaagggacgatggcgggaggtggcgcccctgcgcgggcccatcgaggcgcccttcctgcggccggtctacctgggcgaatcgatcgccccgttccgggttctcggccctgccgagggcatcgtcccggtgaccgacgaggcggccctgctcgatgccgatgaggctggcgagcgcggcctgaacgggctggaggcctggctccgcaccgccgagcgccactggagcgcgctctcctcggagcggacgagcttgcgccagcagatcgaccattacggcaagttgtcggggcagtttcccattgcgccggtgcgtgtggtgttctccaaatcgggtcagctcccggcagcctgcatcatcagcgacgatgctggtgtcatcgatcatgcactctactgggcagacatcgctagcacattggaagcccgctacttggtctccgtgctcaacagcgacaccgttcgtcgccgcatcgagcacctgcaggccaggggcgaacagggcgcacggcacttcgacaagctgatgttcaccttgccgattccgctcttcgacgggcggctcgggctccacacggatctcgccgccgcggcggctgaggctgagcgggtggcgggcgccgtcgcgatcgagccgaggacgccgttcgtccgcgcgcggcgggcgatccgggatgcgctccgggaagcgggcgtcgccgaacggatcgatgccctggtggcggagcttctcggaccggacccgttcgcaccggcgcccgcaccggccgtaccggagttggaggaggcctga

SEQ ID NO: 7717 - DNA, 834 bp, Methylobacterium sp.
gtgcccagtctcggcgatccgacgccgaaggccgcgcccatgaacatgcacccgaccttcctcgaggctcaagctctcgcgcccgcgcaggcgggcctgcgggaaatcgccgacggcctgggctacagctcggactggaactgggcctgggagaactacaagccgatggtgctggcgctcgcgcaagcccacggactgcgccggcacatcgagatcggcggcgggcgcgacccgctcttcacgccggacgagctcggccgccacggcttcgcggtcacgctcaacgacatctccgagcacgagctgatgctggcgcccccggccttcgccaagctgcgctgcgacatcgccggccccgacacggtcgcgaccgtggggcgggagcgcttcgacttcgcctattgccgcatggtgatggagcacgtgccggacgtcgcccggatgtggcgcaacgtccacgacatcctggcgccgggcggggtggcgctgagcttcttcccgaccctgttcgcgccgcccttcgtgctgaacgagctgatgcccgagcgcctgtcccggacgatcgtccacaccctgttcccggaccggcacgacgacggcgacaacccgaaattcccggcccattacaatctctgccggggctccgaggcaccgctggtgccgctgctccgcgagatcggcttccgcgatgtgatcgtgctgccgttctacggctacagctacttctggaagatcccggtcgtgcgccaggtggacgccgccttcacccgccttgcccgcgcccgcgactggcgcaccttcacgagcttcgcctacgtggtggcgcgcaagtag

SEQ ID NO: 7718 - DNA, 1725 bp, Methylobacterium sp.
atgagcgatgctgcgatcacgctgccactgccggacgccggcgcaccggcgggcatccgccgccgcgtccctgagacggccgtggccgcgggcctcgtcgcggcgctctgcgcgctcctcgtcctgatcatcgcgctgccgctgggcgccctgctgatcaagagcttcgagggagcggacgggggctttgccgggctcgccaacttccgcatctacttcgcgacgccgacgctcgtggaggcgctcgtcaacagcctcgtgatcgcggcgctctcggtggccctcgtggtgccgctggccttcggctacgcctatgccctgacgcgcacggccatgccgttcaagggcctgttcctcgccgccgcgctgctgccgatcttcgcgccttcgctgctgtcgggcatcgcgctgacctacatcctcggcaaccagggtgtcctgcgcggcctgctgttcgggcactcggtctacgggccgatcggcatcgtgatcgccgagtgcctctacgccttcccgcacacgctgatcatcctgacaaccgcgctggcgctcgccgatggccgcctctacgaggccgccgccgccatgggcacggggcgtctgcgcaccttcgccaccgtgacgctgcccggggcccgctacggactcgtcggcgcggggttcgtggtcttcaccctggtggtgaccgatttcggcatcccgaaggtgatcggcggccagtatcccgtcctcgccacggacgcctaccggcaggtggtcggccagcagaatttcccgatgggcgccgtcgtcggattgctgatgctggtgccggccgtgctggccttcggggtcgaccgggtgatccagcgccgccagtccgccctgctctcggcccgctccgtgccctacgagcctaagccgcgacgcctgcgcgatcgcttggccctcctctacgcgatcgccgtcgccggcgtgatcgtcggcacctacggcgtcgcggtctgggcctccttcatccgctactggccctacaacctcgccctgaccctcgaccattacgacttcgcggccaccgacgccgacggctggcagccctactggaactcgctcgccatggcggcatcggtcgccgcgatcggcacggtggtggtcttctccggcggctacctgatcgagaagctcaaggtctttcccgccggccggatgctggcccagctgctggccatgctgccgctcgcggtgcccggcctcgtcctcggcctcggctacgtgttcttcttcaacgcgccctggaacccgctcaacgtcctctacggctcgctggcgctgctcgcggtcaacacgctcgcccactactacacggtcgcccacgtgaccgcgacgacggcgctcaagcagatcgatccggaattcgaggccgtgtcggcctccctcaaggtgccgttctggcgcaccttcacccgggtcagcctgccgatctgcctgccgaccgttctggaactcgccgtctatctcttcgtcaacgccatgacgacggtgtcggccgtgatcttcctctacgggcccgacaccaagctcgcctcgatcgcgatcgtccacatggacgaggccgggaccactgccgccgccgccgcgatggcgagcgtcatcatggcgaccgcgctggctgcgcgcctcggtctcgccctgatcggctggggcgtggtcgcgcacctgcagcgctggcgccgccgcgaggcctga

SEQ ID NO: 7719 - DNA, 567 bp, Methylobacterium sp.
atgatccgccagggggtggaactgagcctcgaccggctcgaggcgcagggggcgccggtcgattacagcaccgacctcggccgcctaatccaggggctgggcagcgtgagcgatcgcctgcgcgccgtcgagcaggcgccggcactgcgacagggcgcggatcagatcgtgcagaacttcgaacggcaggcccgggtgctggaactgatcgacggccagatcgccgcgcgcttcgccagcgcgcgcgagcgccggcagcagaccctgtggctcgggggggccggagcggcgggggtcatgctcgggctcttgctgacgctgttcctgccgcgggtgctgccgttctcgctggcggagcggatggcggccacggtgatggggcaggcgccgtgggcagcaggcatcagcctgctgcagttcgcggatccggctgcggtggagcggatcgcggccgccgaccggctcgtgaaggcgaatgccccagcggtggcggcgtgccgatcggcggctgttcaagcgggcaaggagcagagttgcaccatcaccgtgccaggatcacggccgtaa

SEQ ID NO: 7720 - DNA, 564 bp, Methylobacterium sp.
gtgctcgccgcggcccccgcctacacgccccggatgccgcgcaccgacaagcccttctcggtgcggatgaccaatgccgggcccctcggctgggtctcggaccgcgccggctaccgctaccagccccatcaccccgagaccggcgcgccctggccgccgctgccgccgacggtgctgcgggcctggacggaattagccggctacgcggccccgcccgaggcctgcctgatcaacctctacgcgccggacgcccggatgggcctgcaccaggaccgggacgagcaggatctcgcggcgcccgtgctctccctctcgctcggcgcgcccgccctgttccgctacggcggcctcggccgcaccgacccgacccgctcggtgcggctgcaagccggcgacgccctggtgataggggggccctcgcggctggtcttccacgggatcgaccgcgtcctcgcggcgggcgacctgctcgatccgggcgaggcggccctgccggatctcccgcccggctggcgcctcaacctcaccgcccggcgggtgaatccgccggccccgacccgctga

SEQ ID NO: 7721 - DNA, 243 bp, Methylobacterium sp.
atggtgtcagccctcgccgtggcggcggcgggcgccccggccgaactgccgacccagcggctggccgaagcgctcgccgtgctgatggtcgatctggtcggggcgatgccgcttggggatcggtgcgctgttctggagagactggcgaaccggttggatgaccggggacgtgtcgctggtgggagcgaggccgcggcgctgctcggagcggtcggcggggcgttgatgcggatggagggctga

SEQ ID NO: 7722 - DNA, 1590 bp, Methylobacterium sp.
gtgagagatttcagcaggccggggcgctcgcccgtctacgccgccaacggggcggtcgcgacctcgcacccgctctcgacgctggcggcgatcgaggtgctgcgctccggcggcaacgcggtcgatgccgggatcgcggcggtggcggtgcaatgcgtggtcgatccgctgatgaccggcatcgggggcgactgcttcgcgctctacacgccgcgcggcgcggccgtgcccgaggccctcaacggctcgggccgcagcccggcggcggcgaccgacgcgtggtacctggagaacggcgtcaccatcacgccgacctcgccgcacgcggtcacggtgccgggcgccgtcgcggcctgggcgacgctcctcgaacggcacggcacgcgcacgctcggggagctgctgcagccggcgatccgctacgccgaggaggggttcccggttcagccccgcgtcggctgggactgggcgcgcagcgtcgagcgggtctcgcacgatcccggcgccgccgcgacctacctgttcgacggccgggcgccggcgatcggcgcgagcgtgcgcctgccgcgtctcgccgccaccctgcgccgcatcgccgaggacggcccgcgcggcttctacgagggcccggtcgcccgcgacatggtggggcgcctgcgcgcgctcggcggcctgcacaccgagcaggatttcgccgaggccgcgcccgaatgggtcacgccgatcaccacgcgctaccgcggctacgacgtctacgagtgcccgccctccggccaggggctggcggtgctgatgatgctgaacgtgctctcgcccttcgacgtggccgccctctccgcgctcgaccgggcgcacctgctcgccgaggtctgcaagcagggctaccaccaccgcgacgcgctcttcgccgatcccggcctgcaccgcgtcccggtggagcacctgctctccgacgcgtggcgggcctcggcgcgcggcgcgatcgacatgacccgcgcccgcgcgcccgaggtctacccggagatcgccaacgaggtcgcgcaccgcgacacggtctatctcagcgtggtcgaccgggacggcaacgcgctctcgctgatcaactcgatcttccagggcttcggcagcggcatcctggcgccggagagcggcgtgctcctgcacaaccgcggctacagtttccgggtcgagccgggccacccgaacaccatcgcgccgcggaagcgcccgatgcacacgatcatccccggcatgctgatgcgcgaggggcggacggtggcgcccttcggcgtgatgggcggccactaccaggcgatggggcacatccagcttctctccaacatcatcgacctgggcctcgacgtgcaggaagccctcgatgcgccgcgcagcttcgcctacgacggcgtcgtcgagatggagaacgcgttcccggacgacatcctcgccggcatgcgcgaccggggccacaaggcggtgccggccccgctgccgatcgggggcggccagatcatctggatcgaccaccggacgggcacgctggtggcgggctccgacccgcgcaaggacggcagcgcgctggggtattga

SEQ ID NO: 7723 - DNA, 1572 bp, Methylobacterium sp.
gtgggggccggcggcgcgatggtggcaggacacggacggagggcgcgcgctgcgtcccgcctgctcgccggcgcgctctgcgccgggctctgcgcgggcgtctccgcctgcgcggtggggccgaacttcgtgcccccggaggacccgccggtcacgcgctacacgaaggagccgctgcgcaacccgagcgcggccgacgccatcgcgacgcgccagggcggatcggccgaccagagcttcgtctccggcgccgacatcccgggcgcgtggtggaagctgttccgctcgaaggcgctgaaccgcctcgtcgaggaggcgctcgccaacaacccgaacctggaggcggcccaggccagcttgcggatcgcgcagcagaacgtgctcgcccagaagggcaccctgttcccgacgctctcggcgacgccgcaggtgcagggcgcgcgcgcgccggggctcgacctgcaatcgccgctgcagaacgacaaccgcttcctctacagcctgttcaccccgcaggtcgcggtctcgttcaacccggacgtgttcgggggcaaccgccgccagatcgaggccctggaggcccaggccgagaaccagcgcttccagctggaggccgcctatctgagcctcaccgccaacgtggtcacggcggcgatccaggaggcctcgctccgcgcccagatcgacgcgacgaagcgggtgatccaggcccagaccgaggtgctggacctctacaacaagcagctcaggctcgggcagatcgcgggcgccgaggtggtgcagcagcaggccgcgctctcgctctcccagcagctcctgccgccgctggagaagcagctcgcccagcagcgcaacctgctcaccgcgctgaccggccggctgccgagcgaggaggtctcgcagaccttcaccctcgcccagctgcggctgccgaccaagctgcccgtcagcctgccctcgcgcctcgtccagcagcgccccgacgtgaaggccgccgaggccctggtgcagcaggcctccgccaatgtcggcgtggcggtggccaaccgcctgccgcaattcaccatctcggcgaccggcggggccagcgccgtgcgcatcgcccagctcctcaacccgggggcgggcttcttcaccgtcatcggccaggcggcggcgccgatcttcgacgccggcacgctctaccgccgccagcgcgcctccgaggaggccctgacccaggcccaggcgcagtaccgcgccacggtggtgggcgccttccagaacgtcgccgacgcgctgcgcgccctccaggcggacgcgagcgcggtcgcggcggcgtcggcggccgagaaggccacgggcgagagcctcgggctcatccgcaagcagttcgaggcgggcgccatcaacgcgacgcaggtgctgatcgcccagcagagctacctctcggcgctcgtcacctcggcctcggcgcgggccacccagtacgccgacaccgcggccctgttccaggcgctcggcggcggctggtggaaccgcgcggacgtggcggtgcctccgccggagacggacccggcgaagttcctgtga

SEQ ID NO: 7724 - DNA, 189 bp, Methylobacterium sp.
atgacgactgtcgccgcacaggccacgcagatgctcgccgccgccttctcccagcagatgggcgtggcggtggcgcgccagcagatcacggccgagcgcgcggtggccgaactggtcgccggcgcgatccagcccgccgcgccgccggccccgcccggccagggccgaatcgtcgacacgcgcgtgtga

SEQ ID NO: 7725 - DNA, 276 bp, Methylobacterium sp.
gtgctcgcggccttcctcgcgctcgcctgcgggtcggtcgcgcgggccgccgagatgcgcccgccgcccggcacctcctcctgcaccggatgccacgccgagggcgccgcgatgggcgtcctcgacggacggcccgcggccgagatcgcgggggcgctcgaggccttccggacgggcgcgcgcccggccaccctcatgaaccgcatcgccaaggggttcgacgcgcaggagagccgcgccatcgccgcctggttcgccgcgcaggggccgcggtga

SEQ ID NO: 7726 - DNA, 1266 bp, Methylobacterium sp.
atgtcccggatcccgtccgcgccgacccgccgcgccctgatcggcggggccgccgcggccgcgctggcgcgcccggcgctcggcggcacgcccccgcgcgtcgtggtgatcggggccgggttcggcggcgccacggcggcgcgctgcctcgccgccggcggcgtcgatgtgaccctcgtcgaggcgaccgagcgctacgtcgcctgcacgggcagcaacgcggtcgtggtgggcctgcgcggaatcgaggcgcagaccttcgggtacgacgcgctcggccgggccgggctccggctcgtgcgcgcgaccgcgagcgcggtcgatccggcggcgcgccgggtaaccctcggcgacgggacggtgctcggctacgatcgcctgatcctctcgccgggcatcgcgctgcgcttcgatgccgtgccgggctacgacgaagccgccgccgaggccatgccgcatgcctggaaggccggggcgcagaccgtgctgctggcccgccagctcgccgccatgccggagggcggcaccgtcgtcctctcggcgccggccaacccctatcgctgcccgccgggaccctacgagcgcgcgagcctgatcgcccatttcctcaagacccgtaagccgcgcgcgaagctcatcctgctcgacgccaaggacaccttctccaagcagaagctgttcgaggcggcctgggccaagctctacccggacgtgctcgaatacgtgccgctggccgcgggcggacaggtcagcgaggtcgatccggccgcgatggtcgtgcgcacagacttcgccgagtacaaggccgacgtcgcctgcatcatcccgccgcagcgcgccgggcgcatcgcggcgcaagcgggttgcgccgaccgcagcggctggtgcccaatcgaccccgcgaccttcgaatcgcgcctcgtgccgggcatccacgtgatcggcgacgcggccatcgccggagcgatgccgaaatccgccttctcggcgaatgcgcaggccaaggtctgcgctcaggcggtgatcgacctgctggccgggcgcgagcccgaggatccgcggctcatcaacacctgctggagcctcgtcgcgccgggctacggcatctcgatcgcgggcgtcttccgcccgcatgacggactgctcgcggacataccgggggccggcggcgtcagcgcgctcgacgcgccggatgcggtgcgcgcgcaggaagcggcctacgccgagagctggtaccggacgatcacccgggacgtgttcgggtga

SEQ ID NO: 7727 - DNA, 798 bp, Methylobacterium sp.
atggccgccgaatgtgccggcgtgcgccgctacctcttcgcgagttcttgcgccgtctatggcggtggccagggcatggacctcggcgagagcgcggcgttgaacccgctgaccgtttacgctgaaacttgtgcgcgtgccgaagaggccgtgctcgcccgcaacagccgttgctttacgacggcggcccttcgcaacgcgacggtgttcggtctgtcgccacgaatgcgcttcgacttggtcgtgaaccagatgactcatgacgcccttgagggtggccgcatcactgtcggaggtgacggcacgcagtggcgccccctcgtccacgttcgcgatgtcgcaagggcgttcttgtcggcgttacgggcgccgcgccgtgcgatcggtggccatgcgttcaatatcgggtggaagaactatcaggttgacagcgtcgcccacaccgttcggcgtgcgatcaccgtgccgacggacatcacctatctgccaggaagcccggaccggcgtgattaccacgtgagcttcgccaaggccgagcgcatattcggcttcaaggcgagtctgactgtggaagaggccgtcgtcgagatcgcgcaggcgatccagggcaagcgcctgagcaacaccccggcctgccacacggtacaatggtacatgaggctcctggccgagcgggggcctgggcttcgcctgcccggtacggcgccgatgcacatgttggcggaagcgccgtcctcggacgcgatcatcgcgcgcgatgcgggcgctggactgcccgcagtggcgcgcgtccaatga

SEQ ID NO: 7728 - DNA, 981 bp, Methylobacterium sp.
gtggggcgggcgatcgcccacgagttcgcgcgccacggctggaatgtcggcctgatcgcccgcggcgaggcgggcctgcgcggcgcggccgacgacgtgcggcgcgcgggcggcacgccgctggccttcgcggtcgatgtggccgaggccgatcaggtcgagcaggcggcggacgagatcgccgcgttcttcggcggcatcgacgtctgggtgaacaacgcgatggtgacggtctacgcgccggtgcgcgagaccccgcccgaggagttccggcgcgcgaccgcggtgacctatctcgggcaggtgcacggcacgctggcggcgctcaagcacatggtgccgcgggaccggggcaccatcgtgtatatcggctcggctctggcctaccgctcgatcccgctccaggcgagctactgcgccgccaaggcggcggtgcggggcttcgtggattccctgcggagcgaattgctgcacgacggcgcccaagtgcggctcaccatggtgcagttgccggcggtgaacacgccgcaattcgactgggcccgctcgcgcctgccgcgccagctcgagccggtgccgccgatctaccagccggaggcgatcgcccgtcacgtctaccgggcggcgcacgcggcgccgcgcgagctctggatcggcgcctccgcctggaaggcgatcgtcggcaacatgctgatcccgggctggatcgaccactacctcgcccggcacggctatcacggggagatgaccgacatgcgcgccgcgaagaaccgccccgacaacctctacgagccggtcgacaccgatcccggcgcgcacggccgcttcgacgagagatcgcgcgacgcggtcgcggcggcgagcccgcgctggctcaagctcggcctcgtggccgcgctcggcgcggtggcgggcgcgacactcttcgccacggaggcgcacggacgctcggaggcgcggcgccgcctggagcggcgctga

SEQ ID NO: 7729 - DNA, 1263 bp, Methylobacterium sp.
atgtccgcaccaatcgcgacggcgcagcgcccgtccctgccgcgcgcccgtggcctcgacagcagcctcgccctcctgcgcgagggctacgccttcatcccgaaccgctgccgcgccctcggctctgacctgttcgccacccgcctgatgctgagccccgtcacctgcatgacgggcgccgaggcggccgcccgcttctacgacggccaccgcttcacccgccgccacgcgctgcccgcgatgagcttcgggctgatccaggaccagggcagcgtgatggtgatggacgggcaggcccatctctgccgcaaggcgatgttcctcggtcttgtcggcataccggcgctggagcgcctcgcggccatcacggtgcggcactggcgcgccgccgcggagcgctggacgcgggcgaattcggtcgtcctcctcgacgaggcccaccgcgtgctcaccgccgcgatctgcgcgtgggtcggcctgcccttggacccccaggaggtcgcggcgcgggcgaccgagttcgccgcgatgatcgacggcaccggcgcgatcggcccgcgcaactggcgcggccatctccgccgcgcccgcaccgagcgctgggcgcggggcgtgatccgggagatccgcgccggccgccgggaggtgccggagggcgcagcccgcgcgatcgccgagcaccgcgagcgcgacggccgaccgctcgacgcggcggtcgcggcggtcgagttgatcaacgtgctgcgccccaccgtcgccaatgcgcgctacgtcgtcttcgccgccatggcactgcacgcggccccggcctggcgcgccgccctcgccgagccggaggcgcggtgccgcttcgccctggagctgcggcggttctaccccttcatcccgttcatcggcgggcgggtgcgggagcccttccggctgcagggacacgccttccgggcgggcgactgggtgctgatggacctctacggcaccaaccgcgacccgcggctctggtccgagccggagcggttcgacccggaccggttccgcgacgtccagcccggcgccttcgcgctggtctcgcacggcggcggcacggcggcggaggggcatcgctgccccggcgagggcatcagccagatcctgctggagaccctcgccggcgaactcgctcgcctcgcctaccgggtgcccgagcaggacctgacgcttgacctcgcccacatccctgcccggccccgcagcggcttcgtcatccgcgacgtgcgggcaggctaa

SEQ ID NO: 7730 - DNA, 753 bp, Methylobacterium sp.
gtggaacagtacctgacctcgacgttcctgctgtcgctcctgcagatcatctggatcgacatcatcctgtcgggcgacaacgcggtggtcatcgccatggcctgtcgcggtctgccggagcggcagcggcgcatcggcgtgttcctgggcgccttcgcggcggcgggcctgcgcatcctcttcgccgtcatcatctcgcagctgctcgcggtgccgctgctgaaggtgctgggcggcctcatcctgctgcacatcgcggtcaagctggtgcgcggcgaggacgagggcgaggagcacgtccaggcgagttcgagcctgcccaaggtggtctggaccatcgtggtggccgatgcggtgatgagcttcgacaacgtcgtggcggtcgcgggcgcggccaagggccacgacgagctcttcatcatcggtctggcgctctcggtgccgctgctcatcgtcggcgccagcctgatcacccgggcgatcgaccggttcccggtgctgatctggttcggcggcgcgctgctcggctgggtcgcgggcgagatgatcgccaccgaccgcctcgtggtccagtacgtggccgaggccctgccggcctcgctccagggcgtcttccactacggcgtcgccgcgctcggtgccgcgatcgtcatcgcgatcggcatgctgctgcgccgccgcagcgaccgggcggtcgcccgcgagcaggccgcggccgtgggccgggccgaggcggacgtgctcgggagctga

SEQ ID NO: 7731 - DNA, 747 bp, Methylobacterium sp.
ttgcggcacatcttcgccggatcgccgttcgatgtcgtggcttccgccgatcgcctggacgacgtcgagccggccgcgctggcgagcgaggccctggtcatccttctgtcgatcgatccggagcggcagcaggatctcgagcggatcacggaggcgcggatgcgctgtccggaggcggccatcgtctgcctctgcacgggctgcggcgagacccaggtcctgccgatgctcgaatccggcgtcgcggcgatcctgctgcgcacggtggcggccgagaccctggtccagaccctcgaactggcgctgctgggacagcgggtcgtgccgcacctctccatcccggccccccgggagccggccccggcggcgcccgcggaggaggggggcccgctcgaagggccggagcggccggaacccggcgacacgttccggccgaacgcccgcgagatcaagatcattgcctgcctcgtgaagggcgaatcgaaccgcgtgatcgcggaccgcctcgcgatcgccgagggccgggtgaagggtcacgtcaaggcgatcctgcggaagatccaggtgaagaaccggacccaggccgcgatctggggcatgaagcacctcgccggaaccgaggcgccggcatccggagacgggcgcttcgacgcatcggcggaggcggcctgcgaggagctggacgaggacgcgctgcccgcggccccgcgtccggcctggcgcgccgagccccttcacgtccggtga

SEQ ID NO: 7732 - DNA, 1311 bp, Methylobacterium sp.
atgcggcggtcgtggaatccgggcccgcccgcggcggcgcgtggcggcggcgccctccggcaccggatcggcggccatgcggggcgcctcgcatggcccctgatcgaccagggcatcgcgagcatcggcaccttcgggctgacgatcctgctggcgcgcgcgctgccgcccgcggagtacggggtcttcgccctgctgctcggcgggctgatgatcctgcacatggtcacctcctcgctggtgttctatccgctctcggtccgggcggcggccgcgggtccggagggcggggcagccctgatgcgggcgagcctcgaccttctcggcctgctcttcctgccggccggtgcggcgatcgcgctcgccgccctcgcggcgggccgggcggacctgatcctgccggccctcgcctacttcctgctctggcagatccaggaagccttccggcgctacctcttcgcggagctgcgcttcgccgccgcgattccgggcgacgcggtgagctacctgggccaggtcgcgctggtgctctggctcgggcgggaggggcatctgacgctcggcggggcgctctgcgcgatggcgctcaccgccggcctcggcgccctcctgcaggccgggcgcgccgggctcgggcggcgtggcggccccgcgccgcgcctgcccgcgatcctcggcgacttctggcgcctcggcggctggtcgctcgccaacaacctgctcggtacgctgcgcgggcaggtgctgttctggctgctcgccgtcctctccggcgcggccctgacggcgcagctccaggcgagccagaatctggtgaacctgatgaacccgctggtcatcgggctctgcaacatcatcccgcagaccgcggcgcgggcgcatgccggcggcaaggcggaggcgtggcgggcggcgcggccgttcgcgctctccggggtcccggtggcgctgctcttcttcggcgtcctgttcgcggtccccgaaccggtgctgcgcctcgtctacggctcggcctcgccgtatctcgggctcgtgggcccggtgcgcctcctcgcgctcgcggcggtcgcggcctacgccaccgacatggtgtgctcctacttccacggggtggaggcggcgcgccacgccctcgtggtgaatgccgcgggcaccgtcgcggttctcgcggcggccgtgccgctgacgctccggttcgggctcggcggagcctgcgcggcgatggtgctggcgagcctcgtgcggctcctgatctcgcagctcctgctgcggcgcctgatcgccgcggatgcgccgctgccggccgcgtga

SEQ ID NO: 7733 - DNA, 1053 bp, Methylobacterium sp.
atggcaagacaaccgagggtcgttggcgaggtcgagagtctgaaggggttgctggcgcggctctccctggagacgaagttgctccgccttgaggaggtattgcggcggaaggactgggccgatcagccccgtgcgccggccgggcaatcggatggcggtcggtgggtttcgggcggcggatcgggagtaagccggccgcaagcgagcggggatgcgtccgcgccagagtcgaaccagacacaggagcaaaccgtcgccgacgacggtacgcgcgttctgtcgatccgtatccgtgccggacggggcgatttcgacacgcagcatgccgtaacggctccggatggcgagagccgactcttccagaccgccagcgcgaaccaagtgattcgcgacggcgtgtccggcgaggttctatcgcgcagcacgtttaccgcgcacgggccggtttcggatgcgatcgtgcagccggccttcctcgccgctgtgcccgcgacgattgcccggacgctcgaacttgcgacagcgctgtttacggttctgtccgcgcgcaaggacggcttcgggacggtgctcggaatgacggtgcaggaatacaagccgtcgccgaagggcagtccggtgaccgtcacctgggtcggccagccgagcctgagcgatttcaatgccgcttgtccgcggaacggctacgtgatggcgctcacggaccgagttacggctcgcgtcaaggcgcgaggacataatatgtcaatgcaagcgcttggcacgcgcattcactttgaaatagcgcaggaagtgaaaaatctcaacgatccaaacttcaagtccgagctgtttattccgaaaaccgttatgccgaacaggcctgcttctcttgggtccgttcgcttggacctgttcgagagagtcaggccgggtgttgtatgcatctacgattacaaggtcggtatcagtggactggatgccgatcgtgcacgcgatcttgcactgatggcgaagcatcaattccccgaaacccaacagatcatggtcattcaggtgaggcctcgcacatga

SEQ ID NO: 7734 - DNA, 675 bp, Methylobacterium sp.
atgacggatgcccagaaggtcgagcggtggatcgatcggtttccgctcctacaggctctcagcccggcgcaccttcagatcgctcggggaaccgtgcatttcccggtgctggatgcaggcgccatcgcctacgaactgaatggcgagtgtgccaactacctgatgtgcctggagggacgcacgcggatctttcggatgtcggagggcggacgcgaggtgctgatctacaaggttggcccgggtggcacctgcgccctgaccacccagtgtctcctgtctggcggcacctttccagcgcagagcgtggccgaggagcggaccgagctcgcggccctgccggacagcacgttccagcacctgatgggcgacagcgcggcgttccgcagcttcgtcatggatgattacacgcgattgatgtccggcctgttcacgctgatcgacgaggtcgcgttcgcaccgctgaagcagcgcctcgcgcaacggctcctggccgaggctgatccgcggggcgtcgccgcggtgactcatcagaaactcgcggacgatgtcggcagcgtgcgcgaggtggtgagccgcatcctggcacaatgggccgaggcgggcctaatcgaacttcgtcgaggcgcagtcgagattgttgaccggacccgcttggaggccgcagggcggcggtga

SEQ ID NO: 7735 - DNA, 528 bp, Methylobacterium sp.
atgagggctgagccggagatccttcgcctctccgacccggcggtgtcggccgccgccgctcggaggctgttcgcgcaggttcgggcggaactcgctgccgctctgccgcaggaggccgagatcgagcatgtcggcgcgacagccgtggcgggctgcctcggcaagggtgatctcgacgtcgccgtgcgggttccgggcggccgcttcgtcgcttgccgcaccgttctggggcggcgctacgccgacaatgccggctccgtccggacacccgatttcgcagccttctgcgacgagacggccgaaccgccgctcggcatccagctcgtcgcgctcggatcggagctcgacgtcttcgtccgcttccgcgaccggctccgcgcagagcccgatctggtcgggcgctacaacgcgctgaagcgcgcccatgccgggcgttccatgagcgcctaccgcgccgccaagggcgatttcatcgcgacggttctggccggtccaccaggggcgggcccccgcgatagccccggctaa

SEQ ID NO: 7736 - DNA, 1725 bp, Methylobacterium sp.
ttggcgatctaccactgccagatgtcggtcgtcgcccgcggatccgggcgcagcgcggtggcggcggcggcctaccgggcgggcgagcggctggagaacgcgcgcgacggccaggtgcacgactacacccgccgcgccggcatcgcgcacgccgagatcgtgctgcccacgggcagcgatgcggcctgggcaaacgcgcgcccggccctgtggaacgcggtcgaggcggccgagaagcgggtcgatgcccgggtggcgcgcgagttcgtggtggcgctgccgcacgagctgccggccgaggagcgcctcctgctgacgcgggccttcgcccaggccctggccgatcgcaccggggcggcggtggatttcgcgatccacgaaccgcacccgcagggcgacgtgcgcaaccatcacgcccacctcctgatgacgacgcgggtggtgggagcggacgggctcggcgtgaagacggtgctggagctcgccaacaagcaattggtgccgcgcgggctgccgacgacgcaggcgcaactcgttgagatccggcagacctgggaggcgctggcgaacgcgcatctggcgcgtgtgggcctcgacctgcgcatcgaccatcgcagccacgcggagcggggcctggagatcgcgccgacgcagcacgtgggtgtggcagccaccagcgtgcggcggcgcggcggcacggtggaacggcggcggctcgatccagaggcctcggcacgcaatgccgaggcgatccgggcgcggccggagctggtactggagttggtcacggacgagcggagtgtgttcgaccggcgcgacgtggcccgggcgctgcaccgcgcgctcgaggcggacgcgctggacttccaaagcgcattccaggccgccttcgcggcggtgatggcctcgaaagacctggtggagctgcagccggaacggacggatccggagacgggcgcggtgacgccggcgcgctacaccacgcgggcgatgctggcgctggagagcggcatggcggaggcggccgcgcggctgcagggcacgcaccggcacggggtcgatccgggccgcgtggcggacgcgatcgcggcgcaggacgcggcgatccgggcgagcaccggggaggcctcggccgggctgtcgcctgagcagcgcgcggcagtcgggcacgtgaccgggccggagcggatcgcggcggtggtggggtttgccggcgccggcaagagcacgatgctggccgcggcgcgggaggcctgggaggcgcaaggctaccgggttcacggcgctgccctgtcgggcaaggcggcggaggggctggaggcgagttcggggatcgcctcgcgcacgctggcctcatgggatctcggctggcggaacgagcgcgggctgctcggggcgggcgacgtgctggtgatcgacgaggccggcatggtgggttcgcgccagctcgcgcgcttcgtcgacgcggcggagcggcgcggggcgaagctcgtcctggtgggcgatcacgaacagctgcaggcgatcggggcgggggcgccgttccgggcgatcgccgagcggatcgggcacgccgaactcgccgatatccgccggcagcgcacggagtggcagcgcgcggcctcggtggcctttgccacgcaccgcacgggcgaggggctggccgcgtatcacgcgcacggcgcgatcgccttcgcggcggacggggaggcggcgcgcggggcg

SEQ ID NO: 7737 - DNA, 1305 bp, Methylobacterium sp.
gtggtgctggcgcatcgccgggccgacgtgcgggcgctcaacgatggcatccgggcggcgctgcaggcgcggggcgcgctgcccgagggcgaggcggcgggggagcgggcgtttgccaccaacgacggggagcggctgttcgcgccgggcgaccggatcgtgttcctggagaacgaccgagccttgggcgtgaagaacgggatgctcggcacggtggaggcggtggcggaggggcggatcgcggtgcggctcgacggcgagggcgagcgccgggtcagcgtggcgacggacgcgtatcaggcgctcgaccacggctacgccacgacgatccacaagagccagggggcgacggtggaccaggccttcgtgctggcctcggccacgatggaccggcacctgacctacgtggcgatgacgcgccaccgcgacggggtgcggctctacgccgaccggaccgagttcgcgggggagcggcccgggaattgggtgagtgcggctgcggcctatgacgggcttgcggcgcggctgtcgcgctcgggggcgaaggagacggtgctggactacgcgccgtcgtttgcggcccggcgcgggcttgcggagcgactcggcatccggggcgggatcgcgctcgcacccgagcgggcggtggccgaaccggtccgggaggctccggccgcggccgagccgtcccgccgggagctgttcgacgggccgggactgtcccgggaaggccccgtccccgcacctgcggtgcgcacggtgccggccgcgagcgcgcctcaggccggcgtgcgcaatcccgagacgccgcgcggacgtgcgtttgcgggattgaagctgcgcgccgcccctgcgccgaagccgccgccagcggccgagagcccggcaccggtcccggatcgcctggccgagcggatccggtcgctgtcgggcctggagggggcactggagcgctacgcgcaggcctacggcgcggccgagcgtcaggccgaggccgggctgccgcggctggcagggcagcgcgcggcgctggcggcggccgagtttgggctggatgccgtgcaggccgggacgcgggcgaccctgcaggccgccctgcagcatgatccgggcctgcggcaggcgctgctggcgccgtccggcacaggacgcgtctcagacctaatggcggggctggagcgcgagcgggagcgtcaggcccaggcggaactggtggcacaacaggccgagcgcctggagcaggcgcggcggctggaacgccgccaggagcgcgagcagagtctggacctggggctcgggctgtag

SEQ ID NO: 7738 - DNA, 1206 bp, Methylobacterium sp.
atgctgagatccgttctgctcgcgggcgcgatcggcgccctgaccatgggcggcgcgctcgcgcagaccgccgtcaagatcggcgtgctcggcgaccgctccggcgtctactcggacatcagcggcgagggctcggtggtggcagcccgcctcgccgtggaagacttcgccaaggtcgacccgagcgtgaaggtcgaggtcgtctccgccgaccaccagaacaagccggatgtcggcgcggccatcgcccgccagtggtacgaccgcgacggcgtcgacgcgatcatggacggcgtcacctcctcggtggcgctcgccatcaatcaggtcacgcgcgagaagaacaaggttctgatcgattcgggcgccgggaccgccgacctcaccggcccgcaatgcacgcccaacaccgtgcactgggtctacgacacggtggcgctcgccaacggcaccggcagcgccatggtgaagcgcggcggcgacacgtggttcttcctcactgccgactacgtcttcggccagacgctgcagcgggacaccgccgccgtcgtcaccaagagcggcggcaaggtggtgggctcggtcaagacgccgttcccgaccgccgacttctcctccttcctgctccaggctcaagggtccggcgccaaggtgatcgggctggccaatgcgggcggcgacaccatcaacgcgatcaagcaggccggcgagttcggcatcaccggcgggggccaggcgctcgccggcctcctcgtcttctcgtccgaggtgcacgcgctcggcaccaaggtggcgcaggggctcgtgctgaccgagccgttctactgggacctcaacgacggcacccgcgccttctcggagcgcttctcgaagcagatgaacgggcgcaagcccacagccaaccacgccggcgtctatgccggcacgatccattacctgaaggcggtggcggccctgaagaacgaggccaaggacggcgccagggcggtcgccaagatgaaggagctaccgaccgacgacccgctcttcggcaagggcacgatccgcgcggacgggcgcaagatccacgacatgtacctgttcgaggtgaagaaacccgccgagtcgaagggtgagtgggacctctacaagacgctggccaccatccccggcaacgaggtcttccggccgctgggcgagggcggctgcccgctggtgaagggctga

SEQ ID NO: 7739 - DNA, 510 bp, Methylobacterium sp.
gtggccacgtccgtcaggggctgcacgatgacagtcctgaccgatcgccaacgcatcgagctcgcgctgcccgcctacctgctgttcgcgctcagcaggctgccgggcgtgttcgccccatcggatccagccctggccgagcgggccgaggccgacatcgccgtgttgtgcgaggacctacacatcgcctgcctggagccgctcgctgatctggctccgcgcaagcagcaggcggtcctgcgccgcctcgaccgcatcggcaaggatgtcatggtcggatggacggaccagtcatccctcagcctcgtcctgatgctctggtacttcctgaaggacctcgtcgatcgggaggtgctgatcctgtggcagggctctgcgatggatcgagcagtgcacaccctgctgccgatgttcgagcatggcttcgaggagcagaagcgggacgccgcggctcaggagcaggccgtccggctgctcgcgcgtctgcgggccgaagggctctacggctga

SEQ ID NO: 7740 - DNA, 399 bp, Methylobacterium sp.
atgatcgtgctcgattcctcggccatcgtggcgatgctgctcgccgaggacgaggaagcggctttcctgaaggtcctcggcagcaaacgcgcgctcgtcggagcaccgacgctcgtcgagacgcgcatggtgctggacgcacgcctctccgcggccggggatgcgctgaacgattttctgcgcgacggcgccatcacgatcgttccgttcgacgccgcgatgttcgcggcggccgccgaggctttcacccgctacgggcgggggcgccaccgcgcccggctcaacttcggcgactgcctgtcctacgcggtcgcgtcggtcatgcgcctgcccctcctgttcaagggcgacgacttcgtccacacggacatcgtccccgcctgcagccccgcaccatga

SEQ ID NO: 7741 - DNA, 957 bp, Methylobacterium sp.
atgctcacgacgctcgcggtcgtgttgccgatcttcgcgctgatcctcgccggctggctggcgcggcggaccggcctgctcgggccgcacgcgatggccgagctcaaccgcttcgtggtctggctcgcgctgccggctctgctcttcgacgtgatggcccgcagcgtcggcccggagatctggcagccgggcttcctcgccaccttcggcctcagcagcggcgcgctcctcgccctgaccgcgtggctcgcccggcgccggggccgcccgctcgccgacgcggcgatcgacgggctcaacgccagctacccgaataccggctacatgggcttcccgctggcgctcgccgccttcgggcccgccgcgctcgggcccaccaccatcgcggtgatcctcacggtctgcgtcgtcttcgccggcgcgatcgtgctgatcgaggcgggactccagggcggggatcggtccgggcagcgccgcgggccggtcgcccgcacggtggccctggcgctcctgcgcaacccgctcctcgtcgcgccgttctgcggggcgctggtgccgctgctcgggctcggcgtgccggcgcccgtggaggccttcctgaagctgctcggcggggcagcctccccctgcgcgctggtggcgctcgggctcttcctggccgagccgcgtcgcggagacgggaccgggcgggaccgccgcgcgaccgcttggctcgtcgggctgaagctcgtcgcccacccgctcctcgcctacgggctcggacgcttcgtgttcgatctctcgccgctcgcgctccacaccgcggtgctgatggcggcgctccccaccggcacgggcccgttcatgctggctgagttctaccgccgcgaggccgcgctcaccgccgatacggtgctggtctccacggtgctctccgtcgtgacggtcgcagcctacctcgcctacgtagccgggtga

SEQ ID NO: 7742 - DNA, 1239 bp, Methylobacterium sp.
atgacacatccacggccgggattcggccgggcgctggccgccgcactcatcgccgcaccgctcgtcgcgagcccggccgccgcgcaggcgatctcggatggggcggtgcgcatcggcatcctgaacgatcaatccggcgtctacgccgagttcggtggccggtcctcgatcgaggcggcccgcatggcgatcgaggatttcggcggttccgtgaacggcgcgccgatcgagctcgtttccgccgaccaccagaacaaggccgacatcgcctcggggatcgcgcggcaatggtacgaccgggacaaggtcgacgccatcatggaactgacgacctcctccgtcgcgctcgccgtgcaggggctctcgaaggaaaagaagcggatcaccatcaccaccggcgctgccaccagcgacctcaccggaaagcagtgctccccctacggctaccactgggcctacgacacgcgggcgctcgcggtcggcacgggcggcgcgctggtgcagcagggcggcaacacctggttcatgctcaccgccgactacgccttcggccactcgctggaagcggaggtcacccgctacgtcacctccaagggcggcaagatcgtcggcggcgtgcgccacccgctggcggcgcaggactactcctcgttcctgctccaggctcaagggtcgggcgccaaggtgatcggactggccaatgccggcctcgacacgtccaacgccatcaagcaggcggcggagtacggcatcacgcagggcggccagcgcctcgccgccctgttgttcacgctcgccgaggtccacggtctcgggctccaggtcgcgcaggggctgaccctcacggagggctggtactgggacctgaacgacgagacgcgcgccttcggacagcgcttcatgaagcgcacgggcaagatgcccaacatggtccataccggaacctactcggcggtgttgcagtacctcaaggccgtgaaggccgcgggcaccgacgagaccgacgccgtcaacgcgaagcttcatgcgctgccggtggaggatgtgttcgccaagggcggcacggtgctgccgaacggtcgcatggtgcacgacatgtacctgttcgaggtcaagaagcccgccgaatcgaagggcccgtgggacctctaccggttgctcgccacgattccgggtagcgaggcctacgccaagctcgaggagagcggctgtcagctgaccgcggcgcgcaccccctga

SEQ ID NO: 7743 - DNA, 273 bp, Methylobacterium sp.
atgaggggcggtgcggtgggctcgctcttcgcccaggccttccacctcagcgacgccgagcgcaagacgtttctcgttgcgggctcggccgccggcatgacggcgatcttcggaacgccggcggcggttctgctcgccgtggaactgcagctgttcgcgtggcgctccccgccgcctcgtgccggtcgcggcgtcgctgcgcgcccctcgccttcgaggcagccccgctctttcaccgcgtgggcgggggcgccctgcccgccggagggctag

SEQ ID NO: 7744 - DNA, 1119 bp, Methylobacterium sp.
gtgtcgggcggcctcgccgcgccggacgccgacatcgcggcgcggctgcacgccttccgcagcctcggcggcaattgcgagttcggcttcgttcagcgctacggcggcgccgagccctcggggctgctgcgcttctcctacacgccgctggcggacctgctccacgccctcgacaccgacttctcggatctcggcgcgccgggggacctgcatctcgtgccggccgagagcgggacgtactattgtgcgagccgccgctacggcatctggtcgaacaccgcgcggacggtcgggcaggtcgatccggtcgcgttgctggagcgagagtacggccgggtcgcccacttgaagcagcgtatgctggcggagctcgcggaaggatcgaagatcctggtgcgcaaggtcggccccgaggacggcgcggacgatctcgaccgactggtccgcgcgatccggcgccacggcccatcgccgctgctgcgcgtcgccgcaaccggccccgactgggtacccgagccggcgcgatggatcgcggagggcgtcatggagggccgggttcggcgcttcgccccccaggaggtcgcctgggacgtggatctcgaaccctggctccgcctctgcgacagcgccgaccggctatgccggggcctgtcggatgggccgggcctgccgcccgcacggccggttctcgccgtgcggggctccaggccgcggtgccatgtgacccgcggcggcgcggacggcatctcctcgttccggcaggctctcgatgcgcgcggcctcgcccgtgggccgatccacaccgtctcggcctggatctggctgcccgcggatttcgccggcgcgcaggtcttcgcggcactcgattacgagcgcctcgcctgggccgaagccgacacgggccggcgcgaatgctggcagcgggtctgggtctcggcgcggatcccggacggtcgcgacggcatccggatcggcctcgtcgcgcgggcgcctcggggcgaggtattctggtcggcgggctggcgcctcgacgaggggccgctgccgccggccgaaccggagccggtgcacccgccgccctccggcctcggcggctggctggcgcgcctgcgccggtag

SEQ ID NO: 7745 - DNA, 2448 bp, Methylobacterium sp.
atggcccgcatccgcgccgtcgacggcgtcccgccgttgcccgtcggcggcccctggcagctcgcgaccaccccgcccggcgcctgcacgcggccggacgacctcgccgggctcgacggctggatccccgcccgggttcccggcaccgtcgcggcggcactccgcgaggccggcctgtggtccgaagccgagccggccccgatccacgaccgcgacgtctggtaccgcaccacctttccgggcaccggccgggcgcgcctcgccttcgaggggttggcgacgctctgcgaggtctggctcaacggcgcgccggtcctcgccagtcgctcgatgttccgcgcccacgcggtcgcggtggatctcgccggagcgaacgacctcgtcctgtgcttccgcgcgctgaaggccgagctcgaccggccggccaagcgcgggcgctggcggccccgcctcgcgacgcccggctcgctccgccacgcgcgcacgagcctcctcggcttcatgccgggctggtgcccggagatcgatctcgtcggcccctaccggccgatcaccgtgacgccgctgcccgcggacgtgccggaactcgtcgcggccgacctccgcgccggcctcgacggcgagaccggacacctcgtcgcccggctccgcgtcgaaggcccggtggagcgggccacgctccgctgcgacggccgcgccgtggcgctcgcgcggaccgcgccggatctgttcgagggcgaactcctcctccccggcatcgccccctggtggccccacacccacggcgagccgcgcctgcacgcggtcacggtcgatctcgacgggcgcacccacgatctcggccgcacggggttccgcagcgtcacgctcacccgcccgttcgccgaggggctgggcctcgcggtgaacggcgtgccggtcttctgccgcggcgccaactggacgccgccggacctcgtcggcctcggctgcggcgcggaggatgcccgcccgctcctcgatctcgcccgcgaggccgggatgaacatgctgcgggtctccggcatcacgctctacgaatcccaagccttccacgatctctgcgaccagatgggcatcctggtcttccaggacctgatgctcgcgaatttcgactacccgcacgacgatcccgccttccgcgaggagctggaggccgagatcgccgacctcctcaaccggacacagctctcgcccgcgctctgcgtgctctccgggggcagcgaggtctggcagcaggccgcgatgctgggcgcgccgcaggcggtctgggcggacgccttcgcgggcgagcggcttccgatgctggccggggcggtccggcccgacctcgcggtggtgccgaactcgccctcggggggcgatctgcccttctccaccacggcgggcgtgacgcattattacggcgtcggcgcctaccgccggccgctggaggatgcgcgccgggccgaagtcggcttcgccaccgagtgcctcgccttcgcgaacctgccggacgaagcgagcctcgccgcgatggggctcggcgacatggaggcgccgcgctggggcgccggcatcccgcgcgaccggggggcggactgggatttcgagcaggtgcgcgaccattatgtcggcctgctgttcggggtggatccggccgcgctccgccgcgccgacccggagcgctaccgtgacctcgggcgggccgcggtcgccgaggtggtggaggcgaccttcgccgagtggcgccgggcgcgctccgcgacccggggcggcctcgtctggttcctgcgcgacctcgcccccgggacgggctgggggatcgtggacgcgcggggccagccgaaatcgggctggtacgccctgaagcgcgccttccggccggtgcaggtcacgctctccgacgaggggctgaacgggctccacgtgcacctgcacaacgagaccgcggccgcgcgcgacctcaccctgcgcctcgccttcacggatgcggcgggccgcgcggtcgccaaggccgagcgcgccgtcacccttccgggtcgctcatcccagaccctctcgtccgcggaactcctcggccgcttcttcgacgccaccgacagctaccggttcgggccgccggcccacacgctcggacatgcgagtctctgcgactcggccggcgcggtcatggccgaggccttccatttcccgggtgggcgccggatcgagccggccgagaccggcctcgcggtggccgtggagggcgcggcgatccgcatccgggcggagcgccacgcgctcggcgtgcaggtggaggcggagagcgcgcggcctgacgatacggggttccacctcgcacccggcgcggagcggctgatcgccttcccgggtacgttgcgcctgccgcgcggccgggtgcgggcgctcaacgccgtcgaggtggtggcgttcggcccggaggactga

SEQ ID NO: 7746 - DNA, 216 bp, Methylobacterium sp.
atgggccaggatctcgacagcaccgatggcagcggccggatggtcacctttctcggccgcggacttgccctgcggtctcatgcccggctcacgcttctcgtctgcccgctctgttcccagcgcaacggtgaccgaatggctgtcaaaggcacttgcgagtggtgtgcctacgagccggccgagcgggacgaagagccctgcgggccggaccgctag

SEQ ID NO: 7747 - DNA, 1545 bp, Methylobacterium sp.
atgttcaagacgatcctgacgggcctcgccctcaccttcgcctccaccggtgccgcgtcggcccagacgcccggcggcgtcgccaacgtggtgatccagcccgaaccgccgggcctgatgctcggtctcgtccagaacgcgccggcccagacggtggcgggcaacatctacgaggggctgctgcgctacgatttcgccctcaagccgctgcccggcctcgccgagcgctggagcgtgagcgaggacggccgaacctacaccttcaacctcgcggcgaacgccacgtggcacgacggcaagccgttctccgccgaggacgtcgtcttctcggtcgagttcctgcgccagacgcatccgcgcgcccgcggcaacctcgcgaaggtgacgagcgtgacggcgcccgacgcccacagcgtggtcttcaccctctccgagccgttcggccccttcctcggcatcttcgaggtcggctcgctgccgatggtgccgaagcacatctatgcgggcaccgactacaagaccaatccggccaacaaccatccggtcggcaccggaccttacatgttcaaggagtggaagaagggttcctacatccgcctggtcaagaatccgagctaccatgtggccggaaagccctatctcgacgagatctactggcacgtcatcccggacgcggccgcgcgcgcggtcgcgttcgagaccggcaaggtcgacatcctgccgggcggctcggtcgagaacttcgacattccgcgcctgtcgcaggccaagggcgtctgcgtcaccaagaagggctgggaatacttcgctccgctctcctggctctggctcaacaaccgcggcggcccgaccgccaacaaggccttccgacaagcggtctcctacgccctcgaccgcgatttcgcgaaggacgtgatctggaacggcctcggcaagccggcgatcgggccgatcgcctcctcgacgcgcttcttcaaccccaagctcgcaaagtattcctacgacttggccagggccaaggccctgctcaaggagtccggctacaagggcgagaccctccgcctgctgccgatgccctacggcgagacttggcagcgctgggcggaggccgtgaagcagaacctcgaggatgtgggcatcaagaccgagctcgtcgccaccgacgtggccggctggaaccagaagacctccgactgggactacgacatcgccttcacctacgtgttccagtacggcgacccggcgctcggggtcgcgcgcaactacgtgtcctcgcagatcgtcaagggctcgccgttcaacaacgtcgagggctacgcgaatccggccgtcgatgcggggttcgccgaaggggcggcgacgctcgacccggccaagcggcaggccgcctacgacggtgtccagaagatcgtcatcgaggacgccccgctcgcctggctgctggagctggagttcccgaccctcacccgctgcaaggtccacgatctcgtcaccaccagcatcggcgtgaacgacgggttccgtgacgcctggatcgagcgctga

SEQ ID NO: 7748 - DNA, 1245 bp, Methylobacterium sp.
atggaggacacgcccatgaacgccccgacctgtccgcccggctccgccgcccccgaggccaagccctccgccggcttcgtctgggacgatcccttcctcatcgacgaccagctcaccgaggacgagcgcgcgatccgcgacgtcgcgcaggccttcgccgaggagcggctgcgccccggcatcgtggaggcctacgcggaggagaagaccgatcccggcctgttccggcagatgggcgaactcgggctgctcggcgtcacgctgcccgaggaatacggctgcgcgggcgccacttacgtcgcctacgggctcgtggcgcgggccgtcgaggcggtcgattccggctaccgctcgatgatgagcgtgcaatcctccctcgtcatgtacccgatccacgcctacggcaccgaggcgcagcgccggaagttcctgcccaagctcgcgagcggcgagtggatcggctgcttcggcctgaccgagccggatgccggctccgaccccgccggcatgaagacgcgggccgagaagatcgacggcggctaccggatctcgggcgccaagatgtggatctcgaatgcgcccttcgccgacgtcttcgtggtctgggcgaagtccgacgcgcatgacggcgcgatccgcggcttcgtgctggagaagggcatgacggggctctccgccccggccctgaagggcaagctgtccttgcgcgcctcgctcaccggcgagatcgtgatggagggcgtcgaggtcggcgaggacgcgctgctgccgaacgtctcggggctgaaaggcccgttcgggtgtctcaaccgggcgcgctacggcatttcctggggcgcgatgggcgcggccgaggattgctggcaccgggcgcgcagctacaccctggagcgcaagcagttcggccgcccgctggcccagacccagctcgtccagaagaagctcgccgacatgcagaccgagatcgcgctggggctccaggcgagtctcagggtcggacgcctgatggatgcgggcaagatggcgcccgagatgatcagcctgatcaagcgcaacaattgcggcaaggcgctcgacatcgcccgcaccgcccgcgacatgcacggcggcaacggcatcatgggcgagtaccacgtgatgcgccacgcccagaacctcgagacggttaacacctacgagggcacgcacgacgtgcacgccctgatcctcgggcgcgcccagacggggctccaggccttcttctga

SEQ ID NO: 7749 - DNA, 1995 bp, Methylobacterium sp.
atgattggggtcaacctgtccggtgcggagttcggctccggccggggcacctatggtaaggactacatctatccgggcgcggacaccctcgcctactacgcgggcaagggcgtctcgctcgtccgcctgcccgtgacctgggagcggctgcagccgcagctgggcggtccgctcgatccggccgagctgtcgcgcctggagaccttcctgcgcagcgccgagtcctacgggatcgacgtcgtgctcgatctgcacaatttcggccgctacgacggggtgccgatcggttccggctccgtcaccgtcggggccttcgccgatctctggacgcgcctggcccaggcggtcggagggcatccgaacctccacggctacggcctgatgaacgagccgcacgacatgggcgacgccgcgatctggcccgccgccgcgcaggccgcgacggacgcgatcaggaccgtcgacacccgcaccaccgtcatcgttgccggggacgcctattcgggggcccggaactgggccgcccacaatgcggggctcgacatcgaggaccccgccggcaagcttctgtacgaggcgcacgtctatttcgaccgcgacaatagcggtgtctataatgcgccttacgcggaatcgggcgcctctcccctcggtgccgcgaccgcactccagtcctttaccgattggctggcagcgcgcggcgcgcagggcttcatcggcgagttcgcggtcccccgcgacgatccggcctggctgcccgtgctggacaccttcctggctgccatgagcgcgagcggcctatccggcaccatctggggcggcggcccgtggtggggcgactacaagctctcgatcgagcccgttgcgggcacggacagtccgcagctcgacgtgctgtcgcgctacttcgcggaggaggcgcgcccgacccaggtgaccggcgatgccggggcgaaccttcttatcggcagtgccggagacgacacgctggcgggtggggcgggcgccgatacgctgctgggtgggaccggcgccgatcgcctcgacggggggagtgatggcgacctcctctacggcgaggccggcgacgacctcgtggagggcggtgcgggcgacgacacccagtacggcggcgacggtgacgacgtgctcggcggccagggcggcaacgacgtgctgcagggcggagcgggcaacgaccgtctctacggcgacgagggcgacgacgtgctcggcggccagggcggcaacgatctcctcgacggacagagcggcaacgaccgtctctggggcgacgagggcaacgacaccctgcacggcggcgagggcaacgacatgctggagggcggcctcggcgacgacctgctcaagggcgaggccggtgccgacacgctcctgggcgcggacggcaacgatgtcctggacggggggctcggcagcgacctcctctacggtgggaccggcaacgacagcctgcgcggcggcgacggcgccgacctcctctacggcgaggccggcgacgacctcgtggagggcggtgcgggcgacgacacccagtacggcggcgacggcgacgacgtgctcggcggccagggcggcaacgacgtgctgcagggcggagggggcaacgaccgtctctacggcgacgagggcgacgacgtgctcggtggccagggcggcaacgatctcctcgccggacagagcggcaacgaccggctctggggcgacgagggcaacgacatgctggagggtggcctcggcaacgacctgctcaccggcgatgccggtgccgacactttcgtgttcggtcggagccagggccgcgataccgtgagcgacttctccttcgcgagcggcgacaggttgtggcttcagggccagggctacacggtcagccaggcggccggcggcacgctggtcacgctgtccgatggcggcagcgtgctgctccaggggatcgccgcctcgtccttccagggcagctgggtcgtctga

SEQ ID NO: 7750 - DNA, 369 bp, Methylobacterium sp.
atggctggcaccggcacgtccgactcgatcctcgcacgcctgtccgcgggcgagttcgttgtgaacgccgctcccgccgctaagcattgtaccctcctagagcagatcaaaacgtgctcgatccgcttaccggcgttcgccgagggcggcctcgtaggcggcggaagagggggcccgacgggcactgccgcggcgccggacaatatcgcgatcgcgccctcgatcacggtgaacgcagcaggcgggactagggagcagaacacggatctggcgcagcagacggccaaagccgccgagggcatgattcggtctatcatcgtttcggagctgatgagtcagcgccggcccggcaatatcctcgcgggctag

SEQ ID NO: 7751 - DNA, 585 bp, Methylobacterium sp.
gtgacggcgagcgagggacgggcgggagctttcccggatctgcgccgggtgctcgatgcctccggcatcgtcggcacttgggactggtacgtgacgcgccgcgcggtgctctacgacgagggcgcggcgtcgctgctggcgggcgatcccggcctcgccggtcgggagctccagggttccgtggcgacggccgggatccatccgaacgacctcgactgggtcatggccgagatgcggcgcgccgtggaggcgggcggcctgatcctcgccgagtatcgggtgcgccggccggacgggagcgtgcgctgggtgctgagccgcgggcgcgcctatcgcgacgccgaggggcggcccgtgcgcgcccacggggtcctcatcgacataaccgaaggtcgcgacgaggggcagcgctacgtcacgcacgccgccctgtcgcccgccgccgccgccgaccgactgatggatctcagcgtcgagctgcgggcgctcgcggaggcgatgccctcctcgacattgagcctgctcgtcgacctgatgctcctggagatcggcggcgccaccgcggagccgggcgcgcgtcactga

SEQ ID NO: 7752 - DNA, 942 bp, Methylobacterium sp.
atgagcccgtccgatttgaccgggcgcctgatcgtccaggaggtcgccacccgcgacggtttccagatcgagcccgtcttcgtggagacggcggagaagatccggctgatcgacgcgctggccgccgccggcttcggccggatcgaggtctcgtccttcgtctcgccgaaggcggtgccggcgcttcgcgacgcggcggaggtcttcgccggcctgacgcgccgccccggcacggtctacgtcgcgctggtgcccaatccgaagggcgccgagcgggcgctccaggccggggtcgacgagatcaacctcgtcgcctcggtgagcgagacgcacaaccgcgccaacatggggatgaccccggcggcctcgatcgagggcttcgcgcgcatcatggagacggtgcggggctcggggctgagcgtgaacgcgacggtcgccaccgccttcggctgcccgttcgagggcgaccagcccgacgacacggtgctggcgcaggtcgagcggtaccgggcgctcggcgtcgacggcgtgacgctcgccgacaccaccggcatggccaatccccggcaggtcgcccgcctcgtcgcgcgggcgctgcccgcggtcggcgcggaccggctgacgctgcacttccacaacacccgcggcctcggcctcgccaacgtgctggccgcctacgaggcgggcgcccgccgcttcgacgcggctctgggcgggctcggcggctgccccttcgcgccgggcgccaccggcaacatctgcaccgaggatctcgtcagcatggcgcacgagatggggctcgcgaccggcctcgacctcggggccctcatcgacctctcgcgcgacctgccgcgcctcgtcggccacgacgtgccgggtcaggtcgccaaggccggccggccctgcgatctccaccccgcacctccgccgaaggccgcctga

SEQ ID NO: 7753 - DNA, 291 bp, Methylobacterium sp.
atggcttggtacgaggcggaagactacagccgcctgcgcgcgatgatgcaggatgccgaccggctgcccgcgcactacgagggttgggccatctccgccgagcagctcgaacgggaagtgaccagaagcggcgtcgcggtcgtccgggtgcggcttacgccggatgcgtttctgacttggtgtgcggccagggatctgcccgcgaacggcgctgctcgcgcgcgctacgccagcgaagccgttgcccgggccgatgaagggcagccggccgcgctggatcgccgaggctag

SEQ ID NO: 7754 - DNA, 2085 bp, Methylobacterium sp.
atggaggaagcaggcgtggtccgtcaggaacttcgcggcacggtcgccgtgctcacgctgtcgaacccgccggtgaacgcactgggctacgacctgcgctccgcgctcgacgcggccctgtcgcgggcgctggccgacgacgcggtgcgggccgtggtgatcgcggccgagggcaaggtcttcgtcggcggcgccgacatctccgagttcggcaagccgccgcgcgcgccgctgctgacggatctgatcgagcggctcgacggggctgggaagccggtggtcgcggcggtccacggggcggcgctgggcggcgggctcgaactcgcgatggcctgccacgcccgcgtggtcgggccggcggcgaagctcggccagccggaggtgaagctcggcctgatcccgggcgcgggcggcacccagcgcctgccgcgcctgatcggggcggagaccgccttcgggatgatgctctccggcgagccggtcggcgcggagcgggccgtggcggcgggcctcgccgaggcgctggagccgggcgacctcgtcgcggcggcctgcgcgcacgccctgcgattggcggaggcgggccggccggcccgggtccgcgaccgcgccgagcggatggacgaggcggcgcgcgcggccttcgaggcgcgggcggccgaggccctgaagaaggcgcccggccagccgaacgtggcggccctggtcgatgccgtgcgggccgggttcgagcagcccttcgacgaggccgtgaggaccgagcgcgcctgcttcctcgccctggtggacgacccgcgctccaaggcgctgcgctacgccttcttcgccgagcgcgagaccgggcgggtgccggggatcgccaaggacacgccgcgccgggcgatcgcttccgcggcggtgatcggcgccggcacgatgggcggcggcatcgcgctctgctttgccaatgcgggcatccccgtcacggtgatcgagaccgaacaggacgccctcgaccgcggcctggcgcggatgcgcgccacctacgcgtcctcggtcaagcgcggctcgctcagcgcggcggcgatggaggagcggctggcccgcatcaccggagcggtcgggctggagcgcgcggccgaggccgacatcgtggtggaagcagccttcgaggagatgggcgtcaaggaaacgatcttctccgcgctctcccggatcgccaagcccggcgcggtgctggccaccaacacctcctatctcgacgtgaaccggatcgcggcggcgaccgaccggccagccgacgtgctcggcctgcacttcttcagccccgccaacgtgatgcgtctcgtcgaggtggtgcgggcggagcgcacggcgcccgacgcgctcgccaccgccaacgacctctcccggcgcctggggaagctgccggtgacggtcggcgtctgcttcggcttcgtcggcaaccgcatgctggcccgccgatcggcggcaggcgagcgcctgctgctcgcgggcgccctgccgcacgagatcgacgccgcggtcaccgatttcggcttccgcatggggcccttcgcgatggcggatctggccgggctcgacatcggctggcgcacccgcaaggccaccggcggcaaggctccggtcgccgacgcgctctgcgaggcgggccgcctcggccagaagacgggccgcggcttctatctctatcccgagggcgcccgcaccggcgcgcgcgatcccgaggtcgaagccttgatcgccgcggaatccgagcgccggggcatcgcgcggcggagcttcagcgccgacgagatcgtcgcccggctgatgctgccgatggtcaacgagggcgcccgcatcctggaggagggtatcgcggctcgtcccggcgacatcgatacgatctggctcaacggctacaactggccggcctggcgcggcggcccgatgcactgggcggacgggctcgggctggcgcaggtcgcggccgatctggagcgcttcgcggaggaggcgggggacgagaccctgcgccccgcgccgctgctggcccgcctcgcccagacggacaggggattttcccagtgggacgccccgtga

SEQ ID NO: 7755 - DNA, 1182 bp, Methylobacterium sp.
atgctgttcgatcccgacgacctgccgctcgccggcatccgcgtgctggatctctcgcgcgtgctcgccgggccctggtgtgcgcaggtgctgggcgatctcggcgccgacgtgatcaaggtcgagcatcccgagcgcggcgacgacacgcgcgactggggcctgcggaccggcccgagcaacacctcgtatttcgacagcgtgaaccgcaacaagcgctcgatcggcgtcgatctcgccgacccggaggggctggcgctggtgcgcgacatcgcccgccagagcgacgtggtggtgcagaacttcaagaccggcggcgccgaccggctcggcctcggctacgcggccctctcggccgagaacccgcggctgatctactgctcggtctcgggctacgccgccgacggacccgaggggacgcggccgggctacgacctcgtgatccagggcgagtccgggctgatggcgctgaacggcgaggccgagcgcccgcccctcaagttcggcctcgcggcggtcgacctgttcaccggtcagttcgcggcgcagggcgtgctcgccgccctctaccagcgcgagcgcacggggcgcgggcgcctcgtcgagctcgccctgttcgattgcggcgtggcgctgacctcctattacggcctggaggcgatggtgcagggccgcgacccggcccgctacggcaacgcccatccctcgatcgtgccctacggcgtgttcgaggcgggcgacgggccgatcgtgctgacggtcggtaacaacgcgcagtaccgccgcttctgcgagcaggtgctggagcggcccgatctctgcgccgacccgcgctttgcgacgaacctcgaccgctcgaagaaccgcgccgtcttcgtgccggtgctcgaggcggaactggccaagtggacgcgagccgacctcctcgtccgcctcgcatccgccggcatcccctgcggcgaggtgctgggcctgcacgaggcgctgacctcggagcgcgcccgctccgccggcctcgtcatcccgcagggcgcgggcgcggaggcggcgcacgtgctcgccccgccctaccggctcgacggcgcacgcctgccggtgcggcacatgccgccgcccctcgacggatcgggcgccgacatccgggccgcgctaccggatcgtccggcaacgcggacggtctga

SEQ ID NO: 7756 - DNA, 372 bp, Methylobacterium sp.
atgccttgcgccgtggccaagctcctgccgctcctcggatacgcggcctgcctgctcaccctcgcggcgatgacggggatcaacctctatgcgggcccgcggatcgcgacggcgcaggtgccgatgcagtggtcgctgtcgggcgagccgacttggttcgccggcaagatcgtcgggttgtggtttcccgtcctgatcgccctggtggtcggcgcgagcctcctcctgaaggcgcgccagggcggggcgccgtccggcggctgggccgacggcgcggactggctcgtcctcctgggcgcctgcagcctcttgctctgcgtccacgcttggcacgtctcggccgtcatggcctgggcggcgaagcagtcctag

SEQ ID NO: 7757 - DNA, 921 bp, Methylobacterium sp.
atgccggttgcggcgacgctctccaggcgcttcctctccgatgtcgatcatcgcacgaccggggaggtcctcgatcatcccggcttcgcgcaaatgcgacagccctacatcaccgctacgatggcgagctacaagacggcgagcttcccgggcgggtgccagagcacggcctaccgggtcgcgaccatcggcgtgatcgtctgtctctacgccgcctacgacgtcgaggaccgcgcgacgtggccgacgctcgcgcggctgaagcagaccgtcacggccttcgggctctccagcgcgcgccaagtcgatgacttcgtcgcgcgcctcgtgcggacggacaacctcgtgctggagcgcgccccagccgacgggcgcctgcgcctgctcaagccgaccgacaagctcctggcctgggaccgccacgtgctggccccctactacgatgccctccagagcctctatcccgagccaggctacgtccctacccgcgaccctggattccatctggcgctgcgcagggcgtcggtgcggtaccttgggcccgtggcgggcttcatgcgggagaacacggatctgctcccgttccatatcatgtaccagggcgtgcatatgctgatgaccctggtcaacctgagtgtggccgagggcgcacgcgcgccgcacgagccggaccttggcgccttccaagaggccttcggcatctcgcggacccatatccgcaacacgctgctcgcggcgcagcaagccggccttctcacttggagcggtcgggtcgagaagatcatcgccctgacgccacgcggcctggccgccatcgaccgcttcatcgccgacaccctcgcttcccacgatctcggctaccggctcgccctcggggatcttgggcaccccgtgacgcccccgaaacgccgcgccccctga

SEQ ID NO: 7758 - DNA, 93 bp, Methylobacterium sp.
atggaagtggttgtcatggtggccggcgtcctgggggccgcgggcacgatgctctgcatgatgccgagcctcgattctttcttcgagtggtag

SEQ ID NO: 7759 - DNA, 318 bp, Methylobacterium sp.
atgaacgtcacgagcgcaagcgcgtccgccctgtcgcccagttcgcgatcggcgggcacgggcggtgccggcgcagcccgcagcgagagcggcccggtctccggcggcacggagaccgaattcctgaagtacgccaggatgtcgccgatggagcggatgcgggccggcatcctgaagggcatggacctgaccgaggaccaactcgccgccctgccgcaggatgcgcgcacgaaggtcgaggacgcgatcaaggatcagatgaagacgatgatgggtcagagcgaccgcaaggggcagttgatcgatctgtcggcatag

SEQ ID NO: 7760 - DNA, 873 bp, Methylobacterium sp.
atggatctcgacatcggcgaattcgaggaggtctgccgcgacctctacgtccgggccctgaagatcctgccgcccgacatcaaggcgggattctcggaactgcagaagagcgagaccagcgcgaccggccgcgccatcctcgacacgatggtggagaacgtcgcggtcgccgagcgcacgaagaacatcctctgccaggacaccggcatcccgatctacaacatccgcatcggccgcgacgtcgccttcgacggggtcgagctgaaggccgcgatccggcggggctgcgagcgggccacgaaggagttctcgctgcgctcctcggtggtccatccgatcacccgcacgaacgagcagacctcctgcggcatccgcgtgccgatcatccacgtcgacttcgacgacagccctgagaccgtcgcggtcgagatgatcccgaagggctcgggctcggagaacggctccttcctgcagatgctgctgccgtccgacgggatcggggccgccaagcgcttcgtgatcgaccgggtgatcgagctcggcggccgggtctgcccgccgaccatcgtgggcgtggggctggggggtacctcggacctctgcatgcatctggccaaggtcgcggcgacgcggccgctgcgctcggtctgcccggacccggagggcgcccggatcgaggcggagctgtcgcgggcggtcaacgagctcggcatcggcccccagggcctcggcggacgctcgacgagcttcgcggtgcatgtggagctcgccgccacgcacatcacccagaacccggtcgcggtgaacatccagtgccactcggcccgccgcgcccgcgcgacgatcacgccgggcggcatcgcgttcgcgtga

SEQ ID NO: 7761 - DNA, 414 bp, Methylobacterium sp.
atgggcgagcgatctcaggagcacatcctcgtcctgctcctcgacgcggtccgcgacgggggcaggctggtcgggcggacgctggaactcgcccgcgtcgagacggacggcaacatccgggcgctcgccgggctcgccgccaaggtgctggcgatcaccgtgctggtggtctcggccttcctcgtcttcctcgacgcggccgtgaagatgctggccgcgctgatcggctcggaggcgatcggcgcgctcatcgtcgcggtgcccttcctgggcgtggccgcgatcctcgggctgatgggcctgcgccgggtcgccctgcacaatctcgaaccgtggcggagcatgcgcgaggccgagcggatcgccgcccttgccccgtccgtactcagccggcccgccccatccagtcggtga

SEQ ID NO: 7762 - DNA, 681 bp, Methylobacterium sp.
atgatccgcttctactacaatctctctccgaacccgatgaaggtggcgctctgcctggaggagctcgggctgccctacgagccggtgccggtggacgtgcgccgcggcgagcagttcgaccccgtctacggtgcgatcaacccgaacggcaaagtgccggcgatcgtcgacggcgacgtcacggtgttcgactcgaacgcgatcctgctccacctctgcgagggggcgggccgcttcctgcccgagggcgaggcagcccggggcgcgatgctgtcctggctgatgttcgtcgccaccgggatcgggccgttctcgggccagtgcgtgcatttccgccacttcgcgccccccggccaggactacgcggtcgagcgctacaccttcgaggcgcggcgccactggggcgtcctcgatgcgcacctcgccgatcggccctggatgctgggcgacgcctacgggatcgtcgacatggcggtctggggctgggctcggaacgtgccgttcatcctcggcgagggcgccttcgcggatctgcccaacgtgaagcgcctgctcgacgcggtgaacgcgcggcccgccgcgcagcgtgccgaggccctgaagacgcgccacagcttcaaggccgagatggattccgaggcccgcggcttcatgttccgggcgatcgggaccgcggcctga

SEQ ID NO: 7763 - DNA, 231 bp, Methylobacterium sp.
atgctgctctccgaatggatgcgccgcgagggcctgagcgacgccgatgtcgccgccgctgtgggtctgtccgccgaggccatcagaaagctccggttccgagcgcgcggcacgtcactgcgggttgccgcgcggatcgaggccctgtccgccgggcaggtccgggcgcacgatctccagccgcgccaggacaagcaccaggccgccccgcagccggaggccgtgccgtga

SEQ ID NO: 7764 - DNA, 828 bp, Methylobacterium sp.
atgagcgccaccctccaggccgcgccggccccgacggcccggcccgtgccccgcggcgatgccggggcccacacccaggtcggcgccccgatcctgcgcatcacggccctgcgcaagtcctacggcgcgcacgaggttctgaagggcatcgacctcgacgtcgcacgcggcgaggtcgtcgcgatcatcggcaagagcggctcgggcaagagcacgctcctgcgctgcatcaacggcctggaggtcttccagcagggctcgctcatcgtcgacgggcgccacctcctccacgataacccgaaggccatgcgcgagctgcgccagggtgtcggcatgatcttccagagcttcaacctcttcccccacctcacggtcggccagaacgtgatgctcgccccccatctggtgaagcggcgcgggcgggcgcagaacgcggagcgggcgcgcgcgctgctggcgcgggtgggcctctcggagaagttcgacgcgatgcccgacaagctctcgggcggtcagcagcagcgcgtcgcgatcgcgcgggcgctggcgatggatcccgccatcatgctgtgcgacgagatcaccagtgcgctcgatcccgagctcgtcggcgaggtgctgcgcgtggtggaatccctcgcggacgagggcatgaccctgctgatggtcacccacgagatgagcttcgcccgcaaggtggccgaccgggtcatcttcatgcaccagggcctcgtccacgagatgggcgcgcccgagacgatcttcggcgccccgcagaccccggagctgcgccagttcctcggcctgatggagggttcggccgcctga

SEQ ID NO: 7765 - DNA, 978 bp, Methylobacterium sp.
atgcacgtcctgattctcggcgccgccggcatgatcggccgtcgcctcaccgccgccctcgtcgcagccggccgcataggcaacgacccgctgaccggcctcacgctggtcgatgtggtgcggcccgaggcacccgcggagttcgccggtcgggttcgggtcgaggccgccgacctctcggcgcccggcgctgccgccgcggcgctcgccgagcggcccggtctcgtgttccacctcgcggcggtggtctcgggcgaggcggaggccgacatggatctcggctaccgggtcaacctcgacggcacccgcctgctcttcgaggcgatccgtcgcgtgagcgaggccgagggctaccggccgcgggtggtgttcacctcctcgctcgcggtgttcggccagccgctgcccccggtcatcggcgacgacttcatcccggcgcccgcttcctcctacggcgtccagaaggcgatgggcgagttgctgctcgccgattacagccgccgcggcttcctcgacgggatcggcctgcgcctgcccaccatctgcgtgcggccgggcaagcccaacaaggcggcctcgggcttcttctcgggcatcctgcgcgaaccgctcgccgggctgccggccgtgctgccggtgcccgatacggtgcgccactggttcgccagcccaggggccgcgaccggcttcctgctgcacgcggccgggcttgatctctcgggtctcggaacccgccgcacgctgaccatgcccggcatctcggcgacggtggcggaggagatcgaggccctgcggcgcgccgcgggcgagagcgccgtcgccctgatccgacgcgagccggatccggcgatcatgcgaatcatcgcgacctggccggaggccttcgacacccgcacagccaatgccctcggcttcgtcgcggacgcctccttcgacgcgatcctcgcgcagcacgtcgcggagtcgcagcggtcctga

SEQ ID NO: 7766 - DNA, 1284 bp, Methylobacterium sp.
atgcgatcccagatcctcgccgtgctcctgacgagcgcggccctcaccgtcggcgcgctggcgcagggtgcccagcccggcgagaccaagggcaggaccgacgacctggagaaactccaggccttcaagagcacgggcacggagccggcgcccgaggtgccgcagaccgggcgccgcgccgacgccatccgcaagacgctctccaagatcacgctgcccccgggcttcaagatcgacctctacgccgtggtgccggatgcccgctccatcgcggtcggccccaatgccggcgtgctcttcgtcggtacccgcaagagcaaggtctacaccgtcaccgaccgcgacaaggaccgggtggccgacgaggtgcgggccttcgcgcccggcatcggtttcaaggtaccgaacggcgtctgcttctcgcgggacggcgtgctgaccgtcgtcgagcagaaccgggtcctggccttcccggccgcggagttcttctacgagaacccggacgtcgccgccggcatcgtggtccgccaaggcgagctgatcccggcaggggaagagagctacaaccacaccgcccgcgtctgccgggtgggaccggacggcaagacctacatcgcgctcggccagccctacaacgtgccgcccgccgacaagctcgacctctacgcgaagaccggcatcggcgggatcatccgggtcgatgcggacgggaagaaccgcgaggtcttcgccaccggcatccgcaactcggtcggcatcgatttcgccgccgacaagagcctctggttcaccgacaaccaagtcgacggcatgggcgacgacacgccgccgggcgagctgaaccgcgccgccaaggcgggcgagaatttcggcttcccctggtacggcggcggcgcggtccgcaccaacgagtacaaggaccagaccccgcccgcgggcgtcgtggcgccgcaggccgagctgccgccgcacgcggccgatctcggcctgaccttctacgggggcaagcagttcccgaaggcctaccagggcggcctcttcatcgccgagcacggctcgtggaaccgcaccacgccggtcggcgcgcgcatcatgttcgcgacgctcggcgcggacggcaaggtcgcctcggtgaagcccttcgccgagggctggctgacgaaggacggcgagtatctcggccgccccgtcgacgtggcggtgctgctcgacggctcgctcctcgtctccgacgacaccgcgggcgcgatctaccgcatcgcctacgagggcggggaccagtga

SEQ ID NO: 7767 - DNA, 351 bp, Methylobacterium sp.
gtgaggggaccgaaccgggctctcggcctcgccctcgcggcgctggtcctcggtgcgctgatcctcgatgcactcccggccgcggccggggccgacgccgcggcgggccgcaagcgcgccgcggcctgccaagcctgccacgggctcgacgggctctcgaagctgccggaggcgcccaacctcgccggccaggtcgaggtctatctcgtcaaggccctgcgggagtaccgggacggcacgcgccgcaacgcggtgatgaacgtcgtcgccaaggacctctcggacgccgatatcgacgacctcgcggcctattacggcggcctgcagatcgaggtgctgccgcccggctag

SEQ ID NO: 7768 - DNA, 3459 bp, Methylobacterium sp.
atgcggatcctcgccctcgacctcgagcgctacggccccttcaccgaccgcacggtgcggttccgggaggatgcacggctgcacgtggtcctcggcgccaacgaggccggcaagagctcggcgctcgccgccgtcaccgacctcctgttcggcatcgaggagcgcacccgctacgccttccggcacgacatgccgtcgctgcgtctcggcgccgagatccgggccgcggacgggcgcagcttgcgcttccgccgccgcaagggccgcaagaacaccctggtggacgtcgccgatgccgcgctgcccgacgacagccttgcccccttcctgggcggcctctcccgcgaggtgttctgccgggccttcggcctcgattcggcctccctgcgggccggggccgccgagatgctcgaggccgagggcgagctcggcgccagcctgttcgcggcggcctcggggcttcgcggctaccgggcgctccaggggcggctggaggaggaggcggccggcatcttcatgccccgcgccgcccgcgaccggaccttctaccaggcgctcggccgctacgaggaggcccgcaaggcgatccgccagggcgagctgcggacgggcgactggcgcgacctcaacgaggagatcgctgaggcggggactcgcctcgacggcatccacgccgagcgccgccgcatcgccggcgagcaggcccggctcgcacgcctgaagcgggtggcgccgctgatccaggcggtcgacgccgccgccgaggccgccgccgaggccgccgcccgcgacgaaggcccggaccggcccgattcatggactgattcttggaccgacaccctcggcgcccgcatcgtcgcggaggcggcggcccgcgaggcgaccgcccgcgccgcggaggccctggagcgggccgagcaggaactcgccgccctccccctcgacgaggggctgctcgcccgggccgaggcagtgctggaggcttttcgcgggatcgcccggcacgacaaggacgcccaggacctgccgcgcatccgggccgaggccgacgggctcggccaggatctcgcccggctcgccgcccggatcggcctgcccgatgccgccgcgctgaaactgcgccagccctcggacgccgcccgcatccgggtggagggactggtgcgcgagggccgggcgctcgccgccgagatcgcccgcctgacccgggacgcggccgagacccgggccggcccggaggccggtcgccccgagcccgccatcgatcccgctcccctgcgggcggacctgcgcggcctcgcgggcttgcgcgccgaggtcgcccgccgggacgagatcgacgggaccgtgcgccgggaggcggggctgctctggctccaggccggacgcctcgacccgccggttcccgatctcgccgcgctggcgcaggtgccgttccccgcccccgagacgatcgcccgccatcggcaggccttcgcggcgctggagcgccgccgcgagcgcgccgccgagcggcaggaggcggcgcggcaggccgccgcggcgacccgcctgcgcctgcgcctgcgcgagggcgcggaccccctgccctcgccggccgatctcgcccgcctgcgcgccgagcgcgatgcgctgatcgaggccggtcccgccggcgaggcggcgctgcgtcgttgccgggaggccgtggcggcggccgaccgggccgccgatgccctcgtgcgcgacgccgcacgcgccgccgagcaggccgccgaccggatccgcctggaggccgagacggaggaggtggccgccgccgaccgggacctcgccgcgctcgcggacgcccaggccgaggccgaagccgcctggcaggcggcctgggcgcccgccggcatcagggccgccccgcccgccgagatggcggcctggctcggggaggtccagacgctcctcgacgccctcgcctcggtcgagacgcagagcatcgagcagcgccgcctcgccgagcgcgtcgaggccgcccgcccgcccctcgcggcgctcgcggcgcgcgcggggctcgacctgctgcccggcctcgatcctggcctgatgctggcccggatcgaggagcgcgtcgcggccctcggcgaggcctgggagcgcgcccgcgaggcggaagggcgtgcccgcgccgccgccgagcaggccgcccgccgcgccgccgacctcgccgaagcgcgcgcccgcgaagcggtctggcgcgaggcctgggcgcgggcgctgcccgcgatcgggctcgacggcgcggccggccccgacgaggccgacagcgcgctggccgcctgggccgcggtgccggccgcgctcgccgcgctggagcaccagcagcgccgcatcacgggcctgagccgcgacatggaggtctaccgggcgggggccgacgccctcgtggccgcacacgggcccgatctcgccgggcttcccgccaccgcggccatgaaggccctgcacgaccgtctgggcgcggcgcaggagcgtcgcgcccgccgcaccgacctcgcccgccgccgccgcgaggccgccgaggccctggcggcggccgaggccgcgtgcggggccgcctcggccgctttggccgagcacctgaccgagcatctcggggagcacccgaacgaacgggatgaggatccggccgcgctccacgcgcgtctcacggcgcggcgggggctgcgcctggagctggagagccgccgggccgacctcgtgcggatctcggacggggtcgccgaggcggaactccgcgccgacctcgccgggacctcgcccgacgcgatcgaggcggcgctccgcggcctcgccctcgaggaggaggcgctcgaccagcgcggcaaggccgccttcgccgatcgggaccgtgcggagcgccgccgcgcggatctcgagggcggaaccggggccgaactggcgctcgcccagcgcaaggccgcggaggcggaactcgccggcgaggcgcggcgctgggcggtgctgcggctcgcaggcctcctcatcggcaccgcgatcggacgccagcgcgccggccagcaggatccgctgctgacccgcgctggcgccctgttctcggggctgaccgggggcgccttcgcggggctcgcccaggattacgacgcgggcgacgagccgcggctgaccggccggcgcgcgggcggcgagctggtgccggtcgacggcctgagcgagggcacgcgcgaccagctctacctcgccctgcggctggcctatctggaggattacgcgggccgcgccgagcccgcgcccttcgtgggggacgacctcttcctcaccttcgacgacgcccgcaccggccacggcctggaggcgctcgcggcggtcggcgaccgggtgcagccgatcctgttcacccatcaccgccacgtcgcggagctcgcccgcgcacggctgggcgaggcggcggatgtgctggagctgtag

SEQ ID NO: 7769 - DNA, 1251 bp, Methylobacterium sp.
atgagccggttcaccttcatccacgccgccgacctgcatctcggcagcccgctcagcggcctcgccgcgcgcgaccccgagatcgcccggcgcctcgccgcggccgggcggcaggccttcgaggacctcgtctccgaggcgctcgcgcgcgacgttgccttcctgctgatcgcgggggacgtctacgacggcgactgggccgacaacacgatcgggctgttcttcgcccggcaggtcgcccggctcgaccgggccggcatcccggtcctcctcgtgcgcggcaaccacgacgccgagagcgtgatcacccgggcgatcagcctgccggcctccgtccacacctttccgccgacccgggccgacacccaccggctcgaccacctgaaggtcgcgatccacggtcgctccttcccgaaccgggccgtgccggagaactacgccctcacctatccggccgccctgccgggctggttcaacatcggcctgctgcacacctcctgcaccggccacgccgcgcacgagacctacgcgccctgctcggtcgcggatctggcggccaaggattacggctactgggcgctcggccacatccacgactacgcggaactcgcccgcgagccctggatcgtctttcccggcaacctccagggccgcagcatccgcgagtgcggaccgaagggcgccgtcgcggtcgcggtcgaggacgggcgggtcgccgcgctcgagcggatcatcgtcgaccgcgcccgcttccaccgcctcgcgatcgacctcgcggaggccgccgacgagcgcgatgcggtggcacgggtcgaggcggctctgcgtccgctcgccgccgagacggcggggcggctggccgcggtgcggatccacctgaccggcgagacgcgggcgcacgaccggctggccgccgaccgcgacgggctcgtggccgagatccaggctgcggcccaccgggtgcacgaggacatctggctggagcgcctgaagatcgagacgcggcggccgcggggcccagcccccgccccggcgggcctcgccgccgcgatcgatccggcagggttgctcgccgacatcgaccgcgaccccgatttccgggctcgggccagggcggcgctggccgagatcgccgcgaagatgccggcgacgctgccctccgaggaggccgacctcgccgccgagctcgacgcgctctgcgccgaggccgaggcgctggtgctcggccggctcggcggcagacactgctga

SEQ ID NO: 7770 - DNA, 225 bp, Methylobacterium sp.
atgctgcgcatcatccagcccggacgcctgcccgtgatccacgcccatcctatccgccggcccgcccgccggtcacgccgcctgatcctgccggtgcagaagggcggcgcgtacgactgcacggtcgggctgcggcggctcggcccctggctcgtcgtcgacgacaacctcgcctgcggcggcatgaacgtcaccttccgcggcgtctacaggaggcggccgtga

SEQ ID NO: 7771 - DNA, 2172 bp, Methylobacterium sp.
atggatcgggtgaatgtcggcgggctcgcggtggcgcgggtgctccacgatttcgtcgtggaggaggcgctgccggggaccgggatctcgccggaggtgttctggggcggcctcggcgccgtggtgcgggacctgacgccgaagaaccgcgcgctgctcgcccggcgcgacgacctccaggcgcgcatcgacgcgtggcaccgggcgcgggccggcaagccggcggatccggccgcctacgaggcgttcctgcgcgagatcggctacctgctgcccgatcccggcccggtgcaggtggacacccgcaacgtcgatgccgagatcgccgagatcgccggaccgcagctcgtggtgccggtctcgaacgcccgctacgcgctcaacgccgccaacgcccgctggggctcgctctacgacgcgctctacggcaccgacgcggtctcggaggagggcggcgcgacccgcggcggcggctacaaccgcacccgcggcgcccgcgtggtcacccgcgcccgtgcctatctcgaccgcctcgtgccgctggccggcgggcgccacgccgacgtcgtcacctacgcggtcgaggacggccggctcgtcgccaacctgaacaccggcgagaccgtgccgctggcgcggcccgagaccttcgcgggctatcgcggccgggccggcatgccctcggcactcctcctgcgccacaacaacctgcacatcgaggtcgtgctcgaccgcacccaccggatcgggcgcttcgacgcctcgggggtcgccgacatcctgctcgaatccgcgatctcgacgatcatggacctcgaggattcggtcgcgacggtggatgccgacgacaaggtcgtggtctaccgcaactggctcggcctgatgaagggcacgctcgccgccgccttcgagaaggacggccgcacccaggagcgccgcctcaaccccgaccggcactacatcgcgcccgcgggcggcgaggtggtggtgcccggccgctccctgatgctggtgcgcaacgtcggccaccacatggacaccgacgcggtgctcgacgccgagggcaacgagatccccgagggcatgctcgacgcggccgtcaccgcgatgatcgcgatccacgacctcaagggcgattcgggcttgcgcaacagccgcaccggctcggtctacatcgtcaagccgaagatgcacggccccgaggaggtcgccttcgcggtcgagctgttcggccggatcgaggcgatgctcgggctggagcccgacaccctgaagatgggcatcatggacgaggagcgccgcaccacggtgaacctcgccgcctgcatcaaggcggcggcctcccgggtggtcttcatcaacaccggcttcctcgaccgcaccggcgacgagatccacaccgcgatggaggcgggccccgtcatccgcaagaatgacatgaaggcgaccgcctggatcaagggctacgaggagaacaacgtcgatgtcggcctcgcctgcggcctgctcggccgggcgcagatcggcaagggcatgtgggcggcgcccgacgccatggccgacatgctgatgcagaagggcgcgcatccgaaggccggcgcctcgaccgcctgggtgccctcccccaccgccgcgacgctgcacgccctgcactaccacgagaccgacgtgcgcgcccgccagctcgaactcgcccgccggccgcgctccgcgctcgccgagatcctggagatcccgctcgcccgctcgaacttcgcgcccgacgacgtgcagcaggaactcgacaacaacgcgcagggcatcctcggctacgtggtgcgctggatcgaccagggggtcggctgctccaaggtgccggacatccacgatgtcggcctgatggaggaccgcgcgacgctgcgcatctcgtcccagcacatcgccaactggctgcaccacggcgtggtcgacgaggcgcaggtgatggagacgctgaagcgcatggccaaggtggtcgaccgccagaacgcgggcgacccgctctaccggccgatggcgccggacttcgacgggccggccttccgggcggcctgcgacctcgtcctcaagggccgcgcgcagccgaacggctacaccgagtgggtcctcaccgcccgccgccgcgaggccaaggcggagggccggccggcctga

SEQ ID NO: 7772 - DNA, 939 bp, Methylobacterium sp.
atggttgccagactggaaaccttcggcggcgacatccgcgacgtgcgcgccttctgcgccgtggtcgacctcggcaccgtcacggccgccgcagcgagcctgcgggagaccaagggcagcgtgagccgccgcctctcccgcctggagcgggccctcgacgcgcgcctggtcgcgcgccacccccgagccgtctctccgacccccgagggcctcgccttctacgccagggccaaggagggcctggggctgctcgacgaggcggccgagagcgcgcgcgattcccacaccgtgcccgccgggcatctgcgggtgacgacctccgtcgatttcggcatcgaggtcatgccggagatcgtggcgagcttccgggtcctctacccgcagatcacggtcgagctcctgaacacggacggcgtcctcgatctggcggccaaccggatcgatctggcgctgcgcctgggcggggaggcgggcgacatgggctaccgggcctccacgatggccgcgctcgccatcgggctgtacgcctcgcccgcctacctgaagcgccgtccggccccggcgggactgctcgagctcgccgagcatgacctgatcctcgcgcgcgagaagctcgccccctccgcgcaacgtctctcgcccggcggtcggatcgagccgatcccgctccgtccggccatcctcgcgagcgacttcgccgcggtcctgaggctgacgctcgccggcgcgggcctcggacagatcccgaccctggtggcggcccgcgccgtcgagggcggcgacctcgtccgggtcttgccggattggtccgccggcggcggggcgctccgcgcgatcagcttggccggacgcgagctgccggcgcgcgtccgcctgttccgcgagcacgtgcgcggcgccctggcgagccgcttcgccgtggagacgggcgcgcactga

SEQ ID NO: 7773 - DNA, 1107 bp, Methylobacterium sp.
atggactcggctgcccggcgggcgggcgccgtcctgaccgtcgatgtcggagccgtggtcgagaactaccgcttcctgcgcaggcgggccggcggcgccgtctgcgcggccgtggtcaaggccgatgcgtacggactcggggccgaccggatcgcaccggccctggcacgggccggctgccgcgacttcttcgtcgccacgctcgacgagggtatcgcgctacgggatatcctcggccccggcccacggatcgccgtcctgcacggtgcgccgccgcgggccgagccggactgcctcgcggcccacctcgttccggtcctgaacggggcggagcagcttgcagcctggcacaggctcgcccgcgaccgcggccggtcgctgccggcgatcctccaagtcgacacgggcatggcccggttcggattctcggaggcggatctcgcgcgcctgctcgccgcgccggatccattcgagggcgtcgcgctcggcctcgtgatgagtcatctggcctgcgccgacacgcccgacgatccggccaatgccgcgcaacgcgccgccttccgatccgtccgagcgcgcatgcccggcatccccgcgagcctcgcggcctcctccggcatcttcctggggcccgcgttccacgccgacctcgtccggccgggcgccgcgctctacggggtgaacccgcaacccggacgccccaaccccatgcggccggtggtgcgtcttcaggcccgcatcctgcaactgcgcgacgtcgcgaccggcgacggcatcggttacggccacgccgccgtcgcccatcgcccgatgcgtcttgccgtggtcgccgccggctacgccgatggctacctgcgcagcgcttccggacgcggcacggcctttgcgggccctcatcccctggccgtactggggcgcgtctcgatggacagcctgatcctcgacgtcacggacgcgctgccggaggatgttccgctcggcggtttcgtcgatctgatcgggcctggccacggcgtggatgccctggccgaggccgcgagcaccatcggctacgaggttctgacgagccttggggcccgctaccaccgcatctatcgcgaggcttga

SEQ ID NO: 7774 - DNA, 918 bp, Methylobacterium sp.
atgagcaccacccctcagacaggccgcgccgcggtgatcggcctcggctcgatgggcgccggcatggcgggctcgctcctgcgggcgggcttctccgtcaccgcctgtgacgtgaacccggacgcggtcgcccgcttcgaggcggcgggcgggcgcggcgccgcgagcccggcccaggcggccgagggcgcggacgtcgtggtctgcgtcgtggtcaacgccgcccagaccgaggccgtgctgttcgggccgaatggtgccgccgagaccatgcgaccgggcgccgtcttcgtctcctcggcgaccatggaccccgccatcgcccgggatctcgccgcgcgcctggaggagaccggtcggctctacctcgatgcgccgatgagcgggggcgcggcccgcgcggcggagggtgcgctcaccttcctggcctccggctccgccgcggccttcgcgacggcccgtcccgcgctcgacgccatggcaggccggctctacgagctcggcgacgcggccggccagggcgccgccttcaagatgatcaaccagctgctggccggcgtgcacatcgccgccgccagcgaggcgatgagcttcgcggccaagcagggcctcgacctcgccaaggtctacgaggtgatcacggcgtccgccggcaattcgtggatgttcgagaaccgcatgccgcacgtggtcgacggggattattccccgaagagcgcggtcgacatcttcgtgaaggacctcggcatcgtgcaggacatggcccgggccgagcgctaccccgtgccggtggcggccgccgccctccagatgttcctggcggcctcgggcgccgggatgggccgcgacgacgacgcctcggtagcgcggatctacgcccagctctcgggcgcgaacctgcccacggccaaggcctga

SEQ ID NO: 7775 - DNA, 255 bp, Methylobacterium sp.
atggtttctctggaagacattcgtaatattctcgcccggaacgaggctctcgccccgatcgccggcgagatctcggaggacgacaacctgttcgacaagggcctcgactccttcggctcggtgcagctcatgctggcgctggaggagcatttcgacgtcgagttccccgaccatctgctgagccgcaagtcgttctcgacgatccgcagcatccgcgagaccgtctcgagcctggtccaggcggaagccgcctga

SEQ ID NO: 7776 - DNA, 966 bp, Methylobacterium sp.
gtgagcgccgccctcgacctgtcgcggccggggcccgccccggcctacatcgcgcacccgctgcacgccgccgaccggcactggccggagacgaactgctacgtcgatctctggatcgagctgctgcacgggcgcggcctcgtgccggaggcgctcctgggcttcaccctgcggcaggatttcgagggcgaccagttcaccttcttcaagccgccttccgccgacatcgaccggctctacggcctggagatcctcgaactcgccgtctacgacgggctggagcggcacgcgctggtgcaggccgcgcgcggctgcccggtccttgtcgaggtggacgcgctctacctgccggacacggcgggcacgacctacgggcgcggccacgccaagaccacgatcggcatcctggcgctggatcccgcggccaggacactcgactacctgcacaatgccggccggttcacgctgtcgggcgccgattacgagggcatcttcggcccctgcgagctgccgccctacgcggagttcgtgaaggcgggtgccccgccgctgccggaggccgagctgccgggcgcggccctcgacctgttgcggcgccaccgtgcccgggcgcccgcgaagaacccggtgctcgccttccaggcggcgctctcgcgaagcgcggacgcgctggtcgagcgctcgttggccgtgttccacgcctacgccttcaacaccacgcgccagctcggggcgaatttcgagctgctcggcagccatctgcgctggctggacgggcacggcgctgccgacctcgccgacgcggctgcggcggccgagatgctggcgcaggaggccaagaccttccagttccagctcgcccgcgccttccaccgccgcagcgcgcagggcctcggcgcgcgcctcgacaaggcggcggcgcagtacgacgcggtgttcgaagcgctcgaccgggcgctcgtctga

SEQ ID NO: 7777 - DNA, 1815 bp, Methylobacterium sp.
atgctgaccgatcgctcggatccggccgcggagacgatggtcccggcgcagcccgtccgcctgggcgacctgttcggctggttcagcaccggcgcgagccggcggggcgtgctcctgtgcggcaccttcgggatcgagcagctcaacgcctaccgatcctggggacgcctcgccgcgcggatcgcgggcgccggctgcccgaccctgcgcttcgactacccgggcgagggtgattccggcgagagcaccgggtccgaccgcgtgacggaggcgctcgccgccatcgaccggggtatccgcttcctgcgcgaggaggcgggggcgcaggagatcgtgctcgtgggcctgcgcctcggagcgaccctggccgcccgcgcggccgaggccggcggcgtcgaccggctggtcctgctcgcccccttcgcgagcggccaggcctacctgcgggagatgacgctgcaggcgcgcctgatcgaccggctgcccgacggcacgccgctgccgcaggagcccggcgcgctctcggtcggcgggttccggctcgatcccgggaccgtcgccgcgctgggcacgctcgacctcgccgggaccgtgcgcgcgccggcacccgagatcctgatgctggggccgaagaccgcggcgctggccgatcgctaccgcagcctcggcgccgccgtgaccgccggcgccttccccgaactggcaccgctcgtctcggacccgctcttcgcgccctatccggaacggaccttcgaggcggcggccggcttcgccaccgcttgtgccgtgcccggtcccgcaccggaccggcgtccggtgccggccggggcgctcggtggtgcgggctggtgcgagaccgtgtcggaattcggctccggcctcgtcggcgtgctgtgccggccggagacccagcagccgggcgccccgaccgtgatcgtggtcaattccgggctgaacgcgcgctcgggctacggccggcagacgaccgcgctcgcccggaggctcgcggcgaacggcatcgcctcgctgcgcttcgatccgagggggatcggcgacagcgccgaccgcgacgacgaccgctcgcccttctacgcccccgatgccgtgacggacgtgcgcgcggcgctcgatcatctcgccgccgtgcagggcgggcccgtggtgatcctgggaacctgcagcggggcctacctggccttcaacgcgctctgcgcggacgagcgcctgcgcgcggcggtgctggtgaacctgtactgcttcgacctgaagcccggcaccgacatcgagacgatggtgcgcgacacgttccgtcacggccagggctacctcgcacgggcgcggcaacgcggctcctggcggcggatcctcagcggcgagatccgcctgggccaggtggcgggcgcgctccggcgcgacgggtcggccctcatcggccgctggacggcgcgcctgtcccggctgctcccgggcggcgagagcaccggacgccgggtggcgcggctgcgacggcgcggggcgcggatcgccatggtgtacagcgccgacgatccggggctggcgacgctgcgggcccatctcggcggcgcgtccgcgcgcgtcgggcgccggctcggctaccccgtggcgatcctcgacgggacggaccacaacctgagccgccccgccgaccacgagcgcatcttcgcgaccgtgcagcgcgtggcgcacgatgccgcacaagcggatcgggccgcagccgccacggcccgccagcgcacgcccctcgcgcgcgaacccaacgggttgcacctccggccgtccgagaccctgccctga

SEQ ID NO: 7778 - DNA, 1287 bp, Methylobacterium sp.
atgctgcgccaggcgatgatcctctgcggcggtctcggcacccgcctcggagccctgacggccgagaccccgaagccgctcctcccggtggcgggccggcccttcctcgacacgctgctgttcgagctcggccgccacggcttcgaggaggtggtgctgctcgcagccttccgcagcgagaagatcgaggcctatatccgcgccaacccggtcgccgagcgcttcgggatgcgcctgcgggtctgcatcgagcccgatcaggccggcaccggcggggcgctggcgcacgccgcccatctcgccgacgatgaattcctgctgctcaacggcgattcctggttcgactgcaacctgctggcgctcaccccgctcctcgcccgcgagcccggggccgcgatcgcgctgatgctgcgccccgtgccggacgccgcgcgctacggcgtcgccctgatccggggcgagtgcgtgacggccttcctggagcggccgccggcccccgggcccggcctgatcaacgcgggcgtctacctcgtccgccgcgcgctcctcgccgagatcgacggcccctgctcgctggagcgggacgtgctgccccggctcgccgccgcgggccgggtcgccggcctcgtccgctccggctacttcctcgatatcggcgtgcccgagagcttcgcgcgggcgcagacggagatcccgcgccagcgcgtgcggccggccgtgttcctcgaccgggacggcgtgctcaaccacgacgaccattatgtcggctcgcgcgagcgcttccgctgggtcccgggcgcggccgaggcggtcgccgccctcaacgaggccggcgccttcgtcttcgtggtcaccaaccaggcggggatcgcccgcgggctctacgcggaggcggatgtcgcggcgctccacgccgcgatccgcgcggagctgcgcgcggccggcgcccatctcgacgacgtgcgctactgccccttccacccggaggggaccgtcccggcctacgcgcgcgcccatccctggcgcaagcccgagcccggcatgctgctcgacctgatggcgcactggccggtggaccgcgccgcgagccgcctcgtcggcgaccgggagagcgactgcgccgccgcccgcgcggcgggcgtgcgcccgcacctgttcccgggcggggacctccacgccttcctggcggaggcgggcatcctgccgcgccccgcggcggatcccgccgaacgatccaccgatgacgcaccgtccggcgccgcgccgcgacgattcgaagaggcgtga

SEQ ID NO: 7779 - DNA, 1194 bp, Methylobacterium sp.
atgcctgggccgctcagcggtatccgcgtgctggaactcggccagctcatcgccgcgcccttcgccgcccgcctgatggccgagttcggcgccgaggtgatcaaggtcgagccgccgggcgagggcgatcccttgcgcaagtggcgcaagatgcacgagggcacctcgctctggtggtacctgcagtcgcgcaacaagaagtcgatcgcggtcaacctgaaatcgccggagggcctcgacgtcgtcaggcagctcgcgaagagcgccgacgtcgtgatcgagaacttccgtcccggcggcctggagaagctcggcctcggctgggacgtgctctccgcactgaacccgaacctcgtgatggtccgcatctccggctacggccagaccgggccctaccgcgaccggccgggcttcggcgccatcggcgaggcgatgggcggcatccgctacaccaccggcagccccgaggcgcccccggcccgcgtcggcgtcagcatcggcgacacgctggcctcgctccacggcgtgatgggtgccctgatggcgctgctccgggtgaagatgggccagggtgcaggccaggtcatcgacgtctcgctcgtcgagagcgtgttcaacgtgatggagagcctcgttcccgaatacgacctcctgggcgaggtccggacgcggacgggcggcgcgctgcccggcatcacgccctccaacacctacccgacgcgggacggcggctacgtcgtcatcgcgggcaacagcgacccgatcttccgccgcctgatgacgatgatcggccgggcggacctcgccgaggatccggcttttcgcagcaacgacggccgctcgcgccaggccgcgatgctcgacggcgtgatcggcgactggtcggccgcgcgcaccgtcgaggaggcgctggaggccctcgacgccgccgacgtgccggcgggccggatctactcggtggccgacatcgtcgccgacccgcactaccaggcccgcgggatgatcctctccgccggcctgccgggcggccaagaggtgaagatgcccggcatcgtgccgaagctctccgagacccccggggaggtgcgctggcaggggccggccttgggcgagcacaccgattccgtgctcgccgatctcggcctcgacgccgagggcatcgcccgcctgcgcgacaggggagcggtggcatga

SEQ ID NO: 7780 - DNA, 1659 bp, Methylobacterium sp.
atgccgaagggatccgacctgctcgtgcaagcgcttgagaacgagggcgtcgaccgcgtcttcggcatcccgggcgaggagaacctcgacatcgtcgagagcttgcgcacgtccaagatcgagctcgtcctgactcgccacgagcaggccgcagccttcatggccgccacctacgggcggctcaccggcaagcccggcgtgtgcctcgccaccctcggcccgggcgcgctgaacttctcgacaggcgccgcctacgcgcatctgggcgccatgccgatgatcatcatcaccggccagaagggcatcctgtcctcgcgccaggcccgcttccagatcgtcgacgtgatcgcctcgatgaagccgatcaccaagatggcccgccagatcgtctccgcctcctccatccccaccatcgtgcgcgacgccttccgggtcgccatggaggagcgccccggcccggtgctgctggagctgccggaggacatcgccgcggaggaggccgaggcctacacggtcccgtcccacccgatcgacatcccggtcgcccaccccaaggcgatcgagcgcgccgtcgagatgatcctggccgccaagcgcccgctggtgatgctgggcgccgccgcctcccgcccgcgctccacgagcgacctcggcggcttcgtgcagcgtaccggcatcccgttcttcaccacccagatgggcaagggcacggtggcgcacggcacccgcctctacatgggcacggccgccctgtcggagcgggactacgtgcacgaggcgatcgacgaggccgacctgatcatcgccatcggccacgacacggtcgagaagccgcccttcttcatgggccaggcgaaccagaaggtgctgcacatcagctacaccccggccaatgtcgagcaggtctactaccccgacgccgaggtggtgggcgatctcgggccgaccctgaagctgctggccgaccgtctggaggacaggctgccgaacgcgggcgcgctgctgccgctgcgcgagcacatcctctcccgcatctcggaccgggccgacgaggaccgcttcccggtcaccccgcagcggctggtgcgcgacgtgcgccgggtcatccccgaggacggcatcgtctgcctcgacaacgggatgtacaagatctggttcgcgcggaactaccgcacctacgtcgccaacacgctgctgctcgacaacgcgctggccacgatgggcgcgggcctgccctccgccatgatggcggcgctgctctacccgaaccgccgcgtcatggcggtgtgcggcgacggcggcttcatgatgaacagccaggagatggagacggccgtccggctcggcctcaatctggtggtgctgatcctcgacgactcggcctacggcatgatccgctggaagcaggcggtggacgagttcccggactacggcatgaccttcaagaaccccgatttcgtgaagtacgccgagtcctacggcgccaccggccaccgggtcggcgccgtcgaggatctggggccgacgctggagcgggcgttccaggcgggcggcgtgcacctcgtggccgtgccgatcgactactcggagaacacccgcgtgctcgtgaaggagctgcgcgagaaggtgaagccgtcgcagcctgacgcgaccgcctga

SEQ ID NO: 7781 - DNA, 405 bp, Methylobacterium sp.
gtgacgcgctatctcctcgacaccaacatcctctcggcgctggtgcgatcgccgcgggggctcgttgcggagcagcttcggcgtgtctgggagagcggcgtttacacgagcgtcatcgtcgcggcggaactcaggttcggtgcggcgcgaaaagtgtcggatcggctaacgcggcaggtcgaggctgtgctgggggcgctcccggttgcagcgtggcaggcgccgaacgaccggatctatgcggacttgcgtctcgggcttgagcaggccgggacgccgatcggtgccaacgacctgctcattgcgactcaggcgctcgccgacgggagcgtcctggtgacggacaacacgagggaattcgcgcgcatcggcgggctgacgatcgagaactggctccggccctga

SEQ ID NO: 7782 - DNA, 285 bp, Methylobacterium sp.
atgaaacgggacagcaagccggccggtgggccggacgacgcggagctggtccacatccagctcaattccctggaccgggagttcgacagcgatctgggctgcccgatctacgagacggtgttctcctgctcgggcccggaggggcacgcggaggccttcatcaccgtggtggccgcggaggtaaccacgctggatatcgtgccgcaggcgatgagcgacctgcaccggctgttcgcggtactggccgagcagacccgggcatggcggatcgatccgaaggtgtga

SEQ ID NO: 7783 - DNA, 360 bp, Methylobacterium sp.
atggttggcaggtcgcattcgatcccgacttccggggccgagttcgaagacctcgcggagacggtccgggacgagttgctggcgatggccgaacttctgcgggcgatcgggccgcaactgcggcggccgcgctccgacacgctgaacggctcgcggcatgccaacatgaaggaacttcgcttcgatgccgatgacggcgtctggcgggtcgcctacgccttcgaccccgagcgccgcgccatcctgctggtagccggcgataagtccggcgtcgcgagcaaacgcttctacaagacgttgatcgagaaggcggatgcccggttcgaccggcatctcgtccgtatccggagcgaccgatga

SEQ ID NO: 7784 - DNA, 348 bp, Methylobacterium sp.
atgggccggcggacgaagaagcggaaccggacgaaccggacgaagaagcggctcggccgcctgccgccgaccccggaattccggactttcggcatgcggttccatcaggacatcgaccgcttgcacgataccctggaggatgccgcgcacgctgccatgcggaacttcaagggtgaggaacgcagacgcctgcgcgatttcatcgggcagatccttgagagcgacctgtcgcccgacgagttgagcaagctctgggatctgaccggatccgacgtgagattcctcgacgcgaaagggtttcgcgacctcctggccttcgtgcacgatcagcttcgcaagggactgtaa

SEQ ID NO: 7785 - DNA, 918 bp, Methylobacterium sp.
atggacaccatgcgccgcaacctgctgttctcgggcttcggggccctcaccctgctgtcgggcacggtcatcgcccgtgccttgttccccggcggcccgagcgtcgagctcggcggccgcacgatccgccgctggggctgccagtatcagaacatccggcccgactccgttgccgccagcaacctcgatctcgtcgttctcgacccgatcgtcgaagggcagccgctgcggatcgaggcggaggcgccgctccggcgcaagcccgacggcgcgcggcggctcgtcctggcctatctgtgcgtgggcgaggccgagagctaccgtgcgtactggcagaccgcgtggcgcgaggcgccgcccgcctggctcggtccggagaatccccgctggccgggcagcttcgcggtcaagtactggcatccggactgggagacgctcctgctcggccccggcggcgccctcgaccgcatcgtcgaggccggcttcgacggcgtcttcctcgaccgggtcgacgcctacggcgactggccattgcgggggcagggtgcgcagcgcgacatggtcgccctcgtcggccgcctcgcggccgctgcccgcgaccgaaagccgggcttcctcgtggtctcccagaacgccgagcacctccttgccgacgacggcttctgcgcggtcatcgacgccgtcagcaaggagagcttgctctacgggctgcacggcccgaacgtcgccaaccggcccgacgagaccgcctggagcctgaactacctccagaaggcgcaggcgcgcggcctgccgatcctcgtgatcgagtacgtgagcgagccggaccggattgcccaggcgcgcgaccacctcgcgcgcctggggttcgtaccgttcttcggcaggagattgctggacgagcttccgggatcctga

SEQ ID NO: 7786 - DNA, 921 bp, Methylobacterium sp.
gtgctctcgccccgccacttcctgcgccagctcgacctcggaaccctcgaactgttcgtgctgatctgcgagaccggcagcatcgcgcgcgcggccgagcgcgggcagatcgcgccctcggccctgagccggcgcgtcgccgagctggaggcggcggtcggcggcagcctgctggaccggcacgcccgcggggtgcgcccgaacttcctcggcgagcagctgcgccaccacgccctcaacatcctggtcgaggtcgagcagctgcgcagcgagctcggcgagttcgccaacggcgtgcgcggccgggtgcgcctcagcgccagcgcctcggcggtcgagcagttcctgcccgccgacatggcggcgttcacccgcgcacacccggagatccgcatcgacctgcgccagcgcggcagccagggcgtcgcctccgacgtcgccagccgcgcggccgatctcggcatctgcagcgcctgcgagccggtcggtgcgctccaggcgctgccctaccggaccgagcgtctggtgctggtgatgcacccggaccatccgctggcggaccgggacagtctgccttacgcggacgccctcgatcacgagcagatcggcatgcgcggcagcagcacggtgcaggtgcatctcgcccgcgccgcccgggaggcgcggcgcggcctgcgccagcgggtcgaggtcgacagcctctcggcgatgtgccggatgatcgagtgccgcatggggatcggcgtgatggcgctgggcgccttccaggcgctgggcgagcgccgcctgcacggcgcggtcctgacggatccgtgggccgtgcggaccctcaacatctacgcgatcgacttcgcgcgcctgtcccagccggcgggccgcctcgtgagtctcctgctgtcctcgcaggccccgctcgcgtga

SEQ ID NO: 7787 - DNA, 297 bp, Methylobacterium sp.
ttgagttcggacgcacacgtcatcaaccgggctgccagcgtcggcgcgagcgaccgcttcgtgcgctggctcggctggatcgcgaccgtcaccggcgtcctgatgttcgtctcctatctcgaccagatccagctgaacctcgccggacagaagggctcggtcattcagccgctcgccacggtggtgaattgcgggctgtggacgacctacggcgccctgcgccgggactggccggtctccttcgccaacgcccccggaatcgtcctcggagccgtcgccctgatcaccgcgctctga

SEQ ID NO: 7788 - DNA, 762 bp, Methylobacterium sp.
atggaacggtcaggggacggtcaggcagggtcggggcgcggcgccgccggcggcgcggtcggcttccggccgctctaccggcaggtctacgacacgctgctgaagcgcctcgccgacgcggtctggcagccgggccagatcctgccgagcgaggggcagctcgccgccgagctcggggtcagccagggcacggtgcgcaaggcgctcgacgcgctgaccgccgacagcctgctggtgcgccgccagggccgcggcaccttcgtggccgaccacgacgacaagcagagcgtcttccgcttcttcaagctccggcccgacggcgagggcaccgggatgccgacgagccgggtcacggcgatcgcggaggcggcggccagcgccgacgagcgcgggcgcctcgacctcgcgcgcgccgcccgggtcgtgcgcatcgagcgcgtgcgcctcatcgatgggcggctctgcgtgtgcgagacgatcagcgtgccggccgccctgttcccgggcatcgccgagcttgccctgcccaacacgctctacagcctctacgcgacccgcttcggcatcacgatcgcgaccgcgaacgagcgcctgaaggcggtggccctcggcccccgcgaggccggcctgctggaggtggccgcgggcacgcccgcgctggagatcgaccgcgtcgccgtcgacctggaggagcgcccggtcgagtggcgcctctcgacctgcctgacgcaggacgtccactacctctcggtcctgcgctga

SEQ ID NO: 7789 - DNA, 354 bp, Methylobacterium sp.
atgcagacatcatcgtccgaggttccggccgggccgaccgaccgcttcgaggaccggctcgcgcgcagcggcggcccgaacgcccggcggcggcgcggcgcgctgcggccaggcgaggccggacggcgcgggctcggctggaaggcctggctcgcgatcgacgcggtcggtctcgccctgttcctcgcggtgatcgtggcctggccgccgctcagcgcctgccgcgagaaggcgcgcgcatacggcctctacgcgggcgacacgatcgagaaatgcacccgccgtggcctcgccgagcgcttcgagcgggcggaccagcgcgtcaagatgctgatccgcggctcgggcggctga

SEQ ID NO: 7790 - DNA, 3057 bp, Methylobacterium sp.
atgatcccggtcctgaaccgccccgccgacgccctgccgctctacgccgccttctgcgcggagctctcggctcgcggcttcgcgggcgacctgaccctctccgaggccgaccgcacggtcttcgccaccgacaactcgatctaccaggtcgagcccggcgcggtggccttcccgcgcgaccgcgacgacctcgtgcgcatcggcacgcttctggacgacccgcgcttccgcgaggtggtgatgcgcccccgcggtggcggcaccggcaccaacggccagtcgctcggccccggcctcgtggtcgattgctcgcgccacatgacccgcatcctggcgatcgaccccgagcggcgcaccgtgcgcgtcgagcccggcgtggtgaaggaccagctcaacgcggcgctcaaggcccacggcctgttcttcgcccccgagctctcgacctcgaaccgggcgacgatcggcggcatgatctcgacggacgcctgcggccagggctcctgcctctacggcaagacccgcgaccacgtcctcgcgctgacctgcgtgctcgccgacggcacggtgctggaggcgcgcgaccgcgacgcggcggacctcgccgccgtgaaggcccgcgacgaccgggccggagcgatccaccgggcggtcgatgcggtcgtcagcgagaacgccgcgctcatcgccgcgcgctttccgaagctcaaccgctgcctcaccggctacgacctcgcccatgtgcgcggcgcccgcggcgggctcgacctgaagagcctggtctgcggctcggaagggacgctcgcgctgatcgccgaggccacgctcaacgtcctgccgatcccgcgggccgcggcgctggtcgcgctctcctacgtcgatttcgacgcggcgctgcgcgacgcccgcgccctgctgcccttcggcgcggcctccgtcgagaccatcgactcgacggtgctggggctcgcccgcaacgatcccggctgggccggggtgcaggccttcttccccgaggatccggccgggcgccgggtcgacggcatcaacctcgtggagttcgtcggcgcggaggagagcgacgtcgaggcggcgctcggccgcctcgtcgccatgctggaggacgacccgagcccgactcgcatcggcttcacgatcgcccggggggcggcgatcgagcggctctggaccatgcgcaagaaggcggtcggcctcctcggcgcggtcaagggcgacgcgcgcccgatccccttcgtggaggacaccgcggtcccgcccgagcggctcgccgactacatcgccgagttccgcgcgctcctcgacggcaagggcctgcgctacggcatgttcggccacgtcgatgcgggcgtgctgcacgtgcgccccgcgatcgacctgaaggacgaaggacaggaacggctgatccgcgaggtcaccgagggcgtggtcgcgctcaccgcccgctacggcggcctgctctggggcgagcacggcaagggcttccgctccgagttcgtgcccggcgtgttcgggccgctggtgccggcgctggaggcggtcaagcgcgccttcgacccgggcgaccggctcaatcccggcaagatcgcctcggcgcagggcgccgcgctcaccgcgatcgacgccgtgccgctgcggggcgagcgcgaccgcaccatcccgcgcgacgtgcgcgccgccttcgacgaggcgcttcactgcaacggcaacggggcctgcttcagctacgacgcggacgaggcgatgtgcccgtcctggaaggcgacccgcgagcgccgccactcgccgaagggccgcgcctcgttgatgcgcgagtggctgcgccggacggctgccgcgggcatcgacccggccgcttccctgcgcgaggagcggcccggctggctcggcccgctcgccgcatcgctgcgcgccgcgctccggcccgcgccgcggagcgaggatttctcgcacgccgtgaaggaggcgatggacggctgcctcgcctgcaagtcctgcaccggctcctgcccgatcaaggtcgacgtgccgagcttccgggcgaagtttttggcactttaccaccagcgttacccgaggccgctgaaggaccatgtcgtggccgcgctggagccgctgctgccgctggccgggcgggcgccgcgcttgagcaacctgctctcccgcaacccgcttggccaagcggtgctgcgccggctcgggctcgtggcgatcccggccttctcggccccgctcgccccggcgctcgccgggctcggcgtgcggaccgccacgcccgcggcgctccgcgccctgtccgaggccgagcgggcgtgcgcggtcgtggtggtgcaggacgccttcaccagccatttcgaggcgccggtcgtggccgatctctgcgtgctgctgatcgagctcggcttccggccctggctcgccccgttccggccgaacggcaagccggcccacgtgcacggcttcctggcccgctttcgcaagacggccgaggccaacgcccggatgctgcgggccctggaggcgaccggcgtgccgctcgtcggcgtcgacccctcgatgacgctgacctaccgctcggaatatgtcggggcgctcgggacggggaacgtcccgcgggtccagctcgtgcaggaatggctcgccgcgcggctcgacgcgatcgccgcgcgcccggccggccggtccttgcggctcctgccccactgcaccgaacgcaccaacgcgccggccgccgtgaaggactggcaggccctgttcgcgcatctgggcctccccctggagatcccggccgcgggctgctgcggcatggccggcacctacgggcacgaggccgcaaaccgggccacctcggaggtcatctatggccagagctgggcccggcgcgtcgccgagagcccggagggcacactgctggccgacggctattcctgccgctgccaggccaagctcatcgacggccgcgccctgccgcacccggtccaggcgctgctcgcccatgtgcgggcgcacgcgcccgtcgatgccccgaagctcgccgcctga

SEQ ID NO: 7791 - DNA, 963 bp, Methylobacterium sp.
atgcggggcgcggtccgacttctcctgacgctgctcctgctcaccgctcccgccctggccggggaactccgcgtcaccctcggcaccgcgacgcccggcgggggctttcccgcctacgccgaggcgctgatctcggcgctgcgggaggccgatcccggtctcgtcattgagccccgctcgaccggtggctcggtggagaacctcgatctccttcgcggcggggtcctcgacctcgcgctggtgcagggcgagcacgcctacccggcgctcgcggacgacgcgccgccgcggctcaccgtcgtcgcaccgatctacccgacgcccggcctgttcgtgctgccggcccgcagcccggtgcagcaggtgagggacctccgcggccgtcccgtcgcgctgggcacgcgagattcggggctgaccgccatgggccgggccgtgctcgcggcctccggcctcgaccccgagcgggacatcgtgccggtcgtcctcgcgcgggcaggcgacgggccggaccgcgtgcgcgccggcacggtcgcggccctgtggggcgggggcctgcgctggccgggcttcaccgcgctcgccggggatccgggcggtgcccgttttctcgcccccgcgcccgaggcggtcgcgcggctggtggccgagcgcccgtccctgcgccggatgcgcgtgccggccgggacctttcggggtcaggacgagccgatcgacacggtgggctcgtggagcctcatcctcgcccggcccggcctaccgcctgggacggccgagcgcctcgtccgggcgatggacgcggcgcgcgacgccctcgcgcgaaccaccggccagggcacgggcagcgacccgcgcaacctcgcggaggcggtgccggcggcttggctcaatcccgggacgacgcgggcactcgccgatctggcgggcggcccgcagcctcctccgtcggaacccgcccgctaa

SEQ ID NO: 7792 - DNA, 423 bp, Methylobacterium sp.
gtgagcgccgccctcgctctctccgggccgcagcagctcgtggcgtcctggcgcgcgggcgtgctcagcctgccggacgaccggctcccgtgcccgggcctgatctggctcgagcccggcccgcgcgggcgctccggcgtctgggcaggcgtgcggaccatgatgctccgcttcgtcgagcactggggcgaggaagccgccgcgctcggctggtccacggaatcgctcttcggcgtccaccgcctcgctggcgccatgcgcgccgacagcacgggcgcgctcgtcaccctctacccgcggaaggtcgtcgccctcgacgagcgcacggtcaccaccgagcgcaacggcgtgcgccaggtcttccgcggcatgccgaaccccgccgagagcatcccgctctggcggttcaacctctctgcctga

SEQ ID NO: 7793 - DNA, 897 bp, Methylobacterium sp.
atgctggccgacctcgcgtcggagggggagagcggcgcgcagccgcggcccggccggacgctcggctacgcgcaggggcgcttccacgatctcgcctacgtggaatggggcgatcccgcgagcccgcacacggtgctgtgcctgcacgggctgagccgccagggccgcgacttcgacccgctggcccgggcgctggtcggcctcggctaccgggtgatctgcccggacatcgtcgggcgcggccgcagcggctggctcgcggatcccgaactctacggcctgccgcaatacgtccgcgacatggccgcgctgatcgcccatctcggcgtcgaccggctcgactgggtcggcacctcgctcggcggcctcgtgggcatgatgctggcgggcgcgcagaacacgccgatccgccggctcgtgatgaacgatatcggcccgttcctgccctgggcggctctgcgcggcatcggcaaccgcctgcgcgaggcgccgcgcgtgcaccactccctcgccacggcggaagcgcggctgcgcacggcgctcagggatttcggcacgctcaccgacgcgcagtggcgcgcgatgacccgccacagcttctaccctgagcccggcggcacctggcggccgcactacgacccggccatagccgtcgcgttccggccgggccgggtctacaacgtcacgctctggcgcgactgggacgcggtgcactgccccgtgctgctcctgcggggcgagacctccgacctgctgctgccgcagaccgccgccgagatgacccggcgggggccctgcgcgacgctcgtcgagatcccgggctgcggccacgccccggcgctcttcgacgacgaccagatccggatcgtcaccgactggatggggcgggccggctga

SEQ ID NO: 7794 - DNA, 843 bp, Methylobacterium sp.
atgcggtctggccgatcgaggcgcggcggcgggcggcgggggcgggctcccgcggcggcgtccctcgccctcctgtgcgcgctcgccggcctcatgccgggtcccgcggccgcgcgcctgacgcaggcggagctggcccgggtcgccgtcgcgccgccgcccggcgcgcgcgcgcccctcgccctcgccttcacggacgcggccggggaccggcccgtgaccctcggggaggccgcgggcgggcgcccggtcctgctgctgccggtggactatacctgcggcaacgtctgcgacccgatgctctccctctcggcggccgccctcgcggcgaccgggctcgcgggcgagcgggattacggcttcgtcctcgtcggcctcgacccgcgcgacgatgccgcggcggcgcgccgcatgctgtccgagaccctcggctccgccccctcccccacccgtccgcgcgcgctggtcggctcggccgacgctgtcgcggcgctgacccgggcgctcggctacggcttcgtgcccgatccgggcacggacagcatcgcgcatccggccgccgcgatcctgctgacgcccgaaggccgggtggcccgcgtcctctcgccgctggcgctcaacgggcgcgacctgcgcctcgccctggtcgaggccggcgagggccggaccggcaccttgagcgaccggctcgccctgctctgctacggcttcgatgcggtgaccggggtctacaccccgctggtgcgccggatcctcgccgtcgcgggcggggcgaccgtcctggggatcgcgctcctcgtcctactcctcgcccgtgcggggcgggctcggaccgccccctga

SEQ ID NO: 7795 - DNA, 144 bp, Methylobacterium sp.
atgcggaccaaggttgtgctggcgctgacgctgttcgtccttctgacgaccggcaagacgccgggtttccgcgagttgcggaaccccgatgccgagcaccacgggggccgcgcggcggtcgcgctcaagcgggaccgcctgtga

SEQ ID NO: 7796 - DNA, 1785 bp, Methylobacterium sp.
atggcgacgactgggatccgggccgaggcgtcccagctggcacgcatcgacgtccagctgctgctctggctcgtcgtcgggttctcggtgctcaccctcaatgggtcgaccgatctctgggacacgatcacccgcctgcgggtggccgaccccgacgacgcgatgcgcctcgtgggcgtgcgcgacctgctcgccggacagggctggtacgacaacacccagtaccgtttcctgccccccggcggcgtgccgagccactggtcgcgcctcgtcgacgcgcccatcgccgggctgatcctgctgctcactcccctggccggccgggcgctggccgaggggctgacggcggtgctctggccgctgctgctgttcggcctgttctgcctgatggtccatcggggcgtgcgccggagcttcggcccgcgcgcggccgttctggcggtgttcgcggcgacgcagaccttcggcatcctcgtccagttccacgcgggccgggtcgatcatcacaacctccagatcctggcgaccttcggcctcgccctctgcatcgtccgcggcggcctgcggcccggcctcgtcggcggcgggctcgccgcgctctccctggcgatcggcctggaggcgctgccctacatcgcgctcggcggcctcttcctcgcgggcgactgggtgctgcgcggccgcgcggccctgccggccttcctgggcttcggcctcggcctgtcggcggccttcccgctcttcgcggcccagaccgcgcccggcctgtgggggacgtcctactgcgatgccctctcgccgccctggctctggctcgccgccggcggctgcgccaccgcgctggtctgcgcgggcctcgaccggcgcctggccacggcgggcgcccgcctcggtctcgccttcctgtgcggcggcctcctgctcgccgggttcgccgccctgttccccgcctgcctcggcggtccctttccggggatgacgccgctggtgcgcgagcactggctccacaccgtcaacgagatgtcctcggtgccgaagttcctggcctggcggcaatgggagatcctggccttctaccccatcctcgtcgtggcggcggccgcggccacgggcctcgccctgcgcgggcccgagcggcgcctcttcggggtcgccgccctgttcctctggcccggggttgtgctcggcttcttccagctgcgcgggatctacgtcgcggtggccttcgtgcccctggtggcgggcccgctgatcgaccgcgcgctcgcggccgcgccgtccttgcggggcgcgcgcctctggggggccttcgcgctcagcgccggcctgatcggctcgtgctggaccgcgctcgccctgctggcgggggcgctcacgccggcggccggcaacggccgcgacccgacgggcgcagtcaactgccatgcggacgccgccgtggcaccgctcgccgtcctgccgccgggtacggtgctggcctccatcttcctcggcccttcgatcctgctgcggacgccccattccgtggtgggcgcgccctatcaccgcgccattccgggcctgaccgccgtcatcgaggggctcggcgggaccgaggccgacctcctgcggcacgtgcgggcgcacgacgtccgctatctggcgacctgcccgacgcggccgggcgacgacctgcaggccgagcctgccttcgcgacgcgcctcacccgcggcgaggtcgcggtgccgtggctggagccggtggagcttccgggcagcgccctgcgggtctggcgggtgcgctga

SEQ ID NO: 7797 - DNA, 1527 bp, Methylobacterium sp.
atgagccatcacaccgagacgctggtcatcggcgcaggccccgcggggctgaccgccgcctacctgctgtcgaagcacggccgctccgtcacggtgctggagcgcgatcccgcccaggtcggcggcatctcccgcacggtctcccacaacggctacctgttcgacatcggcgggcaccgcttcttctcgaagtcgaaggccgtggtcgatctctgggacgagatcctgcccgacgacttcatcgagcgcccgcgcctgtcgcggatctactaccagggcaggtactacgcctacccgctcaaggccttcgaggcgctgcgcaacctcggcctcctcaccagcacggcctgcgtgctctcctacctgtacgcccgcgcgcggccgatcgagacgccgcggagcttccacgactgggtccgcaaccagttcggcgagcgcctgttctcgatcttcttcaagacctacaccgagaaggtctggggcatgtcctgcgacgcgatctcggccgactgggcggcccagcgcatcaaggggctcgacctcggcgccgcgatccgcgacgcgctcatgcgctcgctcgggctgcggggaaggcccaaggggggcggcaaggcagggggcaagaccggcgagccggtgatcaagaccctgatcgagtccttccgctatccccgccgcggtcccggcatgatgtgggaggcggcggccgcgaagatccaggcgcagggcggccgggtgctgctcgaccgcggcgtcgacgggctgagctacgatcccgccaccggcatctggacggtgagcgtgctcctgggcgacggcagccgcgagacctacacggcccgcaacctcgtctcctcggcccccgtgcgcgaactcgtcgacgcgatccgcccgcggcccttgagcaccttccacgcccgcgcgctgcagtaccgcgacttcctcacggtcgcgctcatcgcgaagtccgacaggaccttccccgacaactggatctacatccacgacccctccgtgaaggtcggccgggtgcagaacttcctgtcgtggtcgcccgagatggtgccggaggaagggcacacctgcctggggctcgaatatttctgcttcgagggcgacgggctctggaacagctcggacgccgacctcgtcgcgctcgccaaggccgagatcggcaagatcgggctgatcgacccggccgatgtggtcgatgcctgcgtggtgcgacagcccaaggcctacccggtctacgacgagacctacgccgcgaacgtcgccatggtccggatggagctggagcgggacttcccgagcctgcacctcgtcggccgcaacggcatgcacaagtacaacaaccaggaccacgccatgatgacggcgatgctgaccgtcgagaacatcctggccggccagcgccgccacgacgtctggcgggtcaacgaggacgccgagtacagcgaggccggagtctcgggtgccgaggcggccctggggagcgagcggctggtgccgcgcaaggtggcctga

SEQ ID NO: 7798 - DNA, 957 bp, Methylobacterium sp.
atgaagacctgcctgatcctcgacgactaccaggacgcggcccggcacttcgccgactgggaccggctccgcaaccgggtcgccgtgaccgttctgcgtgagacgatcaccgatccggacgcgctcgtggcccggatcggcgcggcggagatcctcgtggtcatgcgcgagcgcacgcccttcccggccgccctgctggcgcggctgccgcggctcgagctcctcgtcaccagcgggatgcgcaacgccgcgatcgacctcgccgcggcgagacggcagggcgtcacggtctgcggcacggcgagccatccggcgcccccggccgagctgacctgggcgctgattctcgccctcgcccgccggatcgccccggagagcgcggccttgcgggccggcgggccctggcaatccagcgtcggcacggatctggcgggcgcccggctcggcatcgtgggcctgggcaagatcggcacccggatcgcgcgggtggcccgggccttcgacatggaggtcgcggcctggagcccgaacctcacggaggcgcgggcggaggcggcgggggtgcggcgggccgcctccaaggaagccctgctggcggagagcgacgtcgtcacgctccacctcgtcctgtcggaggcgacgcgcggcatcatcggggcggaggatctcgcccggatgaagcccagcgcgttcctggtgaacaccgcccgtgccggcctcgtcgatcaggcggccctcgtccggacgctcgcggagaaccgcatcgcgggcgcggggctcgacgtgttcgagaccgagccgctgcccatcgagagcccgttccgcgctctgccgaacgtgctggcgctgccccatctcggctacgtgagcgagggcaactaccggacctacttctcggaggcggtcgaggacatcgaggcttggctcggcggcgcgccggtgcgtgtgctcggctga

SEQ ID NO: 7799 - DNA, 522 bp, Methylobacterium sp.
atgatcgagctccgcccgctgcgcccggccggatcgcggtcgggcgcagcggcgggcgatgaggacgggcgccgacgagaccgcttctgggccgcccacggatcgtgcgggccggaccgcgcctgccccgatcgcggccggtccgttccggccgcccacaacaggagcatcgcgatgatcatctggtccggctggggcgtgctcagcgccctcatcaccgtcctggccttcgtcgggggcgtggtcctcgaccttcagcttccgaagctcggcatcccggcgccgaccgggttggtcctggcctggatcgccgcggccgccctgaactgggtggtcggccggcgcctcaacgggcggccgggccgggagatgatcgacgcgcgcaccgggcagcgcgtgctgctggtccagaatcacaccctgttctggatcccgatgcagtactactcggtcctgatgctgctgctcggcgccctggtggtggtgtccagcctgagccgggtgccgcggcccccggtctga

SEQ ID NO: 7800 - DNA, 1185 bp, Methylobacterium sp.
gtgagcgagcccgccgagcccgcgggccccgggcgccgggcctccttcccgctcctcgtcgccgtgaccatgacggggacgctcgcgctgcacatcttcgtgccggcgctggcggatgccgcggccgacctcggcaccacgccggccgcggcgcagctcaccatcacgctcttcctcgtggggctggccggcgggcagctcgtctacgggcctctctcggaccgctacgggcgccgcccggtgctgatcgcggggctcggcctctatctcgccgggctgctcctcgcgattcccgccccgaacatcaccgtcctggtggtggcccgcgtgctgcaggcgctcggggcctgcagcacgctggtgatcggccgcgccatggtgcgggacgtctcaggcagcgccgacgcggcgcgccggatggcgctgctcaccatggcgatgacgctgacgcccgcgctcgccccggcgctcggcggcctcgtcgatacctggctcggctggcgcgcggtgttcggagtgctggctctgctggtcggcgtgctcggggcgctggtggtgttcaccctgccggagacgaaccggcacccggtggcgctgccggggcccagcgcgatggccgcggcctacctgcggctcctgcgcattcccgtcttccgggcctatctggtggcgggcgcctgcgcgggcaccagcctctacgccttcctggcggtcgcgcccttcctcctcgtcgaccggctcggccgctcctcgggcgaggtggggctcgattgcctgatcgtggtcttcggcatggtggcgggcgcggtggcggcgaaccggctcgccgggcgggtgccgatccggcttctggcgcgggccggcaatctcgtctgcctcgcgggcgccggcgcgctgctggcgatcgaccaggccggcctcctcggcgtggtcagcctgatcctcccgctcatcgtctacgcggtcggcgtgggtcttgtgggcccgaacgcggtggccgggctgatgaacgtcgatccgcgcgcggcgggcgccgcctccagcctctacggcttcacccagatgaccttcggggctgtcttcaccgtcgcggtcgggctctggcaccagggcagcgcgaccccggtcgccgcgacgctgctcggggccgcgaccgtcgcgggcctcgcgctacggcgcgcctga

SEQ ID NO: 7801 - DNA, 1197 bp, Methylobacterium sp.
gtgccggacgcgcgggacggcggggaggacgcgatgcggacgatcgaccacggtcagcaccaggacatccgcgatgcggtgcgcgcgctctgcgccgagttcccgcccgagtatcaccgcaaggtcgacgaggcccgcggctacccggaagccttcgtggatgcgctcaccaaggccggctggatggcggcgctgatcccggaagcctatggcggctcggggctggggctcaccgaagcctccgtgatcatggaggagatcaaccgctcgggcggcaattccggcgcctgccacgggcagatgtacaacatgaacacgctggtgcggcacggctccgaggcgcagcgccggcactacctgcccaagatcgcggccggggaactccgcctgcaatcgatgggcgtgaccgagccgacggccggcaccgacacgacgaagatcaagaccacggcggtccgccggggcgaccgctgggtgatcaacggccagaaggtctggatctcgcgcatccagcactcggacctgatgatcctcctggcccgcaccacgccgctcgatcaggtgaagaagaaatcggaagggctctcgatcttcctcgtggacctgcacgaggcgcagaagaaggggatggcggtccgcccgatcctcaacatggtcaaccacgagaccaacgagctgttcttcgacgacctcgagatcccggccgagaacctgatcggcgaggaggggcagggcttccggtacatcctcaccgggctcaacgccgagcgggcgctgatcgcggccgagtgcatcggcgacggctactggttcatcgacaaggtcacggcctacgccaaggagcgcaccgtgttcggccgcccgatcggtcagaaccagggcgtgcagttcccgatcgccgagagcttcatcgaggtcgaggcggccaacctgatgcgttacgaggcctgccggctctacgacgcgggcgagccctgcggggcgcaggccaacatggccaagtacctcgccgccaaggcgagctgggaggccgccaacgcctgcatccagttccacggcggattcggcttcgcggccgagtacgacgtggaacgcaagttccgcgagacgcggctctatcaggtcgcgccgatctccacgaacctgatcctctcctacgtggccgagcacatcctcggcctgccgcgctcgttctga

SEQ ID NO: 7802 - DNA, 1143 bp, Methylobacterium sp.
atgacgttcggcctcaccgaagaccaagtcgcgatccgcgagatggccgcgggcttcgcggccgagcacatcgccccgcacgcgctcgactgggacgagcgcaagcacttccccgtggagaccctgcgggccgcggccgccctcggcatgggggcgatcaccgtgcgcgaggatgtcggcggctccgccctctcccgggtcgattcggccgtgatcttcgaggcgctggccgagggctgcccgacggtcgcggcgttcctggcgatccacaacctcaccgccgggatcctcgaccgcttcgggtccgaggcgcagcgccgggcctggctgccgcggctcgccacgatggagacggtcgcgagctactgcctgaccgagccgggctccggctccgacgcggcggcgctgcggacgcgggccgagcgcgacggcgaccactacgtcctcaacggcgagaagcagttcatctcgggggcgggcgcgagcgacctctacctctgcatggtccgcaccggcgaatcgggcccccgcggcatctcggcggtgctggtcgagaagggcacgcccggcctctcgttcggcgccaacgagcgcaagatgggttggaacgctcagccgacccgggcggtccggttcgacaacgtccgggtgccggtggagaaccgcgtcggccaggagggcgagggcttccgcatcgccatggcgggactcgacggcgggcggctcaatatcgcggcctgctcgctcggcggggcgcaggccgcgctgaccaaggcgctcgcctatatggaggaccggcgcgcgttcgggacgaagctcgccgacttccaggccctgcagttccgcgtcgccgacatggcgaccgatctgacggtcgcccgcaccttcctgcaccacgccgccgccgccctcgatgcgggcgcacccgaggcgacgacgctctgcgccatggccaagcgccacgtcaccgatgtgggctcccgggtcgccgacgacgcactgcagctccacggcggctacggctatctcgccgagtacggcatcgagaagatcgtgcgggacctgcgcgtgcaccgcatcctcgagggcacgaacgagatcatgcggctgatcatcgcccgtgcgctggtcgggaggcgctga

SEQ ID NO: 7803 - DNA, 1473 bp, Methylobacterium sp.
atgcctgagaccgagatcctgtccctgaaggacccgagcctgctcgtcgatgcctgcctgatcggcggggaatggtcgaagagcggctcgggctcgatcgaggtgacgaaccccgcaaccggcgcccgcatcgcccgcgtgccgaatgccggcgtcgaggagacgcgccgggcgatcgcggccgcccacgcggcctacccggcttggcgcgccaggacggccgccgagcgcgccacgctcctcaagaagctcgcggcgctgatcctggagaaccacgaggatctggcccgcatcctcacggccgagcagggcaagtcgctcgccgagtcccgcgccgaggtcgcgatgtcggcaggctacgtgacgtggttcgcggaagaagcgcggcgcgtctacggcgacgtcgtcccctcgccctggccgaaccggcgcatcctcgtgaccaaggagccggtcggcgtggtcgcggcgatcacgccctggaacttcccctcctcgatgatcgcccgcaagctcgcccccgcgctcgcggccggctgcccgatcgtgatcaagcccgccacccagacccccctctcgggcctcgtctggggcctgctctgcgagcgcgccggcttcccggcgggcctcgtctcgatcctgaccgggtcggccaagcagatcggcggcgaactcaccggcaacccgctggtgaagaagatcaccttcacgggctcgaccgagatcggcaagctcctgatgagccaggcggccggcacggtgaagaaggtctcgatggaactggggggcaacgcgcccttcatcgtgttcgacgatgccgatctcgaccgggcggtcgagggcgcgatgctggccaagtaccgcaactcgggccagacctgcgtgtgcaccaaccgggtgctggtgcaggacggcatctacgacgccttcgcggagaagatggcggcggcggccaaggccctgaaggtcggcaacggcgcggaggagggcgtgatgcagggcccgctcatcgaccacgccgcggtcgagaaggtcgaggcgcatatccgcgacgccaccgccaagggcgcgcgggtgatcgcgggcggcaagcgccacgcgctcggcggctcgttcttcgagccgaccgtgctggtggacgtcgtgccgggcatggaggtggccaaggaggagaccttcgggccgctggcgccgctcttccgcttccgcgacgaggcggaggcgatcgcgatggccaacgacacggagttcgggctggcctgctacttctacacgcgcgatctcggccgggtcttccgggtctcggaggcgctggaatacggcatggtgggcgtcaacgagggcatcatcaccaccgaggtggcgcccttcggcggcgtgaaggagtcgggtgtcggccgcgagggcggctaccagggcatcgaggactacctgaacaccaagtacgtctgcgtcggcggtctcggcgcctga

SEQ ID NO: 7804 - DNA, 930 bp, Methylobacterium sp.
atgcccctcgacgcgtccgcgcgcggcgtctacccgatcgccccgaccccgttccacccggacgggcgaatcgacgtcgagtcgatcgaccgcctcaccgacttctacgtcggctgcggcgccaccggcctgacggtgctcggcgtgatgggcgaggcgcccaagctcgaccacgcggagggcatcgcggtcgccacccgcttcatccggcgcgccggcaacctgccggtgatcgtcggcgtctcggcgccgggtttcgccgcgatggcggggctcgcccgcgccagcatggaggcgggcgcggccggcgtgatgatcgcgccgcccaacagcttgcgcaccgacgaccagatcgcgacctactaccgccaggccgccgaggcggtgggcgccgacgtgcccttcgtgatccaggactacccgctcaacttctccgtggtgatgacgcccggcgtgatccgccgcatcgtccaggagaacgccaactgcgtgatgctcaagcacgaggactggccgggcctggagaagatctcgcagctgcgcgccttcgaggccgacggaacgatgcgccacatctcgatcctctgcggcaacggcggcctgttcctcgacttcgagtgcgagcgcggcgccgacggggcgatgaccggctacgccttcccggacatgctggtcgatgtggtgcgcctgtcgcaggcgggtgagcgtgacgccgcccacgacctgttcgacgcccacctgcccctgctgcgctacgagcagcagccgggcgtgggcctcgcgatccgcaagtacgtgatggcccggcgcggcctcatcgcctcggacgcgcagcgcaggcccgcgggcggcatgagcgccaccgcccgggccgaggtggagtacctgctcgcccgcctcgtccggcacgatccccgcgcggcggtctga

SEQ ID NO: 7805 - DNA, 1257 bp, Methylobacterium sp.
atgcagatccacctcgacgccatcggcgggatggccggcgacatgttcgccgccgccctgctcgacgcctttccggagcacgaggccggggtgctggcgagcatacgggccgccgcggcgggcgcggcctgcgagctcgtcgcccacaacgacggggtgctgcaggggcgccgtttcgtggtcgcggagcgcggcgcagcgggcgcgcacgatcatcatcacacgcacgaccatcaccatcaccatcaccacggcgcgcacgatcaccggcactggtcgcagatccgcgcggggctgaccgcggccgatctcgaaccgcgggtgcgcgaccacgcgctcgcgatcttcggacacctcgccgaggccgaggcgcgggtgcacggcatcccggtcgcgcaggtctccttccacgaggtcggggcgctcgactcgatcgccgacatcgtggcggcggcccatctcgcggcggcgaccggcgcgacgggctggagcgtgtcggcgctgccgctcggcgcggggcgggtccgcacgcagcacggcgtcctgccggtgccggcgcccgccaccgccctgctgctcgaaggcttcgccacgatcgacgacggcgtgccgggcgagcgggtgacgccgacgggcgccgccatcctgcgccatctctgcgggaccggcgggcgggcgagcgggccccgcacgctggcccgcagcggcatcggcttcggcacccggaccctgccgggcctgagcaactgcgtgcgcgccctggtcttcgatgaggcggaggccggcgatcgggcgggcgggcgccaccgcgacctcgcggtgatcgagttcgaggtggacgaccagtcggcggaggatctcgccatgggtctcgaccggctgcgggcgcacccggacgtgttcgacgccgtgcagatgccggtcttcggcaagaaggggcggatgatgacccatgtgcgcgtgctcgcccgcgcggacgcgctggaggccgccgccgaggcctgcttccgcgagaccaccacgatcggcctgcgtcaccggatcgtctccggcatcgccctggagcggacgagccgcacggtcgcggtcggcggccacgatctccgggtgaagacggtggcgcgccccggcggtgtcaccgccaaggcggaggccgacgacgcgctggcccacgagggtcacgccgcccgcgagagcctgcgccgcgcggccgagcggatcgccctcgccgagcgcgcggacgaggagcgggcatga

SEQ ID NO: 7806 - DNA, 816 bp, Methylobacterium sp.
atgagcgcgtcgctggagagcctgctcgccgggatgggcccgctcgccgtggcggtgagcggcggcgtcgacagcctgacgctcgcgaccctcgcccaccggcgcctcgggcacgacggcatgctcgcggtgcacgcggcctcgcccgcggtgcccggcgaggcgacggcgcgggtccgcgcggaggccgaacgccagggctggcgcctgcgcgtgatcgaggccggcgagttcgccgatccccgctaccgggcgaacccggtcaaccgctgcttcttctgcaagacgaacctctatgccgcgatcgcccaggctaccgaccggcagatcgtgtcgggcgccaatctcgacgatctcggcgagtatcgccccggcctcgacgcggcccgcgagcacggggtgcgccaccccttcgtcgcggcgggcctcggcaaggcggcggtgcgggcgctggcgcgcgcgatgggcctcggcgacgtcgccgagcttcccgcctcgccctgcctgtcgagccgcgtcgagaccggcatccgcatcgagccggagaccctggccttcatccacgcggtcgagcgcatcgtcggccgggcgctcgccgccgagggggcggaggcgcgggtgcgctgccgggtccgggcggagggggtggtggtcgagctcgacccgcgctgcctcgcgctcctcgacacgggcctgcgcgcggatctcggcagcgcgatccgcgagcgggcgcccgcgccagcgctcgccggcccggtgcgcttcgagccctaccgcaacggcagcgccttcctgctgaacggagccgcccgatga

SEQ ID NO: 7807 - DNA, 1266 bp, Methylobacterium sp.
atgaccctcgccctcggctgcgtggcggacgactatacgggcgcctcggatctggccaacaccctgaccaaggcggggctccgcactgttcagaccatcggcatcccggccgacgacctcgcgctcggagccgccgacgcggtcgtggtcgccctgaagagtcgctcgatcgcgcccgagcgggcggtcgccctgtcacgggcggccgacgcgtggctgcgcgggcgcggcgccgcccacgtgatgttcaagatctgctcgaccttcgactcgaccgaccggggcaatatcggccctgtcctcgacgcgctccggaaggacgcgggcgaggcgatcgccctcgtcaccccggccttcccggagaccgggcgcagcgtctaccagggccaccttttcgtcggtgccgtgccgctcaacgagagcccgctgaaggaccacccgctcaaccccatgcgggactccgacctcgtgcgggtcctcgcccgccagagcgcggcaccggtcgggctcatcgacgtcgcgaccgtggcgcggggggccgacgccgtgcgcggccgtctcgacgcgctggcggcggagggggccggtgcggcgatcgccgacgcgatcttcgacaccgacctggaaatcctcggacgcgccgcgctcgcgcaccgggtctcgtgcggcgcctccggcctcggccttggcctcgcacgggcgctggccgcccccagcgcgcccgacccggccgcggacgtgctggccgaggccgtcggcgggctctcggcctgcctcgcgggcagttgctcgcgggcgacgctggagcagatcgcggcggcggaggatcgaatgccggtgctccgcctcgatcccgagcgcctgatcgcgagcccggacggcctcgccgaggccgtcgcctgggccggcgaccggatcggacggggcccggtcctgatcgcgagcagcgcggatccggaggcggtgcgcgccctccaggctcgccacggcgtcgaggcggcaggccacgccatcgagaccggcctggcacggctcgctgccgccctggtggagcgcggcgtgcgccgcctcgtggtggcaggcggcgagacctcgggcgcggtggtcgaccatctcggcctcaaggccttccgggtcgggccggagatcgcggccggcgtgccggtgctgcgcacgacctcgggcgagccgatgctgctcgccctcaaatccggcaatttcggcgggcgcgacttcttcgccctcgccctcgacctgatgcggtga

SEQ ID NO: 7808 - DNA, 1017 bp, Methylobacterium sp.
gtgaccatccaccagacaccgggtcgtctcgtgaccatcgccgacgtcgcccgggaagcaggggtcggcgagagcacggtctcgcgcgtgctgcgcgggcagggctcgttctcgaagcgggcgggcgagcgcgtgctcgaggtggccgcccggctcggctacgtgccgaaccggctcgccgggtcgctggccggcaacgccgattcggcgggctcgcagctcgtcggcgtggtgatcccctcgctcgccaacatcgtattccccgacctgctgcgcggcctcaccggcgccctcgacggcgccggcttccagagcgtcgtcggggtgagcgactacgaccctgcgcgcgaggaggccctggtcgccgggctgctgtcgtggcgtcccgccgccctggtgctgaccgggttggaacacacggaattgacgcagacgcggctgcgggcggccggcatccggatcgtcgagatgatcgacacggacgggccgggcctcgacatcgtggtgggcttctcgaaccggaccgtgggccatgccagcgcccgccacctgatcgggcgcggctaccggcgcatcgcctatgtgggccacgacctcggccgggacctgcgggcggccaagcggctggccggcttcgaggcggcgctcgccgagtcgggcctcgccctgcacgcccgtgagctcgtggccgaccgctcctcggcctctgccggccgcgccgccctggaggcgctgatggggcgcgtgccggacaccgacgcggtctacttctcaaacgacgacatggcgctcggcggctacttcgcctgcctgggccgcggctgggccgtgccggagcgggtggccctgttcggctgccacgccctcgacatcaccgaggcgatgccgcagccgctctcgaccatgcgcacgccccgcctcgccatcggccgcgcggcggccgaggccttgggcgcgggcggcccgcccgggacgatcgatctcggcttcgaattgagcgagggggccaccgcatga

SEQ ID NO: 7809 - DNA, 672 bp, Methylobacterium sp.
atgaacgcatcggaaagcaggctgcgcgaggagatctgccgctacggccgctcgctgttcgagcgcggcctgacgccgggctcctcgggcaacatctcggtgcgcctcgacgacggcggttggctggtctcgccgaccaacgcctcgctcggcttcctcgacccggcccggatctcccggctcgatgcagtgggcaacctcgtctccggcgacaagccgacgaaggagatcccgctccacaccgcgctctaccagagtcgccgggaagcgcgcgccatcgtgcacctgcactcgacccatgcggtcgcggtctcgatgctgcccgagatcgacccgaaggcggtgctgccgccgctgacgccctactacctgatgcgcaccgggggcacggcgctcgtgccgtatttccggcccggagacccggcggtcgccgacgcgatccgtgggctcgccggccgctacagcgccgtgctgctggccaaccacggtcccgtggtggcgggcgagagcctggagggggcggtcttcgccacggaggaactggaggagacggcccggctctacctgctcctgcgcaacctcaatccccgcgccctctcgcccgcgcaggtggacgacctcgtcgcccatttcgggctgacgctcccggatcaccgcggcggctgcggctga

SEQ ID NO: 7810 - DNA, 1131 bp, Methylobacterium sp.
atgcgcgcccggcggcccgatccctcgcacgataggctcatcatgatctcaggcccggctctggtcgtcgatcgaacccatctcggacgccgcgcttccggtatcgagcgcatcaccgaagagctgttctcggcctcggcgctcgcgccgctgccggtggtcggctgggatggggcgggcagcaagccctcgatggtgctgaatcagcgcctgcggatcccggcggcggccttggcgcacaaatccaagctctggctgttctccggctacccgccgtctccctggatgacgtggatgccggagcgaaccatcttctacgtccacgacctctttctgctgacgcggcaggccgaactcaaccgatccgcgaagctgtacatggtccggccgttcagaacggcgctcgcgcggctgcgctacttcctggcgaactcgcaagcgaccgtcgacgctctccggacggccgtccgtcccgaggccacgatcctgccctaccgtccggcgatccggaacgtgttcggcctgagcgatcggcgccctgctgcggcggacgaccggccgctcgtcgtgggggcgatgggcacgatcgagccgcgcaagaacttcgtcggcgccgcgcgcctgtgcgagagcctcgggcacgtgctcgggcggcgggtcgaactgcacatcatcgggcgaagcggttggggagaagacgcatcgatccttgagcgtcagccccatgtccgcctcgagggattcctcgacgatgccgccgcacgcgcggtgatcgacgggttcgacctcttcctgtgcagctcgcacgacgaggggctcggcctgccgctgctggagatgcagttcgccggcctcctcgtcgtcgcaccggacaaacccgtgttccgggaagtgctcggcacgtccggcctgctcgtcgacatggccgatccggagggcgcggcacgggcgatcgccggccgactcgcggaacccgggtggcgcgcgcgggctcaaggacaggcctctgccaacatcgcgcgctggaaccggcaggccgcacaggaccgcgacgccgtgatcgcgttcctcgaagcgcgtctctccgcgctcgatgcgtccgccgccacgcactgcgtacagcaggcctag

SEQ ID NO: 7811 - DNA, 231 bp, Methylobacterium sp.
gtgagcgcgacgcgcaacgagcagacgaagctcctggcgaccgccatcaacaacgtggcggtcgccttcgcggtgctgggcttcgtgacgccggtcgtcgccgtgagcttcggcgcggcgagcgcgcccatcctgcgcaccgacagcgcgctgttcatgctcgtctggctttgcgccggtttcaccttacattgggtggcgagacgcaccttgcggagcctcgaaccgtga

SEQ ID NO: 7812 - DNA, 984 bp, Methylobacterium sp.
atgatgagcgaagacgcggccagcgtgagcctgccgagctacggcgacgtcgcgcgggcggcggagcggatccggggcgcggcgcatcggacgccggtgctcacgtcccgcacagccgatgcccggaccggggggcagctgttcttcaaggcggagaatctgcagcgggccggcgccttcaagttccggggtgcctacaacgccatcgcggcgctgccggaggaagcgcgccgacgcggcgtgatcgcctactcctccggcaaccacgcccaggcgatcaccctggcagcccggctgctcgacgttccggccaccatcgtgatgcccctcgacgcgcccgccatgaaggtcgcggcgacccgcgattacggtgcggaggtcgtcacctacgaccgctacacgcaggaccgcgaggcgctgggccggtccatcgcggcggaacggtccctgagcctgatcccgccctacgaccatccggaggtcatcgccggccagggcaccctggcgctggaactgatcgaggagaccgggccgctcgacatcctggtcgcatgcctcggcggcggcggccagctcgcgggctgcgcgctcgccgccgccgagctgatgccggaggcgcgggtctacggggtcgagccggaggccggcaacgacggccagcgctcgttccgggagggccggatcgtgcggatccccgtgccgcagacgatcgcggacggcgcgcagaccacacatctgggcgcgcgcaccttcccgatcatcgcgcgccacgtcacggacgtgctcaccgtctcggacgcgcaactcgtcgagacgatgcgcttcttcgccgagcgtatgaagctcgtggtcgagccgacgggctgcctcgccgcggcggccgtcctcgccggtctggtggacgtgcgcgacaaacgggtcggcgtcgtgatcagcggcggcaacgtcgatctcgcgagcttcgcgcggttcataggcggatga

SEQ ID NO: 7813 - DNA, 486 bp, Methylobacterium sp.
atgagcgatgggcgcaaaccacccggcgcgccggaccgacccggcggcctgatccaggcgatcctctcgggtctcgccccgaaacgccccccggcgccggagcccgagcccgcgcactggcccgaggcgccccgcgctgggccgggctacgagacggaggacgtcgacgtccgccggaccggcctcgtcatggcggggctggcagcctcggcgctcgtcgcggtcgggctgatgctctggctgatgcacgccttcgcggcgggccagcgccgggagctgcccagcctcactccgcagcagaccgcggtgctgaagcccccgccgccgaacctccaggccgacccctaccgcgacatcgcccgcgagcgggccgccgagcgcgcccggctcgacggctacgccctcaccgagggggggcgcgcccgcatcccgatcggccgtgccatggagttggtgaccggccggccgctggatcccgcccgatga

SEQ ID NO: 7814 - DNA, 312 bp, Methylobacterium sp.
atgcgcaatccgatccacgatctctcgccggaggaccgcgcgctcctgcggcgccacatgcgcaagccggtcctgaccttcctggcgctgctggcgctgctcgccgtcaacgtcgcgctcggcgccaccgtgcccttcgcccatacctgggcgctggagctcatcgtcgtcaccgtgatggtggcgctcatcctgctcgtctcgatggaggtgacgaaggagccgccgctggtgaagctgttcagcgtgctcggcttcttctgggtcgccatcctggtggggatgacgctgacggattacctcgcgcgctga

SEQ ID NO: 7815 - DNA, 369 bp, Methylobacterium sp.
atgcgcaccatcgagaaccgaaccgaagatacggtcctgaacacgctcaacgccctgctcggcgtcatcctgctctcgacgccctggtatctgggagtggccaacgagaccgccgcggccctcaacgccttcgtctgcggcacagccattgccatcattgcggtgctcgccctcagcaagtcctacgactgggaggaatacatcaacctcgccatcgggctctgggtgtccatcgccccctgggttctcggtttcgcagagaccggggcttcgatgtgggcgcacgtcgtgatcgggcttgcggtcgccgccctggccgcggtcgagctctggcgcctctacgtgtcccccgaggcgcgctctgtctga

SEQ ID NO: 7816 - DNA, 885 bp, Methylobacterium sp.
atgaacatcggcttcatcggcctcggcatcatgggcgcgcccatggccggccacctgatcgcgggcgggcacagcctgttcctgaagagccgccgctccgtacccgacgccctcctgagcgcgggcggcacagcctgcaccaccgccgccgaggtcgcccgccacgccgacgtgatcattctcatgctgcccgacacgcccgacgtcgagacggtgctgttcggcgaggccggcgtcgccgaggggctggcccccggcaagaccgtgatcgacatgagctcggtctcgccgatcgccaccaaggacttcgccgccaaggtcgcccgagccggctgcgactacctcgatgccccggtctccggcggcgaggtgggggcgaagaacgccgccctgtcgatcatggtcggcggcgccgaggcggccttcgccagggccgagcccctgttccacctgatgggcaagaccgtgacgcatgtgggcgagagcggcgccggtcaggtcgccaaggtcgccaaccagatcatcgtggcgctcaccatcgaggccgtggccgaggggctgctcttcgcgtcgaaagccggcgccgacccggccaaggtccggcaggccatcaccggggggctggccacctcgcgcatcctggaactgcacggcgcccggatgatcgagcgcaccttccagccgggcttccgcatcgacctgcaccgcaaggacctgaacctcgcgctggagggcgccaaggcgctcgacctcgccttgcccggcacggcgctcgcccagcagctcttcggggcctgcgcggccaacggcgcgggcggcctcgaccactccgccctggtccgcgcgctcgagatcatggcgaaccacccggtcgccgagggctga

SEQ ID NO: 7817 - DNA, 891 bp, Methylobacterium sp.
atgagcgaccggccccgctcccccgccttctacgcgctggcggccttcttcgtcctgttcgtcgccttcctgtacgggccgacgctgaccatcctggtcctcagcttccagggcccgcacggcggcctgaccttcccgatgaacggggtctcgacgcactggttcggcaagctctgggcggggctcggcatcgtcgacatctggggcgcgctctggcgctcgctccgcctcggcttcgtcgtgatggtgctcaccgtggggatcgcgttcttcgcgggcctcgccttccgcaagcgcttcgtcggcgagggcgccctgttcacggttgcggtggccagcctgatcgtgccctccatcgtcgtgtcgctcggcatcgggctggagttccggctcctcgacgacgcggtgaagtggctggccgccgagaccggctggggctggctgcaggagcacggcaccctgatggggctctacacctcggcactcggggcccacctgacctggacgctgcccttcggcctgctcatcatgttcgcggtcttcaaccgcttcgacccggcctacgaggaggcggcgcgcgacctcggtgccaccggcccccagaccctgcgccacgtcgtggtgccgatcctcgggccctcgctcgtcggcgtcgcgctcttcggcttcaccctatccttcgacgagcttgcccgcacgagccaggccatcggcggacgcaacaccctgccgttggaactgcagggcctgaccaccaccgtgacgacgccggagatctacgcgctcggcacactcaccaccggcctgtcgctcgcggtgatcggggcggcgctcggcgcgagcctgtacctgcagcggcgcagggcccggcgagggctgcggctcgggtga

SEQ ID NO: 7818 - DNA, 945 bp, Methylobacterium sp.
atgaccgaggccgccctccccgctctcgcggacgcgcccaccgtgccggtcgccgcgagcctcaccgcgaagacccgccgccggcgggccctggcctatctccaggcggcgccgatggcgctcgtcttcgcggtcttcttcctcgtgccgctcctgctgaccctcatggtcagcttctgggagtacaacgagtacgagatcatcccgtccttcacggtgcagaactaccgcgacgtgttcgagggctgcctcgacgtgcagaacgcctgcacgaccctgcgcacctatctctcgacgctcaagttctgcgccctcacctggctcttcaccctgctgatcggcttcacggtggcgtatttcgtcgccttccacgtccgctcgcgcaacgtgcagatggcgctcttcctcgtctgcacgatcccgttctggacctcgaacgtgatccgcatgatctcgtggatcccgctgctcggccgcaacggtctcgtcaacgacacgctcatggggctggggctgatcgcgcggcccatcgaggggctgctctactccgacttctcggtggtgctggccttcgtccacctcaacacggtcttcatgatcgtgccgatcttcaacagcatggcgcgcatcgaccgcgcgctgctcgaggcggcctacgatgccggcgccagcggctggcagaccctgtggaacgtggtgatcccgctcgccaagcccggcatcgccatcgggtcgatcttcgtgatcaccctggtgatgggggatttcgtcaccgtcggcgtcatgggcggccagcagatcgcctcggtcggcaagatcatccaggtgcagatgtcggcgctccagcttccggcggccgccgccaacgcggtggtgctgctcggcgccgtgatgctgatgatcgtcgcgatgacgcggctcatcgacctgcgcaaggagctgtga

SEQ ID NO: 7819 - DNA, 1275 bp, Methylobacterium sp.
atgacgaccacgatcaagctcagccgccgcaccctgctccagggagcgggtgtcgccgggctggcgctcggtgccggaccgatcaccggctttcccaacgtgatcgccgccgagcccgtgaccctgcgctacctcggcaccgccgtgaaccagtccggcgacatcgcccggaaggtgaaggaggatctcgggatcaccatcgagtacatcccggtcgtcaccgacgaggtgaccaagcgtgtggtgacgcagccgaactccttcgacctcctcgataccgagtatttcagcctcaggaagctcatcccgtcgggcaacatccagggtatggatgcccgccggatcaagcaggccgacaacatcacgccggtcttcacccggggcgaggtcgccggcaagaagatcggcgaccagggcacggcgcccaagaaggttttttatcttgagggacaaaattcgaaaaactttgccggctcggccaccgagtggatcaccctgatccccaccacctacaacgccgatacgctcggcatccgccccgacctcatcaagcgcccgatcacgagctggcgggagctcctgaaccccgagttcaagggcaaggcctcgattctcaacatcccgtccatcggcatcatggatgccgccatggtgatcgaggccaccggcgactacacctatcccgacaagggcaacatgacgaaggccgagatcgaccgcaccatcaaggtgctgatcgaggccaagcgcgccggccagttccgcgccttctggcaggacttcaacgagtccgtgaaccttatggcgtccggcgagaccgtgatccagtccatgtggtcgcccgccgtcaccaaggtccgctcgcagggcgtggcctgcacctaccagccgctcaaggagggctaccgggcctgggcgtcgggcttcggcctgcccaagacgctcacgggccggaagctcgacgcggcctacgacttcatcaactggttcctctccggctgggccggcgcctacctcaaccgccagggctactactcggcggtgctggagaccgccaaggcgcagatggagccctacgagtgggcctactggatggagggcaagcccgccgagaaggacatcaagggcccggacgggagcgtgctggagaaggccggcgccacccgcgacggcggctccttcgagacgcgcatgggcggcgtcgcctgctggaacgccgtgatggacgagaacacctacatggtccgcaagtggaacgagttcatcgcggcgtga

SEQ ID NO: 7820 - DNA, 993 bp, Methylobacterium sp.
atggatgtcgagctgatccgcctgaccaagcgctacggcagcacggttgccgtggacggcatcgacctcaaggtccgctccggcgcctattgctgcctgctcggcccctcgggctgcggcaagaccacgaccctgcggatgatcggcggccacgagacggtgtcttccggcgacgtggtcatcggcccgcgcgcggtgggcgacgccgcgccggcggagcgcggcaccgcgatgatgttccagagctacgccctgttcccccatctcgattgccgcgacaacgtcgccttcagcttgaagatgcggggcgtcggcaaggccgagcgccgcgcgcgggcgctcgccatgctcgacctcgtacagatggcccacctcgccgagcggatgccggcccagctctccggcggccagcagcagcgcgtggcgctcgcccgcgccctcgtcaccgggccgaaggtcctgctcctcgacgagccgctctcggccctcgacccgttcctgcgggtgcggatgcggacggagctgaagcggatccaggccgagctcggcctcaccttcatccacgtcacccacagccaggaggaggcgatggcgctctccgacctcgtggtggtgatgaacggcggccgcatcgagcaggcgggcgacccgcgcacggtgttcgagcggcccgccaccgctttcgtcgcccgcttcatcggcggccacaacgtcgtccggctgcccgacgccagcgagatcgccgtgcgcgccgacgggatgcgcctcggcccggaggcgggcgccgaggccgtgccggcccgggtcgtgtccatcgagtaccagggcaccagcgtgcatgtcggcctcgaggcggacggcctcggcggccgggagccggccgcgctcacggcgatcatcggcgacggcgcctatgcggaccggccgctggcgctcggccagaccgtgccgctgggctgggacgccgccgccgctcatcgcctgagcgcctga

SEQ ID NO: 7821 - DNA, 1422 bp, Methylobacterium sp.
atggccgatttcgacctcgccatccggggcggcatgctcgtcaccgccgccgacaccctgcgggccgatctcggcatccgcgccgggcgcatcgcggccgtggccgagcgcatcaccgatgccgcccgcaccctcgacgcgtccggcctcctcgtcctgcccggcggcatcgacagccacgtccacatcgcgcaggcctcggggccgggcatcgtgatggccgacgatttcgcctcggccacgcgggcggccgccgccgggggcaacacctgcgtgatgcccttcgccctccagccgcgcggcgcgtccctgcgggaggccacccacgcctaccgggcgctcgccaaggggcagtgccacatcgacgtggccatccacctcatcgtctccgacccgacgccggcggtgctcggccaggagctgccagcgctgatcgccgagggctacacttcgttcaaggtcttcatgacctacgacgacctcgtcctgaacgaccgccagatcctcgacgtgttcgacctcgcccgccgcgagggggcgcgcgtgatggtccatgccgagggctacgacaccatccggtacatgaccgagaagctggagcgcgccgggcagaccgcgccctacggacacgccctgtcgcggccggagctcgtggagcgcgaggcggcacaccgcgcgatcgcccacgccgaattggtcgacctgcccatcgtcatcgtgcacgtctcgggggagcaggccatggagcagatcgcctgggcccgcgggcgcggcctgaagatccacgccgagacctgcccgcaatacctcacgctgacggccgaggacctgaaggggcgcggcgccgccgacccgatggcgggcgcgaaatacgtctgttcgcccccaccccgcgacagcgcgagccaggccgcgatctggcgcggcctggagacgggcgtgttcgagatcgtctcctctgaccactgcccgttccgctacgacgacccgagcggcaagctgaatccccgcgcgcgggattccttccgctacgtgcccaacggcatcccgggcatcgagacgcggctgccgatcctgttctcggagggggtctcgaaggggcggatctccctgaaccgcttcgtggagctcaccgccacgaaccacgccaagctctacggcctctacccgcgcaagggctccatcggggtggggttcgacgcggatctgacgctctgggatccgaaccgccgcgagacgatcacccaggcgaacctgcaccacggcgcggactacacgccctgggagggattcggggtgacgggctggccggtcatgaccatcgcgcgcggcgcggtggtcgcggaggacggccgcgtgacgggcgccccggaccgggggcgggtgatcgaccggacggtgcaggcagtaccgccgcggtag

SEQ ID NO: 7822 - DNA, 1107 bp, Methylobacterium sp.
gtgagcagcacccgccccaccatcacgccggccgacgcggtggcggaagtctccgcgctcggccgccgcctcgccgagggcgccaagctcttcggcgagatccgcgacgccgacgtgcagatcgccaccacgccgaaggacctcgtctggagccaggacaaggtctcgctctaccgctaccggccgctcgccgagtccaagggcctgcccccggtgctgatcgtctacgggctgatcggccgctacacgatggcggacctgcaggaggaccgctcgctggtgcgcaacctcctgaacctcggtctcgacctctgggtggtcgactggggcaatccgggccgggccgagcgcttcgtcaccatcgacgactacgtcgacggctatctcgccgagtgcgtggacgtgatccaggagcgcacgaaccgcgagacgctgaacctgctcggcatctgcgagggcggggtcttcaccacctgctacgcggcgctcaaccccgatcacgtcaacgcgatggtgctcaccatcacgccgatcgacttccacgccgaccagatcgacaaccgcccgggccacggcttcatcaacctctgggcgcgatccctgcggccggaggacgtcgaccggctgatcgagtcgcaggggtcgctgccgggcgccttcatgggctcggtcttctcgatgatgacgccgatgcggaccctgacgaagtacaacctcgacctgctcgacgcgctcgcagacaggaagaagttcctcaacttcctgcgcatggagaagtggatcgccgaccggccggaccatccgggcgaggcggccaagcagtggctgaaggacctctaccaggagaacaagctggtcgagagccgcttcgagctgtcgggccgcacggtgaggctcagccagatcacctgcccggtgctcaacgtcttcgccaaggacgaccacatcatcccgcccgccacctcgcgggcgctcggcgccaagatcggcacacaggactacaccgagctcggcctgcccggcggccatgtcggcgtgttcgtcggcggcaaggctcaggcgctgctcggctccggcatcgccgactggctgagcgcgcgcggctga

SEQ ID NO: 7823 - DNA, 1110 bp, Methylobacterium sp.
atggaacgccgaagctttctccagggcgccgtcctcggcgccggtctcgcgggcgccggcagcgcgggggcggccgtgaacgcgcctggcctgccccagacccgtccgcaggatcccgccgacctgcccttcgtcgccgatcccggcgagatgcggggcgagatgctctaccgcccgttcgggcggcatgcggagaagatctcggcgatcgggatgggcggcttccatctcggcaagaacgcggtctcggacgcggaggccacgcgcctgatccatgccgggatcgagcgcggcatcaccttcatggacaattgctgggactacaacgaggggcgctcggaactccgcatgggcgaggccctgtcgcagggcgggtatcgcgacaaggtcttcctgatgtccaagatggacgggcggaccagggacgaggcgatgcgccagatcgacacctcgctgaagcgcctgcgcaccgaccggatcgacctcgtccagcaccacgagatcctgcgctacgacgatcccgaccgcgtcttcgccgagggcggggcgatggaggccttcgtcgaggccaagaagcagggcaagctgcgctatatcggcttcaccgggcacaaggacccgcgcatccacctgcagatgctggaagtggcggccgagcgcggcttccagttcgatgccgtgcagatgccgctgaacgtgatggacgcgcatttccgctcgttcggccacctcgtcctgccctacctcgtccagaacggcatcgcgccgctggcgatgaagaccttcggcgacggcgtgatcctgaagagcgacgcgccgatcaagccgctcgaatacctgcacttctcgctcaacctgccggtctcggtggtgatcaccggcatccagaaccagcgcgacctcgaccaggccttcgaggcggtgaagaccttccggccgatggacaaggccagggtcgccgagctcctcggccgcagccgcgcctacgcgctggagggcaagtacgagctgttcaagacgagcgcgaccttcgacggcaccgccaagaacgccgcctggctcggcgaggacgtgccgggcgtgcagaagcttgcgccgacgatggaatag

SEQ ID NO: 7824 - DNA, 672 bp, Methylobacterium sp.
atgagcctcgccgaggagttcgtcctcgatttcgcccggcccgagcggatcgggatggaggagaccgtctacgcggccggcaagtcggcggagcagatcgacgccatcctgacggcggcggccgagcgcggggcccgcctgttcctcacccggctcgacgccgacaagcgcgcggcgctcgctcacgagctcgattactgcccggtctcgcgcaccgccgtcttcggtggtccgaaccgggtcgcgggcgttgccagcgtcgccatcgtggcggccggcacctcggacgtgccggtggcacgcgaggccgagcggacgctggcctatacggggatcgccgcgacgctgatcgccgatgtcggcgtcgccggactctggcggctgcagcggcgcctcgacgagatccgggcgcacccggtcgtcatcgtggcggccggcatggacgcggcgctccccagcgtcgtcggcggtctcgtgcccggcgcgctgatcgcggtgccgacctcggtcggctacggcgtcgccgagggcgggcgcgcggcgctcgacgcggtgctggcgagctgcgcgcccggcatcacggtctgcaacatcgacaacggctacggcgcggcctgcgcggcgatgcgcgtgctgcacgccgcccgggcgctccgggagttgtccccatga

SEQ ID NO: 7825 - DNA, 789 bp, Methylobacterium sp.
gtggcccacgaactgcgcgcggtcgccgccgccgcccgccccgacctcgccggcatcgaccgggcggagctggcacggacccggaccgacctcgccgcctgcttccggatggcggcccgctacgggctggaggaggggatctgcaaccacttctcggccgtggtgccggggcgcgacgacctgttcgtggtcaacccctacggcctcgccttcgcggagatccgcgcctcggacctgctcgtctgctccctcgacgggcacgtgctggagggcgaggggcagccggaggccaccgccttcttcatccacgcccggctgcacgcccgcctgccgcgggcgcgggccgccttccacacccacatgccgaacgccaccgccctcagcatgatcgccgggcagcccctggccttcgccggccagaccgcgctgaagttctacggccgggtcgcggtggacgacgcctataacggcctcgccctcgacttcaccgagggcgaccgcatcgccgcgaccctcggcgaggccgacgtggtgttcctgcgcaaccacggggtgatcgtcaccggcccgacggtcgccgaggcctgggacgacctgtactacctggaacgcgccgccgaggtgcagctgaaggccatggccagcgggcgcgcgctggtgccggtgcccgaggcgatcgccgcccgcaccgcggcgcagacgcgcgagggcgatcccgagagcgcgcgcctgcacatggaaagcatccggcggcgcctcgcccgcgaggagccggatttctcggggtag

SEQ ID NO: 7826 - DNA, 750 bp, Methylobacterium sp.
atggaggggacggatctggcctggcgggccgaggaggcctgccgcaacgcatggccggcgccgcgcgaggcgcatctcgacggctggctgctgcgcgcggccggcggccccacgcggcggacgaactcggtgaacccgctgcgcggcccccgcgcggccccggaggcggcgatcgcggcctgcgcggcggtcttccgcgggctcggacggccggccctgttccgggtcgtctcgctcgcgccggaactcgacccggtgctggcgcgccgcggctacgcggcggagggcgcctccctgacgctcgtggccgacctcgccgggcgcggccaggcccaggacccggtgcacctcgccgaggcgccggacgcggactggctcgccttccgcgcggcgatcaacggcgccgatccggaggcggagcgcgcctaccgggcgatgcacgcggcgatcctgctgccgcgggcctgcgcggccctgcgggtggagggcgcgatcgtcgcgcaggcctacggcgtgctcgacgggcccctcgtggtgatggagtcggtggcgacggccgaggcgtgccgcgggcggggatacgcccatcgggtcgtggcggcgctgatgcgctggggccgcgcgcggggcgcgcgcgccgcctgcctccaggtggtggccgacaacgcgccggcccgggcgctctatgccgggctcggcttcgaccgggaggtgtcgcgctaccattaccggcgggcgccggggcgctga

SEQ ID NO: 7827 - DNA, 1341 bp, Methylobacterium sp.
atgacagcctcggggacagagtctgcggcgggcgcggcgacatcgctggacgcggccctgacacggatcgggacgggccggttccaggcgcggctcctcgggatcttcggcctcgtctgggcggccgacgcgatgcaggtgctggcgatcggcttcgcggccccgacgctggccagggcgttcgagatcccggtgccgcaggcgatccaggtcggcaccgtcttcttcctcggcatgatgctcggcgcctggggcttcgggcgcctcgccgaccgggtcgggcggcgcgcggtgctgatcggcaccgtgctggcggacgccgccttcggcctcgcctcggcgctagcgcccgacttcacgagcctgctggtcctgcgcttcctcaccggcgccgcggtcggcggcacgctaccggtcgactacgccgccatggccgagttcctgccggcggcccggcgcgggcgctggctcgtgctgctcgaggcgttctgggctctgggcacgctggcgctggcgctggtgagctgggccgcggcggcctggggcgggccggacgcgtggcgctggatcttcgccgccaccgcgctcccggcgctcgtcggcgtcgccctgcgcttctgggtgccagaatcgccctacttcctctggcgccagggccggctcgacgaggccgaccgggtgctcgcccggatggcggcggcgaacggacgctccttcagcgcgggcacgctccggcgcgatcttgagaccgggccgcagcccagcctgctcgccgcgcccctgcggcagccgttcctgctgatcctggcggtgtggctcctggtctcgatggcctattacgggctgttcgtctggctgccggcccagctcgcggcctcgggactcggcttcctgcgcgcgcagggcttcctcgtgctggtggcgctcgcccagctccccggctacgcgctcgccgcccacggggtcgaaagctggggccggcggcgcacgctgatcgggttcctgctgacggcggcggccggctgctcgctctacgtcgcgaccgccgatcccctggtgatcgcaggcgcgaccctgctgatgagcttcgcgatgctcggcgcctggggcgcgctctacgccttcacgccggagctcttccccaccacgacgcgcgcgaccggcatgggcgcggccggggcgctcgcgcgcgtcggggggcttctggccccctcggcgctcgggctcgtggtggcggtgagcttcgcggcggcgatcgggctgttcgcggtgctgctcgcgctcgccgccatcgccgtcgcggggatccgcgaggagacgcgcgggcgggtcctgacctga

SEQ ID NO: 7828 - DNA, 1323 bp, Methylobacterium sp.
atgagcgccggcatcgccgtgtccgatgcccgccggagccgcgtccggatctccatcgtcctgatgctgttcgtcgccacgacgatcaactacgccgaccgcgcgaccatctcgatcgccggccccgccctgtcgaaggacctcggcctcaacgccgtgcagatgggctacatcttctcggccttcgcgtggtcctacgtgctggcccagatcccgggcggctggctgctcgaccgctacggcgtgaaatgggtctacgccgccgcgatcttcctgtggtcggccttcacgctcgtgcagggggcggtcggcttcttcacgggcgccaccgcggtcgcgctgctcttcgcgctgcggctcgccgtcggcctcaccgaggcgccggtcttcccggccaacgcccgcatcaccgcggcgtggttcccggcgaaggagcggggcatggcctcggccttcttcaactcggcgcagtacttcgccaccgtcctgttcacgcccctcatggcgtgggtggtccaccatttcggctggcaccacgtcttcaccatgatgggcgcgctcggcatcgccttcgccctgctctggacccagctgatccacagcccgaaggaccacccgggcatcaaccaggccgagcgcgactacatcgagaagggcggcgccctgctcgacatggacgggcagggctcggcacgccaagcgaacgtcggcaagacgctgaagcagctgctcgccaaccggatgctgctcggcatctatatcggccagtactgcatcaccacactgacctacttcttcctgacgtggttcccggtctacctcgtgaaggagcgcgggctgtcgatcctgcaggcgggcttcgcggcggtgctgccggcgctgtgcggcttcgtcggcggcatcctcggcggcgtcatctccgacatgctgctgcgccgcggctactcgctcaccgccgcccgcaagatcccgatcgtcggcggcatgctgctctcgatgtcgatcatcggctgcaactacgtgcaggcggacgccctcgtggtcggcctgatggcgctggccttcttcggcaagggcatcggcgcgctcggctgggcggtggtctccgacacctcgccgcgggagagcggcggcctgtcgggcggcctgttcaacaccttcggcaacacggccggcatcaccaccccgatcgtgatcggctacatcgtgcagaccacgggctcgttcaacggcgcgctggtcttcgtcggcctcaacgcgctggtggcctgcttctgctacctcgtggtggtcggcgagatccgccgggtcgagctgcgctga

SEQ ID NO: 7829 - DNA, 1197 bp, Methylobacterium sp.
atgagcgcgcacacgaagccccgccccctcgacggcatcaccgtgctgtcgctggagcacgccatcgccgccccgttctgcacccgccagctcgccgatctcggcgcccgggtgatcaagatcgagcgccccggcaccggcgacttcgcccgcgcctacgacgagcgggtgcggggcatggcctcgcacttcgtctggaccaaccgctcgaaggagagtctgaccctcgacctcaaggcgcctcaggccgccgggattcttgaccggctggtcgagcgcgccgacgtgctggtgcagaacctcgcgcccggcgccgccgcccggctcggcctctcgtacgaggcggtctcacagcggaacccgcgcatcgtcgtctgcgacatctccggctacggcgacgacgggccctaccgcgagaagaaggcctatgacctgctgatccaggcggagggcggcttcctgtcggtcacgggcagcccggacgagccggccaaggccggcaactcgatcgccgacatcgccgccggcatgtacgctctccagagcgtgatggccgggctgatccagcgcgaccgcacggggcgcggcgcccgctacgacgtctcgatgctcgaatgcatggcggagtggatgggctacccgctgctctacgccttcgagggcgcggagccgccgccgcgggcgggcgcgtcgcatgccacgatctacccctatggcccgttcccgaccggcgacgggcgcaccgtgatgctgggcctccagaacgagcgcgaatggaccctgttctgcagccgcgtgctgaggcggccggagctgaccgccgatccgcgcttcagctccaacgcccggcgcagcgcggcgcgggtggaactcgccgggatcatcgagcaggctttcgccgggctcgaccgcgcggccgtgatggcccggctcgacgcggccggcatcgcgaatgcgggcgtgaacagcatggcggatctctgggcgcacccgcagctgcacgcccgcgggcgcttcggcgagatcggctcaccggtcggtcccctgccgacgctgctgccgcccgggcggacggaggcctatgcgccgcgcctcgatccggtgccggcgctgggcgagcacagcgcggcgatcctcgcggaactcggctacgacggcgccgcgatcgacgcgctgcgcgccgacggcgtgatctga

SEQ ID NO: 7830 - DNA, 855 bp, Methylobacterium sp.
atggacgccagccccctcgacctcgaccacctgcgcacgtggatcggccgcaccgagaccgcggaggaccagctcaccgagcagacggtccgggccttccgcgcgacgctcgaccaggatccgggcaaccctgagaccggcgaggtcgccccgctcgcgatccactggtgcctctcgcccccgatccggcccctgcacgagctcggccccgacggccacccggcccgcggtggcttcctgccgcccgtcccattgccgcgccggatgtgggcgggcggcgagatcgtccaccgcgatcccctccgggtgggcgaccgggttcggcgcctctcccgcatcggcgacgtgcaggtgaagcacgggcgcaccggcccgctctgcttcgtcgcggtccaccacgatttcgagacggcgcgcggcccggccgtctccgagcgccacgacatcgtctaccgggagatgacgccgggccgctccggccagccgcccgaggccgccggcggcgtgccggaggccgacctctccgagaccgtcgagcccggcccgacccagctgttccgctactcggcgctcaccttcaacggtcaccgcatccactacgaccggacctacgcgcgcgaggtcgagggctatccgggcctcgtggtgcacggcccgctccaggcgacgtggctcctccacctcgccgcgcgcctcgccggccgcatccctgagaccttccgcttccgcggcctcagccccgtcatggacggcgccccgctcaccgtctcggcccgcctgaccggggacgggagcggcgaggcctggacgctcaccgccgacggccgcgtcggcatgcaggcgacattctcatga

SEQ ID NO: 7831 - DNA, 1701 bp, Methylobacterium sp.
atgtcggatgaaccgcacggcctcgaccgcggcctgacgaactacggggaccgcgacttcgcccgcttcctgcgccgctccttcgcgcgctccatgggcatctcgccgggcctgctgaacaggcccgtcgtcggcatcgccatgacgccctcgggcttcaacaactgccaccggagcatgccggagctcgtcgaggccgtctcccgcggcgtgctggcggccggcgccctgcccaggcccttcccgaccgtgtcgctcggcgaggttttcctcaacccgaccagcatgatgtaccgcaacctcatggccatggacaccgaggagatgatcggtgcccagcccatggacgcggtcgtgctcatcggcggctgcgacaagaccgtgccggcccagctcatgggcgcggcctcggccgatgtgccggccgtccagctcgtgacagggccgatgtcgaccggccgccaccgcggtcagcggctcggcgcctgcaccgactgccgcggcttctggggcaggtatcgcgccggaacggtcgacgcggaggagatcgccgaggtcgagggccggctctcggtcacggccggcacctgcgcggtgatgggcacggcctccaccatggcctgcatcgccgaggcactcggcatgtcgctgcccggcaccgcagcgatcccggccgtgcactccgaccgcctcgtcgccgccgaggagagcgggcgcgcggccgtgcgtctgatcgagacgaggatcaggccctcccggatcatcacagagaagtcggtcgagaacgcgatccgggtgctgatggcgctctcgggctcgaccaacgccgtcgtgcatctcactgccatcgccgggcggctcggcatccggatctcgccggagcgcttcaacgcgatctcggacgagacgccggtgctcgtcgacctgaagccggtcggccagggctacatggaggatttccacgctgccggcggcatgggcgcgctgctgcgcgagctgcgccccctgctgcacctcgacacccgcgacattgagggccgcacgctcgccgagcgcctggacgagccggcgggttggatcgacaggtcggtgatccggccggcctccgatccgatctcgccagtgggcggcttggtctcgctgtcggggacgctcgcgccggacggcgccatcttcaagcgcgcggcggcgacgtcggacttgttcgagtcggagggccgcgccgtcgtgttcaccggactggaggacctgagccggcgcatcgacgacccggagctcgacgtgcaggccggcgacatcctggtcctgcagaacgcgggcccgcacgcggcgggcatgccggaggctggctacctgccgatcccgaagaagctggcgcaggcgggcgtgaaggacatggtgcggatctcggacgcgcgcatgtcgggcacggccttcggctcgatcgtgctgcacgtcgcgccggaggccgcgatcggcggtccgctcgctgcggtgcgagacggggaccgcatccgcctgtcgatccgggagaaacgcgtggacctgctcgtcgcacccgaggagatcgcccgccggatggacggcttccagccgccgcccgccccgaagcggggctacaaggcgctctaccgccgaaccgtcacgcaggcgccggagggctgcgacttcgacttcctggcgggagggatcgccgtctga

SEQ ID NO: 7832 - DNA, 903 bp, Methylobacterium sp.
gtggcgcagaccatcgggttcatcgggctcggcaacatgggcgggccgatggcggccaacctcgtcaaggccggccacacggttcgcggcttcgacctcgtccctgcctccctggaggcggcacgcgcggccgggatcgcggtcgtgggctcggccgcggaagccgctcagggagcggacgcggtcgtcacgatgctgccggccgggcggcacgtgatcgatgtctggggcgggctctgcgagagcgtgccggccggtacgctgctgatcgattcgtccaccgtcgatgtcgagagcgcgcgccgcgcccacgcgctcgccgaggcccgcggctgcccgtcggtcgacgccccggtctcgggcggcaccggcggcgccaaggccgggacgctcaccttcatggcgggcggcggggacgcggccttcgccagggccgagccgatcctccggcagatgggcaaggcggtgttccactgcggtgcggcgggcgccggacaggccgccaagatctgcaacaacatgatcctcggcatctcgatgatcggcgtgtgcgaggccttcgctctgggcgagaagctcgggctctcgcgccaggcactcttcgacgtggcttccgtctcttcgggccagtgctggtcgctcaccacctactgtccggtgcccgggcccgtgccgacctcgcccgcgaacaacgactaccgtccgggcttcgccgccggcctgatgctgaaggacctgcgcctcgcccaggccgcggccgccgcggccggggccgcgacgccgctcggcgccgaggcggcgcagctctacgccctgttcgacgcgctcgggcacgggggcgaggacttttccggcatcatccgtatgctgcgcggaaccacggcgggagacgcgggccgatga

SEQ ID NO: 7833 - DNA, 897 bp, Methylobacterium sp.
atgaaggtcgcggtggcgggggcaggctcggtcggctgctacttcggcggcctgctggcccaggccggccacgcggtcaccctgatcgggcgtgctcagcacgtggcggcgatccgcgcgcgcgggctcgtcctcgagaccgcggccggctccgagaccgtgccgctctgcgcgaccaccgggatggatggggcggcgggcgcggacgtgattctggtctgcgtgaagtccagcgacacggaagccgccgggcgggatctggcccccgttctgacgccggacgccgcgatcctcagcctgcagaacggcgtcgacaaccccgagcggcttgccgccgtgctcgggcgggacgtggtgccggcggcggtctacgtggccaccgagatggcgggggcgggccatgtccggcacctcggccgcggcgacctcgtgatcgggcccagccccgtgagcgaggcaatcgcggccgtgttccgcgatgcggccatcccgaccacggtctcgccgaacgcgatcgatgccctctggagcaagctggtcctgaactgcgcctacaacgcgctgtcggcggcgacgcggctgccctacggccgcctcgtcggcgtcgcgggcatcgaggcggtcatggccgatatcgtcgcggaatgcacggccgtcgccggggccgcgggggtgcggctccccgacgacaccttggcgcgcgtgctcgctctggccgagaccatgccgggccagttctcgtcgacggcgcaggacgtgatgcgcggcaaggagagcgaaatcgaccacctgaatggattcatcgtccgtaggggcgccgaattgggcgtgcggacaccggtcaaccgggttctgcacgcgctggtgaaggcactggaaacgggcggggccgcgtga

SEQ ID NO: 7834 - DNA, 567 bp, Methylobacterium sp.
atgcgccgcctcgcgccgcccgccctctgcctcctcgccctgctcaccgcgcccgcgctcgccgagagcgccgccgagcggctgccggcctgcctcgcctgccacggcgagggcggcacctcggccagtcccggcgtgccctcgctcggcgcgatgccggcggactacgtcgtcacgcagctctacctgttccgcgagcgccagcgggtcgccgacccgatgaacgctgtggccgaggggctctcggacgacgacctgcgcgcgctgggcgacgcgatagcccggctgccggcgccgaagcccgagccgaaccccgacccggcccggatggaggccgccagggcgctcgcggccaagcaccagtgcggctcctgccacggggcggatctcgccggccaggaccagatcccgcgcgtcggcgcccagcgcgaggactacctgctggcgaccttgcgcgcctacaagtcgggtgcccgcgccggctacgacccggcgatgaacgaggtggcgcagggtctctcggaggacgacatcgcggccctgtcctactacctcgcgcaccgctga

SEQ ID NO: 7835 - DNA, 597 bp, Methylobacterium sp.
atgggagcgcccgcccaccgacccgcgacctacgccgacctcgaagcggtgccggagcatctggtggccgagatcatcgacggcgtgctggagacgcatccccgtccgcacccgcggcacgcggcggcggcgtccgacctgtccacgctgctgggcccgccctttcgccatgggcgcgggggccctgggggctggatcttcatggtcgagccggaactccatcttggacgcgatgtcgtcgtcccggatcttggcgggtggcgccgcgagcggttgccggcggaggtgatgaaggccgccttcatcgaaacgccgccggactgggtctgcgagatcctctcgccgtcgaccacccggatcgaccggggcccgaagcgccgcgtctacgcggaagccggcgtcggccatctctggctgctcgaccccgccgccggcctgctggaatccttcaccctgaccgagagcgcttggcggctcgatggcaccgttcagcgcggtgagaccgtggccctgccgcccttcgacgccgtcccattcccgctcgacgacctgttcgccttcgacgatccggccgccccgtcaccgaccgagacctga

SEQ ID NO: 7836 - DNA, 1146 bp, Methylobacterium sp.
atggcggacgcgaccgggctcggggcactcgacacgccctgcctgctcctcgacgaggcccggcttcgggcgaatgtcgcgcggatgcgcgggcgcctcaccgggctcggggtggcgttccgcccccatctgaagacggcgaagtcgcgcgaggtcgcacggctcgccatggcggcgccggaggggcccgccatcgtctcgaccctgcgggaggcggagtacttctgtgaggccggcctgcgcgacgtgatctacggggtgggcatcgcgccggacaagctcgcccgcgtcgcagccgtgcgggcgcgcggcgccgatctcgcggtgatcctcgactctcccgaacaggccgaggcggtcgccgcgcacgcggcccgcaaccgcgatcccctccccgtcctgatcgaagtcgatgcggacggacaccgctccggcgtcgcgccggacgacgcggagacgctcgtcgcgatcgggcgccggctcgtcgggggcggggtgagcctgcgcggcgtgctgctccatgcgggtgacagctacgcgctgagcgatcccgaggcactcgccgaggcggccgaggccgagcgcgtcgccgcggtcaccgcggccggaatcctgcgcgcggccggcctgccctgccccgtggtcagcgtcggctcgacgccgaccgcccgcttcgcccgggatctcaccgggatcaccgaggtgcgggccggcgtcttcatgttcggcgacctgttccaggcgggcgtcggcgcggtcgcgccggaggacatcgcgctgagcgtgctcgcgacggtgatcggacatcagcggaagaagggctggatcatcacggatgccggctggatggcgctctcgcgcgaccggggcacggcgcgtcaggcggtcgaccagggttacggcgttgtctgcgacctcgcgggacggccctatccggacctgatcgtggccgatgcgaaccaggagcacggcatcgtggcgctccgccgcggctcggaggccgcgctgcccgatctgccgatcggcgcgcgcctgcgcgtgctgccgaaccacgcctgcgccacgggcgcgcagcacgaccgctaccacgtcctcgacgatgccggccgcgtcgcgaaggtctggcctcgcatcaatggctggtga

SEQ ID NO: 7837 - DNA, 447 bp, Methylobacterium sp.
atgacacgcccgcactccgttgacgcgctcgtcccgggccggtcgtgcggccaatgcacggcctgttgccggaccctggagatcgaggcgctcgccaagccggcaggcatcctgtgccaccacagctccggtgtcgcctgcacgatctacccggagcgcccggacgcgtgcgctcggtggtactgcctgtggcggaggatcggcgccctgccggaggaactgaggccggatcggtcgggcgtggtcttcgccctggaaaaggcgtcgccggacgcaggagcccatcagggagcctgcatcgtaggccgcgccgtcgacggggagcaagccttcgaacgatgggaggcgaccgaagcgttcgccatgttcgtccgagagggatcgttgccggtttggaaggcgacggcccgctccgccaccttgatgcatgccggggcggcgctctga

SEQ ID NO: 7838 - DNA, 1572 bp, Methylobacterium sp.
atgctgagcgatctggaagccccgccgcgccctgtcggcgatgccccccgcaccatccgggtccacccggacgacaacgtcgccatcgtggtcaacgccttcgggctgccggccggcacggtcttccccgacgggctcacgctcaccgagttcgtgccgcagggccacaaggtggcgctcgccgacgtgccgaagggcggccacgtggtgcgctacggcgaggtcgtggggattgccctgcgggcaatcccgcgcggctcctgggtcgaggaatcctgcgtcgagacgccggtcgcgccggccctcgacgcgctcgagaagtccacccgcgtgcccgccgccctgccgccgctcgaggactacaccttcgagggctaccgcaaccccgacggcagcgtcgggacgaagaacatcctggcgatctcgaccagcgtgcagtgcgtcgccggcacgctcgacgtcgcgatccggcgcatcaagcaggaattgctgccgcgcttccccaacgtggacgacgtgatcggcctcacccacgcctatggctgcggcgtcgccatcaacgcgcccgaggcagtgatcccgatccgcacgctccagagcctcgcccggaacccgaatttcggcggcgaagtgatggtggtggggctcggctgcgagaagctcgtctccgagcgcctcgtgcccggccgccaggggacggacgaggacccggccaacgtcgtgcgcctgcaggacgagcgccacgagggcttcggcagcatgatcgacagcatcatggccatggccgaggcacggctccgggtcctgaaccggcgtacccgcgagacctgcccggcctccgacctcgtggtcggcctgcaatgcggcggcagcgacgccttctcgggggtcaccgccaacccggcgctcggcttcgcggccgatctcctcgtgcgctgcggcgccaccgtgctgttctccgaggtgacggaggtgcgcgacgcgatccacctgctcaccccgcgggccgcgaccccggcggtcgccgacgcactgatccgcgagatggcgtggtacgacgcctatctggagaagggcggcgccgaccggcgcgccaacccctcgcccggcaacaagcgcggcgggctcaacaacatcgtcgagaaggcgctgggatcggtggcgaaatccggcaccagcgcgatcgcgggcgtgctcgcgccgggcgagcgggtgcgcgagcggggcctgatcttcgccgcgacgccggcgagcgacttcgtctgcggcacgctccagctcgcctccggcatcacgctccaggtgttctcgacgggccggggcacgccctacggcctcgcccaggcgccggtgatcaaggtcgcgacccgcagcgagctcagccggcgctggtccgatctgatcgacctagacgccggccgggtcgccaccggcgaggccacgatcgaggcgatgggctgggagctgttccggctgatcctcgacgtggcgagcggcgtgagacagccctggtccgaccgctgggggctgtacaacgacctgaccctgttcaacccggcgccgatcacctga

SEQ ID NO: 7839 - DNA, 909 bp, Methylobacterium sp.
atgctcgcacctgccatcctgcggcggctcgacctgaccaccctgcgcctgttcgtggccgtgtgcgaggagggcagcctgacccgggccgcgcggcatgccgcgatcgcgccctccgcggtgagcaagcgactggtcgagctggagcagaccctcggcgtccagctcctcgagcgcggcgcacgcggcatgacgatgacgccggcgggcgagacgctgctgcatcatgcccggcgcatgctgcgcaacgccgagcagatcgccctcgaactggccgagcacgccaagggggtgcggggcatcgtccggatgctcgccaacctctcggccatcgtgcagttcctgcccgaggacctgcgcgccttcctggcgagccagggcgcgatcaagatcgatctggaggagcgtccgagcggcagggtggtgcggggcgtggccgagggcgcggccgagctcggcatctgtgccggcagcgtcccggcccccgggctcgacagcaccctctaccggcgcgaccggctcgtggtcgtgatgcgccgcgaccatcccctcgccggccggggcgccctcgcctttgccgacaccctcgaccacgacttcgtcggcctgcacgccgagagctccatctatggcagcgtccaggccgaggcgctgagcgccggccggcccctgcggctgcgcgtgcacgtgccgggcttcgacgcggtctgccggatggtgcaggccgatatggggatcggcgttgtaccccagggtgtcttcggcctgttcggcggcgccacggacctcgtcgacgtgccgctctccgacccctgggctcaccgcacgctgcagatcgtcacccgaccggggcccctcacgccggccgcgagcctgctgcgccgccacctcgccgcgcccccggactga

SEQ ID NO: 7840 - DNA, 762 bp, Methylobacterium sp.
gtgaaggttcaaggtatcgcggcgatcgtcaccggcgccggttcgggactgggtgcagcgaccgcgaaggtcctggcggccgcgggcgcccgggtggcgctcctcgacctgaacgcggaggcagcctccgcgacggcgcgggagatcggcggcctcgcgctcgcctgcgatgtggcggatgccgggagcgccgaagcggccgtcgcgcgcgcggcggccgagcaggggcccgcgcgggttctggtgaactgcgccgggatctgcccggccgcgaaggtggtcggacgcgacggcccggcctcgctcgacgccttctcccgggtcgtccagatcaacctggtcggcacgttcaacatgatgcgcctcgtggcggccggcgcggcaggtctcgaaccgctggacgggggagagcgcggtgtcctcgtctcgacggcctcgattgccgcctacgagggacagatcggccaggcggcctacgccgcctcgaaggccggcgtcgtgggcctgaccctgccggtcgcgcgcgagctcgcgccgctgggcatccgcgtctgcgccattgcgccgggcatgttcgagacgccgatggtccagggcctgccgcaggaggtccaggagagcctcggggcggccgtgccctttcccacgcggttcgggcggcccgacgagtacgcccagctcgtcatggcgatcgtctccaacccgatgctcaacggcgagaccatccggctcgacggcgccctgcgcatgcaggcacgatag

SEQ ID NO: 7841 - DNA, 1131 bp, Methylobacterium sp.
atgccgaccggtatcaggcgctgcaccgagatcgagggcgcctgcgcgatccacgaggcgccgccggacatccgggtccataccgacctgctctacgtccccgtggagtgcggtgccctctgggggctctacgcggacggggtccggatcgaccgcgaggccccgctcgacgccgacgccgcgcggcaggtcgccgagctccgcgtctcggccccgcggatcgacgggcgcttctactatctgggcgacgtggtcgagcatttcggccacttcgtcgtcggcagcctctcgcggctctgggcgctgcctgcgggtgccgacacgcccctgctctaccacggcgcgcaggacatcgagcggctccgcggcctcggcttcctggagccgatgctcggttccctcggcctcggcctggaggcgctccggcacttccgcgtcccggtccggctcgccgaggtcacggtggcggcgcgcgccttccgggagaaccgttcggcgagccgggcctacgacggactctgcaaggcgatcgggcggccctggctggcgggggtggctgccgacggcgatgcgcggccggcctatctctcgaagctcaagctgcccccgggcagccttcacaagctggagaacgaggccgaactcgtgcgggagcttgagcgccggggcgtcgacatcgtcttccccgaagagctcgacatccgcgctcaggtccggctcttcgccgagcggcggcacatcctcggcctcaccggctcggccctgcacgtctcgctcttcgccgcgcccgagcgccggatcctcggcctcaactggtgccgccgcctcaacgcgaacctcccgctcttcgacgccctgaaccggaacagggcgcactactatttcgccgacggggtgacctgggtccggaacgacgcctacgccgccgagggcgacttcttcctgcgctggtcgctgccggacccggcctccgtcgctgccgccctggtcgagcgcgccgcggatttcgacgggatcgccgagcgggacgcacgggaggatgccgcgcgggcgggcgggcccttcgcccgctccgtggccgccgccgggcgccgggcgcgcgccgggctgcggcggatcctgagcccctga

SEQ ID NO: 7842 - DNA, 270 bp, Methylobacterium sp.
atgatcgtctgttcctgcaacgtcctgtccgacggcgccgtgcgcggctgcctcaacccgggcccggcctgcccgcgcacgcccgcccaggtctatgcctgcctcggctgcagcccgaaatgcgggcgctgcgcccgcaccatccggtcgatcctgcggacagccctcgcggatgcggcggaagcggacgcccatgcctgctcggcgtcttgcgccagcgcctgcagtctgaaacagttccaaacagcggacgaggagctggccgcctga

SEQ ID NO: 7843 - DNA, 1542 bp, Methylobacterium sp.
gtggctcggggcgctcgcggcactcagcgtgccgctgctccggaggctgaagccctgagcgccgcccgcttctcccacctgctcgccgccgagctgcgcctcgtcctgcgcgagcgcctgacctgggcgatcctggccgcgctcctcgcggccttgtgcctcgcggcccgaacgggcgccgagcgcaccgaggcggcgcgcgccgcggtcgcgcaggcgaccgaggacggggcccgcaccgtgcgcgacgcccgggccgcgcacgcgcgctatgcccggccgagcccgatcaccgtgaactactggcaggacccgaccgacgccttcggctacatgacctacttcatggccgcccacgcggtgaaaccgccgacgccgctcggcctgctggccgccggccagtccgacgtgcagcccgccgtgatgcggatcagcttcggattcagcacggtgttcgacgacaccgcctacgagctcggcagcgccgcccggctcaggctcggcgccttcgatctcgccttcgtgctggtctacctcgtgcccctcgccgtgatcgcgctcgcgggcacgcggctctctgccgagcaggatgccgggatcctgcgcctgatcgcggcccagccgatcggcccgcgccgggtcgccgccgcgaagttcggggcggtcgggctcgtcgcggtcgcgggcgtgctcggggggacggcgctggcgctcctcatggcgggcgggaccggcccgctcgcgggctggggcggcgtgctggccctactcggcgcaagccttgccgcctacaccctgttctgggtcgcggcctgcgcgctcgccgcgagcctgtggcgcggggcggtggcggcgctcgccgtgctcgtcctggcctgggccggcctgaccgtcgccctgcccaccgcgctcggcctcgcggtggacctgctcgcgccgcgcccctcccgcatcgcggcgatcgacgcgagccgtcaggcgcaggcggcgttctacgcgggcgagacgggcacgcgggtcgcgagcgcgtggctcgccgcgcgcgtccccgatgccgccgctcggccgggcctatccgagaaacccgagatcaagcggctcgcccgcgacgccttctacgacacggcgctccgcgagacccgggcggcgctcgccgcgcatgcccgcgaactggcggcctggagcggacgcctcgccctgctcgcgcccgcgagcgcgctggcgctggcgctcgagaccgccgcgggcacggacgccgcccggcacgccgccttcctggcggcggccaccgggtatcgcgggagcctgcgcgccttcttcgagccgcggatcgtcgcccaggcgctcgatccggtccccgtctgcgccggctgcccgggccggctcgacttcgacgcctacgacgccgtgccggccttcgcgcccgccccggctctggcggcggcccggcttcaggcgtggctcagcctcgcggcgctcctcgccggcacgctcgcgctggccgtgctcgcccatcgccggctgcgcgcctggccggcctga

SEQ ID NO: 7844 - DNA, 1395 bp, Methylobacterium sp.
gtgaggcgggtcgcggccgagctcgccctgatcctccgcgacgcgcgcctgcgctggatcggcgcggtgctcgtcctgctgctcgctctggccggccttgccgcgtggcgggaggccgccgcctacggggccgagatccagcgcgtcaccgcggccgagcgcgcgcgctggctcgggcaggacgccaagaacccgcactcggccgaccattacggtctctgggtgttccgcccctctgcgccgctcgcggtgctcgatcccggcaccgagccctttacgggccggatggtgcgggtggaggcgcacctgttcaacgacgcggtctaccgcgccgtgcaggatgccgggccgctggcgcgcgccggcctcggcagcgtcgccgacatcgtgcagctcgtggtgccgctcgccgcgatcctgctcggcttctccgccttcgcggccgaccgggagcgtgggacgctccgcctcgcactcggcaacggcgtgccgccgggccggctcttcgccgggcggctcgcggcgctcgtgctggcgctggcgctcgtcgtcgggctgccgctcctcgggctcggggcgctcgccgccgatagtttgggagccgagggctggcaggtctggccgcgcctcctcgcctgggtcgccgcacagctcgcctatgcgggtgcgttcctgctcgtcgccatgctggcctcgctggtcgcccgcacggcgcgcggcgcactcgcggcctcgctcgccgcctgggtcctgctctgcgtcgccgccccgcggctcgcgggcgcgggcgtcgagctgctgcagccggccctgtcctaccgcgaggtgcgcgcccgcatcgatgcgggcttccgtgcccaccgcacggcggaggccaacgacgtccgggtgcgcgaggtgctggcccgctacggcgcgagcgacccggacgagctgccggtcgacctgcgcggcctgatgatgtccgagaacgagagccacaacttcgcggtctacgaccgggagctcggcgccttcttcgcgagcctgagcgcgcaggagcgcgccacggcctgggccggtatcgtctccccgcgcgtcgccctccaggccctgtcgcagacgctggccggcaccgatttcgccgcgcacgcccatttcgtctgggcggcggagcgctaccgccgcacgatctcggagcggatgaacgccgagatccgcgaccatccgcagggcggcggccgagtgctcgtctccgggccggagctctggcaggagatcccgcccttccggcacgcgccgctgccgctcgcccgcgcgctggcggatgcgggcgttccggccctgatcctcgccctgtggctcggggcgctcgcggcactcagcgtgccgctgctccggaggctgaagccctga

SEQ ID NO: 7845 - DNA, 729 bp, Methylobacterium sp.
atggcgaacgacgggcccgtgctggcgctggacggcgtcgtcaagcgcttcggccagcgcaccgcgctcgcgggcctcgaccttatcttacgttcgggcgaggtcttcgccctgctcgggccgaacggggccggcaagaccacgacgatcaacctgatcctcggcttcctgcgggcggatgcgggcacggtgcgggtgcggggcgtcgatgccagtgccgacccggtcggggcgcgggcgcacgtggcctacatccccgagcaggtcgcgctctatcccaccctctcggggctcgagaacctgcgctacttcgcgacgctcgcggggctcgacctcggcaaggcggaggcgcgcgcgctgctggccgaggcgggcctcggcggcgacgcccacgaccgggcggccggcgcctactcgaagggcatgcgccagaaggtcggcatcgcgatcgcgctcgcccgccgggcggggctcctcctcctcgacgagcccacctccgggctcgaccccggcgcctcggccgagttctcccgcacggtgcgggcggcggcggagcgcggcagcgcggtgctgatggcgacccacgatctctaccgggtgcgcgagatggcggaccgggtcggcgtgctcggcggcggccgcatcgtcgaggagatcgacccgcggagcctcgaccacgtcgcgctggagcggctctacatcgagcggctctcggagagcgcggcgtga

SEQ ID NO: 7846 - DNA, 1017 bp, Methylobacterium sp.
atgagactcttctcgacccttgccctcgcactcgctctagccggttcggctgcgcaggcggccgagcggacgaaactcacggtctacacggctctggagaacgaccagctcggtcccttcaagacggccatcgagcgggcggtgcccgaggccgaggtggtctgggtgcgcgactcgaccggcgtcatcaccgcccggttcctggcggagaaggacaatccccgcgccgacatggtgatcgggctcgccgcctcaagcctcctgatgttcgagaagctcaacctgctggccgagtacaagccggccggcgccgacgccctgaaggaggcctttcgcgacccgaaggcgccctacacctggaccggcatggacgcctatctcggcgtcgtctgcttcaacaccgccgaggccgcccgcgacggcgtgaagacgccccagcgctgggcggacctgctccagcccggcctcaagggcaaggtcgtgatgccccatcccgcctcctcgggcaccggctacctgatggtggccggctggctgcagagcatgggcgaggagaagggctgggccttcatggacagcctccacgagaccatcgcggcctacctgcattcgggctcggcgccctgcgtccaggccgcccgcggcgagcgcacggcgggcctctccctcgacatgcgcggcgccgccgagaagaccaagggcgcgccgatcgaggtcgtcgtgcccgccgacggcaccggctgggacgaggaggcgatggcggtggtggcgagctcgaagaacctggcgctggccaagaaggtcgccgactggggggccaccaaggccgcgagcgagctctacgcgaagagctacgcgatcgtcgcctatccgggcgtgtcgagcgcgcccgccaactacccggccaatgccgaggcgggcatgatcaagaacgatctcggctggatggccgagaaccgcgatcgcatcctggccgagtggtcgcgccgctacgaatcgaaggctgccaggaagtag

SEQ ID NO: 7847 - DNA, 1377 bp, Methylobacterium sp.
atgtacggcgccgtgctggcgggcgcctcgtccgatgcggcggcccgggccacgcccggaaacgtgatcctgatccgcggcggctacgtcatgacgatggatgccgtgcggggcgacctgcccggggccgacatcctcgttcgcgacgggcgtatcgccgagatcggacgcggcctgccggctccggagggcgccgacatcgtcgaagcggcgggcgcggtggtcctgccgggcttcgtcgatgcccacacccatggcgcgatcagccagatgcggggtctctacggcaacacgcccgagaccgcgttctttcccgtcaccaaccggctctcggcgcattacagtccggaggacacctatatcggcatgctgctgagcgccgtggagagtctggcctccggcatcaccacgacggccgacttcttcgacgccgtgcgcgaccgcgaacacgcggaggccggtctccgggcgctgcgggacgcgcagatccgggcgcggctgctctacgggatgacgagcaagaccgcggcggccccgatcgatctcgcccatgtcgaggaatggcagcggggctgggcggaccgctcggccggcgggcgcctctctctcggcctcgcttggcgcctgccgcaggatctcgacgacgcgcgggcctgggcgatcaagcagggggaatgggaggcggcccgccggctcggtctgccggtgcaggtccatgtcagcggcacggtaccgggacgggcggaggcgatgttcgacgccctgatcgcccggcggatgcttcggccgggcctgcaggtcatccatgcgaccgacgcccgggacgaccagctcgccgcgctggaggaggccggcgccggcctcgtggtcacgcctctgaccgagcaccgggtcggctacggcctgacccggatcgatcgcttcgccgggatccggcgcctcggcttcggcatcgatggaagtgcgctggccggctccaccgacatgttcgccctcatgcgcctcaccgcgctcacccaggccggcgccgcgcgtgacgagacggccgtctcgccccgccggctcctggaactggcgacggttggcggggcgcgggcgatgggcctcgatgcggagatcggcaccctcgtgccgggccgcgcggccgacctgcagatcgttcggctcgacacctggaacctcgccggtttcaagggcggcgatccgtcggcactcctcgtctactcggcccgaccggaggatgttgcaaccgtcatggtcggaggccgcttggtgaagcacgaccgtcgccttctattcgacgacctcatgctgctcgaccaagcccgcctatccatcctcggaatttgcagacgttccagccaagtcggtccttga

SEQ ID NO: 7848 - DNA, 318 bp, Methylobacterium sp.
atgagcagccacgccgcatccggcgcggggcgccgcaagccgcatcttctcgcccattccccggacgacaacgtcgccgtcgcggtgatcgaggggctcgccgccgacaccgccgccttcggggtgatcaccgagaacgacacgaccttcgagatccatgtccgccacgacatcccgatcggccacaaggtcgccctcaccgacctgaaggccggcgatacggccatcaagtacggccaggacatcggccgggtcatcaaggacgtcgccaagggcgagcacgtccacgtccacaacgtcaagacgaagcgctggtga

SEQ ID NO: 7849 - DNA, 1287 bp, Methylobacterium sp.
gtgatgatgttcaggcaagccgctcagctcgaacacgagatcgccacccccttcgcgggcggggcccccgaccagttcgccacgcaggcgctccaggccaagcgcgcctcggaggattaccgcgccgccaccttcatgggctggcgccgcgagaacggccgcgtcggcgtgcgcaaccacgtcgtcctgctgccgctcgacgacctctccaacgccgcctgcgaggcggtggccaacaatgtgaagggcacgatggcgctgccccacgcctacggccggctccagttcggcgaggatctggcgctgcatttccgcaccctcatcggcatcggctcgaacccgaacgtcgccgccgtggtggtgatcggcatcgaggaccagtggacgaaccgggtggtcgagggcatcgcccggaccggcaagcccgtgatcggcttcggcatcgagggccacggcgacatcgccacggtggccagggccagctaccaggccaagcgcttcgtgcagtgggcgaccgagcttgcccgcgaggaatgcccgatctcggacctctgggtctcgacgaagtgcggcgagtccgacaccacgacgggcctggcctcctgccccaccgtcggcaacatgtacgacaagctgatcccgcacgggatctacggcgtgttcggcgagacctcggagatcaccggcgcggagcatctctgccgggagcgggcggcgagcccggatatctccgacaagtggtacgccatgtggaaggcctaccaggacgacgtgatcgaggcccacaagaccgacgacctctcggactcgcagccgaccaagggcaacatcgcgggcgggctgaccacgatcgaggagaaggcgctcggcaacctcgagaagatcggccacgagtgccgctacatcgacgcgctgcagccggccgaagcgcccgccaagggccccggcctctacttcatggacacctcctcggcggccgccgagtgcgtgaccctgatggcggcggcgggctacgtggtgcacaccttcccgaccggccagggcaacgtgatcggcaatccgatcgtcccggtgatcaagatcaccggcaatccccgcaccgtgcgcaccatgggcgagcacatcgacgtcgacgtctcgggcgtgctgacccgcgagatgacgatcccgcaggccggcgatgcgctgatcgacatggtggtgcgcaccgccaacggccggctgacggcggccgaggcgctcgggcacagggaattcgtgatgacgaagctctaccgcagcgcctga

SEQ ID NO: 7850 - DNA, 942 bp, Methylobacterium sp.
atgtccaaggtcgtcatcagcgagttcatggacgaggcggcgatcgctgccgaactccagggtttcgacaccctctacgatccgggcctcgtcgaccgtcccgaggcgctcgccgccgcgctggacggtgccgacgcgctcatcgtgcgcaaccggacgcaggtgcgcgggcccctgctcgccgccgcgcgggacctcaaggtggtgggccgcctcggcgtcggcctcgacaacatcgacgtcgcggcctgccgggagcgcggcatcgcggtctacccggcgaccggcgccaatgacggggcggtggccgagtacgtgatcggcaccgcgatgctgctgctgcgcggcgcctacggggccacagcggcggtcgcggccggcacctggccgcgcaacgccctgatgggccgcgagatcgcgggcaagcgcctcggcctcgtcggcttcggctccatcgcccgcgagacggcccgccgcgccgccgcgctcggcatgacgatcgccgcgcacgatcccttcgtcgcccccgacgacccggcctggaatccggctcacggcccggtggtgcgcagcgcccgcgacgccctgatcgcggagagcgacgtgctctcgctccacgtgccgctgacggacgagacgaggggcctcgtcggcgcggcggcgatcgcccggatgccgcggggcgccgtgctgatcaacgcggcccgcggcggcgtggtggacgaggcggccgtcgcggccgcgctccggtccggccatctcggcggcgcggccctcgacgtgttcgaccgcgagcccctggacgccggggccggcgcggtcttcacggacgtgccgaacctcgtcctgacgccgcacatcgcgggcgtgacgatcgaatcgaacgtgcgggtctcggcggtgaccgcccgggccgtgcgccgccacctcacggagcgctag

SEQ ID NO: 7851 - DNA, 225 bp, Methylobacterium sp.
atggtgccgaccgcagcagaggggaccggagcgacggagcggaacggcgcggagccgggccggatccgcgtcttcgcgcgcgacaggcgcggcagcacggcgatggagtacgcgatgatcggcgcgctgatcttcgcggtcgccgccggcacgatcaagctctacggctcgaagatgaacgacgtctacgcccgcatcgggacgactgccgcccagatcgagtga

SEQ ID NO: 7852 - DNA, 987 bp, Methylobacterium sp.
atggccgataccgccgccctcgaccccgccccgatcgcggccgcccgacccgagagccgtgacgaccggacgctgcaccgccgcgtcttcctcggcatcgccctcgcgctcgttctggcgccgctggtactctaccccgtcttcctgatgaaggtgctgtgcttcgcgctgttcgcgctcgccttcaacctgctgctcggctacggcggcctgctctccttcggccacgccgcctatttcggcatggcgagctacgtctcggcgaacgccgccaagcactggggcctgacgcccgaactcgcgatcctcgccggcaccctggtggcgggcgggctcggcctcgtcttcggcgccctcgcgatccggcggcagggcatctacttctcgatgatcaccctcgcgctcgcccagatggcgttcttcttctccctccaggccaagttcaccggcggcgaggacgggatccaggcggtgccgcgcggccacatgttcggactggtgagcctcgcggacgaccgggtgctctacgccgtggtggcgctggtcttcttcggcggcatgctgctcatctaccgcatcatccactcgcctttcggacaggtgctgaaggcgatccgcgacaacgagccccgcgcgatctcgctgggctatcgggtcaaccgctacaagctcgcggtcttcgtgctctcggcctcgctggcggggctcgccggtgccaccaaggcgatcgtgttccagctcgcgtcgctcaccgacgtgcactggaccatgtcgggcgaggtggtgctgatgacgctggtgggtgggatgggcacggtgttcggcccgatcgtcggcgcgctcgtgatcgtcacgatggagacctacctcgctcagttcggcgcctgggtgacggtgatccagggcgtcgtcttcgtgctctgcgtgctcctgttccgagagggtatcgtcgggctcctcgcgcgccgcatcggccggccgctctag

SEQ ID NO: 7853 - DNA, 141 bp, Methylobacterium sp.
atgcttcagatccgcgacctccgggccgaggagttcgaggcggcactggacggttcgaagtcgccgcagcaggccctcgacgatgccgtggcgaggggcaacgcggtgctgcgccttttccagcgcaggactgcgcgctga

SEQ ID NO: 7854 - DNA, 546 bp, Methylobacterium sp.
atgcgcacaggatacgccctcgcgctcctcgcgctcctcgcgctcctgccggccgccgctcgcgcggacgcggtcgatctcgcgggcagcgcgacggtcggggcgctgcgtcgcgaggtgagcctgcgggtcgcctgcgagccgaagacccgcgccgtctccctcgacctgaccgtgccgggcttcgcggatctggagccggtcttcgacttctcggggctcgaaggtccgagcgggagcacggcgatgctcagcgagttccgggtcgtcggcgccgcgggcgtgcgcaccgcgcgggcccgcgcgagcggcgcggtggcggccgagcccgcgacgagcttccggctcaccgtggcgcccgcgcgccgcggcgagacgccggccaacggcatcgcggtcgccctggtcgagccgggagcacggctcgtctggacgcaggcgagcccgcgcaaggacgacgctccgctgatcgcgagcgtgacggtgcccgaagccgagaccgggccgctgcgtacggcgctgacgccctgcctcagcggcccctga

SEQ ID NO: 7855 - DNA, 1644 bp, Methylobacterium sp.
atgcaccgcacgcccctgacacgccgatcggtcctggccgggggcgcggccctcgccgccctcggcccggccggccgggccttcgcacagggcggggcctcggccggggcctcgggcggcccgtccggcagcctgacctacggcatctcgatgaccgacctgccgctcaccaccggccagcccgaccggggcgcgggcggctaccagttcacggggctcacgctctacgaccctctggtggcctgggaacttgacgtcgccgaccggccgggcaagatggtgccgggcctggcgaccagctgggagagcgacccggccgaccgcaagaactggatcttccgcctgcgcgagggcgtgaccttccacgacggctcggccttcgacgccgacgcggtgatctggaacttcgacaaggtgctcaacaaggaggcgccgcatttcgaccagcggcaggcggcgcaggtgcgcccgcgcctgccgggcgtggcgagctacaggaagctcgacgccgcgaccgtgcaggtgacgacgaagagcgtcgacagcctgttcccctaccagatgctctggttcctgatctcctcgcccgcgcagtacgagcgggtcgggcgcgactgggcgaagttcgccttccagccctcgggcaccggtccctacaagctcgcgggcctcaccccccgggtgcgcgccgagttcgtgccgaacgagcgctactggaacccgaagcgcatgccgaagctcgcccggctgacgctcgcctgcgtgccggaggatctcgcccgggtgaacgcgctgctctcgggcaacgtcgacctgatcgagctgcccgcccccgacgcggtgccgcgcctcaaggcggccggcatgcgggtggtgggcaacgacacgccccatgtctggaactaccatctctcgatggtcgagggctcgccctggcgggatctgcgcctgcgccgggccgccaacctcgcggtcgaccgtgagggcgtggtgcagctgatgggcggcctcgccgcgccggccgtcggccaggtgcagccgtcgagcccctggttcggcagcccgagcttccggatccggaccgacatggacgaggcccgcaagctcgtcgcggcggcgggctactcggtgaagaacccgctcaagaccaccctcgtcatcccgacgggcggcaccgggcagatgctcagcttgccgatcaacgagttcatccagcagagctgggcggaggtcggcatccaagtggcgttccgcaccgtggagctggaggtggcctatacgggctggcgccagggcgcctcggaccccagcctgaaggacgtcacggccggcaacatcgcctacgtcacctccgacccgttctacgcgatgctgcgcttctacgattcccgccagatcgcgccgaacggggtgaactggagccactaccgcaacgccgaggtcgacgcgctctgcgacaagatccgcaacagcctcgacacggccgagcaggaccggctgctcgcccggatgcacgagatcgtggtggacgacgcggtgcaggtctgggtcgtgcacgacaccaacccgcacgccctctcgccgcgggtgaagggctacacccaggcccagcactggttccaggacctcacgacactggcctga

SEQ ID NO: 7856 - DNA, 252 bp, Methylobacterium sp.
atgaccaagaccaagcttctgctcgccgcctcgctcaccctgctggcgggctctgccttcgcgcagggcggctcgccctacaacgcctcaggctcgcaggccggcggcccgctcggcggcctggagcgtcgctcgggcgctcccggcggcgcgcccgcggtggccccgggcgccgtcgacccgtcgatggccccggcccccgccccccgcaagcggaccatgaagaagcgccgcagccatcgcagtcggtaa

SEQ ID NO: 7857 - DNA, 1620 bp, Methylobacterium sp.
atgaagccgttcgtctggaaccagggctacccgtcgctgcgcatgccgatcttcggccgcaacgtggtggcgacctcgcacgcgctggccgcccaggccgggctcaagatgatctggcgcggcggcaacgcggtggacgccgcgatcgcggcggccgccgccaagacgatcaccgagccctgcagcaacggcctcggctcggacgccttctgcatcctgtgggacggggagcagctccacgggctcaacgcctcgggcggcgcgccggccgcctggacgcccgactacttccgccgcaagtacggggaggcggcccgcccgccgatgcgcggctgggactccgtgacggtgccgggcgcggtcgccgcctgggccgcgctccacgagcgcttcgggcgcctgcccttcggcgaccttctggagcccgccatcgagatcgccgagcgcggctacctcgcgccgatcgtggtgcagcagaaatgggcggcggccgcgcgcgtcgccgacctcgccggccagccgggcttcgccgaggtcttcctgccgcacggccgcgccccggaggtcggcgagcgggtgcggctgccgggcatcgcccggacgctgcgcgccgtcgccgagacgaagggccgggccttctacgagggggagatcgcgcaagcgatggcgcgccacgcggccgcgcacgggggcgccatgacggtggccgaccttgccgccttccgccccgaatgggtcacgcccaccggcaaggattatcgcggctacaccctccacgagatcccgccgaacgggcagggcatcgccgcgcagatcgcgctcggcatcctcgaggatttcgacctcgccagcctgccgccggacgggcccgagagccagcacctgcagatcgaggcgatgaagctcgccttcgcggacacctaccgctacgtcgccgacccctcgggcatgacggtgacgcccgaggagatgctggacccggcctacctgaaggcgcggggccggctcatcgaccgggcgcgcgcgcaggatttcgggcccggcaacccggcctccggcggcacgatctacctcaccaccgccgattcgtcgggcatgatggtgagcttcatccagtcgaacttcatgggcttcggctcgggggtggtggtgcccgaatggggcctgtcgctgcagaaccgcggccacggcttccacctcgatgcaggcagcccgaacgtggtggcgccgggcaagcgccccttccacaccatcatcccgggcttcctgacgaaggacggcgcgccggtgatgagcttcggcgtgatgggcggcaacatgcagccgcagggccatgtgcagacgctggtgcggatgctcgaccaccaccagaacccgcaagccgcctgcgacgcgccgcgctggcgggtcaacgaggggctcagcatcaacaccgagtccacgatgccggccgagacggtgcaggcgctcgcagagcgcggccaccaggtcgaggtgatcaacgacagctaccaggatttcggggccggccagttcatctggcgcatgggcgatccggacgcggacggctacgtcgccgcgagcgacccgcggcgcgacggacaggcggtcgtctgctga

SEQ ID NO: 7858 - DNA, 474 bp, Methylobacterium sp.
atggccaaggccacacccgccacccgcgccctcgacaagctgggcgtcccctacagcctgcacgcctacacctacgatccggaggcgccgcgcatcggcctccaggccgcggaggcgctcggcgtcggcccggaccgggtgctcaagaccctgatggccgcggtcgacggcaagccggtctgcctcctcgtcgcctccgacagggaggtcagcatgaagcgggtggccgcagccttcggcggcaaggcggccgcgatgctgaaggtgcccgatgccgagcggctgaccggctaccatgtcggcgggatcagcccactcggacagaagaaggcggtgccgaccgtgatcgatgccggctccctggcgacggatgcggagatccacgtgaacggcggcgggcgcggcctccagatccgcattcggccggacgacctgctgcgggcgctgggcgcgcgaacggcggagctcgcttga

SEQ ID NO: 7859 - DNA, 1740 bp, Methylobacterium sp.
atggtcatcgggacttgcagtgccgccgcctggctcgactgccccggtctcgacgccgagcatgagccggatttctacaattcggcaggttgggcgccgccgccgaaggagatgccgcatccgccgtccgagtacgatttcatggccgtcgtgctcacgctccgagccgtgctgccggacgatgcgctctggaaactcggctacgacgacctcgccggacaccgcaaagcgctggaggaatgctgcgaacggatcgatcgcgcggtcgagaacctgctgcactggaaccggcgctacggtatcccggccttcgtagcgaatttctttatccctcagcacggtgcgatcggaaatcttctgccgcgctatgatctacgcaacgttgcgtttttcatcgaggagatcaatcgtcacctggaacggagtgttcggcgcttctcaaatgcctacatcttggacatggatcgcatcgcagcatcctacggccgtcggcgcatgcaggacgacgggtacttgctgacgagtcacggctccaaccagtgggaactgccgatcgacgaacggatcgaaccgatgggaccgctctcggctcatttcgatttcatgtctcagcgggaattcatcagtgcgctctgggctgagatggtcagcttgcaccgaactttgacgaaggtcgacgcggtcaagctcgtcgtgatcgatctcgacgacacgctctggcggggtgtgagcggcgacatcgccgacgtcgggattcatatgtacgaaggatggccgaccggcgtcgtcgaggcgctgatgtacctgaagaagcgcggcatcatgctggcgatcatcagcaagaacgacgagagccgtatccgtgagatctggccgtcgatcaccgacaatcgcataacgttgaatgatttcgccaccatccgcataaactggcgatcaaagccagagaatatggcggagatcctgagcgtcgtgaacgttctaccgagcagcgtcgtgttcttggacgacaatccggtggagcggtcggcgatgcagcaggcctatgcggaaatgcggattcttggccggcatccatggtactttcgccgtaccctgctctggtcagccgagacacaggtcgacgtgatcacgacggagtcaggctcacgaaccgagatgatgcgggcgcaattcgagcgcgagggtcagcgcaagcggctgagccgaaccgagttcctgacctcgctgtctttggaggtcgagctctacgaggtccaccgaggcgatccgcgctgggatcgcgcgttcgaactcctcaacaagacgaaccagttcaacacgacgggcgtgcgctggaccgcagaagccctgctgacgcgcctggaggcggggatgcgcgccttcgcgttcgatgtccgcgacaggttcaccaactacggtctggtgggcgtctgcctcgtcgacggcgcggaaatactgcagatggtcatgagttgccgggtgaacgggctcgacgtggagctcgcagctctcagccgactcacgacgctcctgcgcgcggccggagcgaaggacatctcggcggctctcgtcgagacaaagctcaacctgctatgccgagatctttggtcgcgctgcggcttccgcgatgatggcggcctatggcgcctcggcgtaggagatgcgcctccggagccggagttcatcacgatccgttcggatccgaggccaagaccggatcgatccggccgagattga

SEQ ID NO: 7860 - DNA, 1305 bp, Methylobacterium sp.
atgagttcggcgacggggcccggcggggcggatatcgagcgggtcgcgatcgacgacgccggtctcggcgccttctaccgcagcatgacgccacctgagcgccacaccttctgggcctgtgcggcgggctgggcgctcgacggcatggacttcatgatctacccgctggtgatcggcacgatcatcacgctgtggcaggtcgagcccggcacggcaggcctcgccgccaccgtgacgctgctggcctcggcgctcggcggctggctcgcgggcttcgtcgccgaccggatcggccgggtgctgaccctgcagatcaccatcctgtggttctcgttcttctcgctcgtctgcgccttcgtgcagaatttcgagcagctcctcgtcgcccgcgcgctgctcgggctcggcttcggcggcgagtgggcggcgggcgccgtgctgatgggcgagaccatccgagcgcagtatcgcgggcgcgccgtgggctcggtccagtccggctgggcgatcggctggggcatggcggtgctggcgcaggcggtcctgttcacgtggctgccgcccgagagcgcgtggcgctggatgttcgtgatcggcgcgctcccggccctcctcgtgttctacctgcgccgctacgtgcgggagcccgaggtcgccgccgagagccgggcgcgggccgccgcctccggcgaccggccgcggatctgggagatcttttcaggccccatcctgaagacgaccatcctggcctcgctggcctcggccggctgccagggcggctactacgccatcaccacctggctgccgcgcttcctcaccaccgagcgcggcctctcggtcgtctcctcgacgggctacctcgcggcgctcatcgtcggctcgttcgccggctacctcgtcggcgcctggctcgccgaccggctcgggcggcggccgctcttcctgatcttctcgctcggcgccatcgcggtcatcctggcctacacgcagctgccgctctcgaacgcggtgctctgggtgctgggcttcccgctcggcttcttcgcctcgggctacttctcggggatgggcgccttcctcaccgagctctacccgacgcgcctgcgcggctcgggccagggcttctgctacaatttcggccgcggcatcggcgccctgttcccggcgctggtgggctacctctccgcccagatcgggctggcggccgccatcgcgggcttcgcggccgccgcctacggggtgttcttcgtggccgccttcgcgctgcccgagacgcggggccgcgtgctccacgccgatgcctga

SEQ ID NO: 7861 - DNA, 1083 bp, Methylobacterium sp.
ttgtttgcccaggccagcgacgatcttggcaccgagaccagcctcgacgtggtgcgccgcatcatgtcgggcaatccgaccagcgtcctggcgttcgcccgacgggagggtttcgactgcgccgccccgcgggcggagggcgtcatcgcatggctgccgcttaccgcatccgggcacgctgcccttctcgacggcaccttcaacgtccccgatcccgacccggcccacctctcggctcagcatgagccgtccgcggcaatctatgtctgggcgatctacgcccccggcttggccggcggcgtcgggatcgcgttcgaccagatgtcgagcccgttgcaccggcatgccgatctctacgcgagggcggcatcgacgagcggacggcggctcatcaccggtctgggtttcgagccgttggacacggtggtgcccatgtcggcccctggtctctacgtcttccgcaagccgggctcctcgctcggccgcccgctctacgacagttaccccacgccggggcagcattatacgttcacggtcgtgcggacccacgacgacctcgccaaggtcatggccatccgcagcgccgtctacatcggcgagcaggcctgcccgttcgaggaagagttcgacggcaacgatttctcctcgacgcacctgatcggctacgccggggacgaaccggcggcctccctgcgcgtccgatgcttcgcgaccttcgccaaggtcgagcgcctggccgtgcgccaggagtaccggcgctcgcgattggcccccctcatcgtcaaggcggcccacgagctctgccggatgaagggctatgcgcgggtctacggacacgcccagaaggggctggtgaacttctggcggcgttccggcgcccggcccttccctggggcccgcgagttcgccttctccgaccacgagtatgtcgagatgctggccgagatcgaaccgcatccggacgccatcgccgtcggagccgacccctacgtcatcattcgcccggaaggccgctggcatgcgagcggcgtccttgagcggtctcgcctgcgtcccgtgacgcggccggggtcggcgcggtga

SEQ ID NO: 7862 - DNA, 264 bp, Methylobacterium sp.
atggccgacggcacgcagggactttccgacaaggcactctcgatcttcgccttcgcggcctaccaccgcctgctcagcggcgagcgcgtggcgtcggtgatccggaaggacggcgccggccacgaggccgacccggacggcgtcgccgaattggagggccggggcctcgtcaccgccagcgagaccagcatcgacctgaccgaggaggcgcagcgcttcaccgagacgctggtggaggcgatgcggcgcacggcgggcgcgtag

SEQ ID NO: 7863 - DNA, 1485 bp, Methylobacterium sp.
gtgcagttcggtgtgttcgaggagttgcacgccttcgtgtcgcggcacggcgtctcggacctcttcatgctgttcgccctgatggggctcgcgatgttcggcgcgagcgtgcgcaagtcgctgctgctgcgcgcggccctgcgcgagcgcgacgcggcggcccgggaagccgaatccatcgcccggcacgacgggctgaccggcttggccaaccgtcggctcttccatgaggccgtggaggcggagcgcgcgggcgccggcgcgctgccgagtcacgccgtgctgcttctggacctcgatcggttcaagccggtcaacgacatctacggccacgctgccggcaacgcggtgctctgcgcgattgccgagcgcctgcgccggctgatcccgacgagcggcgtggcggcgcggctcggcggcgacgagttcgccgtgctggtgccgctcgacgggggcagcgacgggctcgtacgtctcgcccaggcgatgatcgcggcgatcggtgaaccggtcctgtggtgcggcaatgcgctgaaggtcggcggcacggtcggcatcgcgctggtcgaggccgacatggcggatgccgacgcggtgctgcacgctgccgacctcgccatgtaccagggcaagaaggacgggcgcggcacgtacagggtcttcaagagcacgatggacctggagctgcgcgcccgcgcccagctcgagagcgagctgcgcgacgcgatccagcggggcgagatcgagccgttctaccagcccgtcgtggcgctgcccgagaagacgctgatcggggtcgaggtgctcgcccggtggcgccatccggtccgcgggctgctcacgccgaaccatttcatcggcatcgccgaggagaccggcatgatcggcgatctcagctaccggctgctgcggcaagcctgtctcgacgcccgcgactggcccgcgcaccttctgctcgcggtcaacatctcgccgcagcagttccaggaccgctggctgtgcgagcgcgttctgtcgatcctcacagagacgggcttccccccgtcgcgtctcgaagtggagatcaccgagagcgctctggttcaggatctggaggcggcccgcaccacgctgacctcgctgcagaacctcggcgtgcgcatcgcgctcgacgatttcggcaccggttattccagcctgtaccacctgcgcgagctgaagttcgacaagctgaagatcgaccggtcctacgtcgatacgatcacgatgagcgacgagcgggcgaaactcgtggacgcgatcatcaagctctcggcaagcctcggcctcgtgaccaccgccgagggtatcgagacggatgccagcgtcgactggctctcgggccagggctgcgatttcggtcagggctatctcttcggcgcgccgatgccgaagacggagctgacggcgctgctcgccgcgcccgacgcgcatgggatgagcgcggcgctgaaacaggtggcgtga

SEQ ID NO: 7864 - DNA, 1554 bp, Methylobacterium sp.
atgtcccctcccctcacccgccgccgcgtcctcgcgggcgccgccgccctcaccctcgcccggccgggcatcagccgcgccgccgaccggcccgcgctcagccacggcctgcaatcgggcgacgtctcgggcgacggggccgtcgtctgggcccgggccgaccggcccgcccgcgcggtgatcgagtgggcgacgaccgagagcttcggggacatccgcggcggcgtcttcgtcgatgccctcccggagagcgacctcacggtgaagacggccctgcagggcctgccgcccgaccaggacatccactaccgggtccggctccagaacctcgccgagccgacgatcctgggcgagcccgtcaccggccgcttccgcagcgcgccgatgcgggcccgcgacctcagcttctgctggtcgggcgacaccgccggccagggctggggcatcgacgagtcccgcggcggcatgacgatctacgccgcgatgctgaggaaccgcccggacttcttcctgcattccggcgacacgatctacgccgacgggccgatccaggccgaggtccggcttcccgacggcggcctctggcgcaacctcgtgacggaagagaaggccaagcccgccgagacgctcgacgagttccgcggcgcctacaagtacaacctcctcgaccgcaacctgctggcgatgaaccgcgagatcccggtcctcgcgcagtgggacgaccacgaggtcaccaacaactggtggccgggcgagccgctgacccgggccgagcaccgccgccgcggctacacggaaggcaacagcctcgtgctggccgcccgcgccacccgcgccttccacgaatacatgccgatgcgcttcgagccggccgagccgggacgcgtctaccgccgggtcgcgtacgggccgcatctcgacgtgttcctgctcgacatgcgcagctaccgcgggccgaacggcgccaacgacgagaccgaggcgagcgcgcgcacgcagttcctcgggcccgtgcagctcgcctggctgaagcgggcgctgaaggcctcgaaggccacctggaaggcgatcgccgccgacatgccgctcggcctcgtcgtcacgtacgacaccgatgagagattcggctcggaaggcgtggcgcagggcgacgggccgccgctcgggcgggaactggagatcgcggacctgctgcgcttcatccgcgaccaggacatccgcaacacggtctggttcaccgcggacgtgcactacacggcggcgcaccactacgacccgaacagggcccgcttccaggaattcgcgccgttctgggagttcgtctcgggcccgctccacgcgggcaccttcgggccggcgaagctcgacgacacgttcgggccgcagctgcgcttcgtgaaggccccgcccgacgggcgccagaacctgtcgccggccgagggctaccagttcttcggccacgtcgcgatcgcgggcgccacgggccagatgaccgtgacgctgaaggacgccgccgacacgaacctgtggcggacggtgctcgacccggcgtga

SEQ ID NO: 7865 - DNA, 822 bp, Methylobacterium sp.
gtggcgatcctgcgccaccccggtgccgcgctcggcctcgtcatcctcgccggcgcgatcggcgcggccctccttgcgccggtgctctatccggcctcgccctggcggatggtgcagcggcccttcatcccgcccttcaccctggaccgagtcccgctcgggaccgacgccctcggccgggacatcgccgccggcctgatgcacggggccggcgtctccctcgtcgtcggcctcgtctcgacgctcgccgccctgctgatcggggtgccgcttggcgcgctcgccggctatctgggcggccgggtggacgacgcgctgatgcgcttcaccgagctgttccagacggtgccgagcttcgcgctggccatcgttctggtggcgatcctccagccctcgctcggctcgatgatcctcgccatcgccttggtgagctggcccccggtgacgcggctggtgcggggcgaggtgctatcgctgcgctcgcgcgagtacgtgcaggcggcgatcgtcaccggccagaccaccttcacgatcctgcgccgggaggtcctgcccaacaccctgtcgccgatcgtggtgctggcctcgctgatggtggcgaccgcgatcctgctcgaatcctcgctctccttcctcggcctcggcgacccgaaccggatgtcctggggcttcatggtgggcgccggccgcaccgtgatccggcaggcctggtggatcaccgccttcccgggtctggcgatcctgctcaccgtgctcgccctcaacctgatcggagaggggctcaactacgccctcaacccgcgcctgtcccgggagcgctga

SEQ ID NO: 7866 - DNA, 1557 bp, Methylobacterium sp.
gtgtccgagccgatgaacggggccgagagcctcgtgcgcaccctggtggcgggcggggtcgaggtctgcttcaccaatccgggcacctcggagatgcatttcgtggcggccctcgaccgggtcgcgggcatggaatgcgtgctgttcctgttcgagggcggcgcgaccggcgcggcggacggctacgcccgcgtcgccgacaagccggcctcgacgctgctccatctcggccccggcctcgccaacggctgggccaacctccacaacgcccgtcgcgcccgctcgatggtggtcaacatcgtgggcgagcacgcgacctatcaccggcagtacgatgcgcccctgacctcggacatcgcggcgctggccgccaccgtctcggcctggacccgcaccggcacgagcgccgaggcggtcgcggccgacggcgcggcggcgatccgggccgcccgcaccgccccgggacggatcgccaccctgatcctgcccgccgataccgcctggcagccgggctccggcatcgctcccgtgccgccgatccccgaacgggcgcgggcgagcgacgaggcggtggcggccgcggcagtggcgctcctgagcggggagccggccctgctgcatctcggcgaccgggcggtgcgcggtgcgggcaagcgcatcgcggcccggatcgcggcgaggaccggcgcgaagctcctcgccatgcaggccaatgcccgcatcgaccgcggcacgggccaggtgccggtcgagcggctgccctacccgatcgaccaggcgatcgaggtcctgaagccctaccggagggtcgtcctcgtcggcgcgacgcggccggtcggcttcttcgcctatccgggcaagccgagcgtgctcacgcatcccgattgcgagacggtgacgctggccacgcccgaggaggaccagatcgaggcgctggaacggctggccgaggcggtcggcgcgccggacgacatcgacgtggtccagccgccgcggccggagcttccgggcgcgggccggctcgaggacgacgcgatcggccgggtgctcggcgcgctgatgccggagggcgcgatcgtctgcgacgagtcgctgaccacgggccgcaacttcttcgcggcgacccacggcgccgccccgcacagctggctccagctctccggcggctcgatcggggtcggcatcccgatggcgaccggcgccgcggtcgcggcgcgcgaccgcaaggtgatcaacctccaggcggacggcagcgccctctacaccgcccaggccctctggacccaggcgcgcgaacgcctcgacgtggtgacgctgatctggtcgaaccgcgcctacgcgatcctgcggggcgagctcgccaatgtcggggcgcacaatcccggcccgaaggcgctcggcatgctctcgctcgacgacccgccggtcgactgggtcagcctcgcccgcggctacggcgtcgaggcccgccgtgtcgagacgctggaggtcttcaccgacgtgttcgcgcacgcgctggcgcggcggggccccttcctgatcgaggtggcgctgtag

SEQ ID NO: 7867 - DNA, 1407 bp, Methylobacterium sp.
atgaccgataccccgaccgacctctccctcctgtccgccaaggccctggcggagggcatcgccgccaggagcttctcgcccgtcgacgcggtcgatgcgctgctcgcgcgggtcgacgcgcaggatcccaagctccgggccttcacggaggtctacgccgccgatgcccggctcgccgccgagggcgccgaccgggcgatccgctccggacacgcggtcggcccgctgcacggcgtgccggtggcgctgaaggacctcgtggacctcgacgggcgcatcaccatggggggctcggccgcccaccgggcgcgggtcgccaccggcaccgccaccgtcgcccggcgcctgatcgcacagggcatgatcgtgctcggcaagacccacacggtcgagttcgcctacggcggctggggcaccaaccagcatctcggcacgccctggaatccctgggatctggagacaccccgcacgcccggcggctccagcagcggcaccggcgtggcggtcgccgcccgcatggcgccctgggggctcggcaccgataccggcggctcggtgcggctgccggcctcgttctgcggtctcagcgggctcaaggtgacggtcgggcgcatctcgacccacggcatcgtgccgctctcgaccaccctcgacacgcccgggccgctcgcccgcacggtggaggatgcggcgctcctctaccgggcgatgtccggccccgacccgctcgacccgaccacgcggggcgtcgaaccccacgacccgttcccgaccctctaccgcggcgtgcggggcctgcggctcgcccgcatgcccgatgccgagcgcgacggcgtggatgccgccgtcctcgccgcctacgaccgggcgctcgacaccctcgcggacctcggtgccgagatcgtcacgatccgcctgcccttccgcttcgccgacctgttcgccctgagcgcgatcaccaacgccgaggcctacttcaccaatggtgcgctggccgaggacccggcgagcccgctcggcgacgcggtgcgggcgcgcatcctcgccggggcgaggctctcggcgcaggattatctcgcgacgatccggcggcgcgaggcgatgaagcgggccctcggcgcagccctggagggcttcgacgccctgctcacccccaccaccgagacggcggccatcccgctcgacagcgtggacgaggaccacctgccctcgcgcttctgccgcttcggcaacctgctcgacctctgcgggctcgccctgccgagcggttacacgcaggccggcctgccgctctcgctgcagatcgtctgccggggctacgacgaggccacggcgctgcgcatcggccaggcctaccagggggcgacggactggcacctgcgcctgccgccgggtatctctggctga

SEQ ID NO: 7868 - DNA, 1239 bp, Methylobacterium sp.
atgcccgcgcgcggcacggcgcgcgggaccgatgccgaacccgagaacggatccgccgccatgaagccctttaccttccagaccacgcccaacgtgctgttcgaggccggtgcctccaagaagctgcccgagatcgtggccggtctgaaggccaagcgcgtcctgctggtgaccgaccggggcgtgcgcgaggccgggctcaccgccccggccgagacggcgctggccgaggccggcatcgagatcgacgtgttcgacgacgtgaaggccgacccgccggccagcatcatcgagaccgcggtcgcccgggcgcgcgaggccggcaccgacctcgtgctctcgatcggcggcggctccgccctcgataccgccaagctggtggcctacctcgccaagtccgacgagcgcctcgacgacatctacggcgtcggcatcgcgctgggcgagcgcctgcccctgatcctcgtgcccaccaccgcgggcaccggctcggaggtgacgccgatctcgatcgtcaccacgccgaccaccgagaagaagggcgtggtctcccacaagctcctgcccgactgggcggtgctcgaccccgagctgaccctggggctgcccgcccacgtcaccgccgcgaccggcatcgacgcgatggtgcacgccatcgaggccttcaccagcaagaacaagaagaacccgatctcggaccagctcgccaagcaggcgctggcgctgctctcgggccatatccgcaccgcctgctccgagccgaagaacctcgaggcgcgctcggggatgctgctcggctcgatgctggccggcatggccttcgccaacgcgccggtcgcggccgtgcacgcgctggcctacccgatcggggcgatcttccacgtgccgcacgggctctcgaacgccctcgtgctgatgggcgtgatgcggttcaacctcagccacgcgcagggtctctacgccgagctcgcagccgtcctcgacgcggacgcggtcaacctgcccgaggacgcggccgccgcccgcttcgtcgagagcctggcggcgatctgccgggattgcaaggtgccggcctcgctcgccgaggtcggcgtgaagccggacgatctggaacggctcgccaccgacgcgatgaagcagacccgcctcctcgtgaacaacccgcgcgaggtcacccaccaggacgcctacgcgatctacgccgaggcgctcgacggcaaggtgcagcaggcggcctga

SEQ ID NO: 7869 - DNA, 1188 bp, Methylobacterium sp.
atgaccgacgccgtgatcgtcgccaccgcccgcacgcccatcggccgggcgcatcgcggggcgctgaacctgaccggcggggcggatctcgccgcccacgccatccggcacgccctcgaccgggccggcgtcgagcccggcgccgtcgaggaggtcgtcatgggctgcggctacccggaggccgccacggggggcaacgtcgcccggcacgcgagtctcgtcgccggtattcccgtgcagtcggccggcgccacggtgtcgcgcttctgcgcctcgggtttgcaggcgatcgcggacgcggccaagcgcatccggctcgacggcgtgccggtcgcggtcgcgggcggcgtcgagtcgatcagcctcgtccagccgcaggtgcggcgcgagctgacccgcaatgcgtggctggagcagaacctgccccagatctacatgccgatgatcgagaccgccgacatcgtggcggagcgctatcgtatctcccgcgaggcgcaggaccagttcgccctgctgagccagcagcgcacggccgcggcgcaaggagccgggctgttcgacgccgagatcgtaccgatagaagcgacgatggcggtaaccgacaaggccacgggcgagacccggaacgtcgggacccgcctgacgaaggacgagggcaaccgccccgacaccacgctggacggcctcgccaagctgaagcccgtgcgcggcgagggcgccttcatcaccgccggcaacgccagccagctctcggacggcgcctcggcctcggtgctgatgtcggccgaggaggcggcgcggcgcggcctgaagccgctcggcatcgtgcgcggcttcgcggccgccggatgcggaccggaggagatgggcatcggtccggtcttcgcggtgccgcggctgctcgaacgcaacgggctgaccgtggacgatatcggcctgtgggagctgaacgaggccttcgcctcgcagtcgatctactgccgcgaccggctcggtctcgatcccgataaggtgaacgtcaacggcggcgcgatcagcgtcggtcacccgttcggcatgtcgggcgcccgcctcgtcggccacgccctgctggagggccgtcgccgcggggtgcgctacgccgtcgtcaccatgtgcgtggccggcggccagggctgcgccggcctcttcgagatcgagcgggagtga

SEQ ID NO: 7870 - DNA, 1182 bp, Methylobacterium sp.
atggacctgcgcttcacccccgaggagaccaccttccgccaggaggtgcgcgccttcttccgcagcgagatcccggaggagatccgccgcaaggtctccgagggccgcgcgctcgcgcgcgaggactacgtcacctcccagcgcatcctgaacgcgaaggggtgggcggtgccgcactggcccaaggaatggggcggccaggactgggacccgatccggcgctacatcttcatggaggagctgatgcaggcggcggtgccgctgccgctgcagttcaactgcttcatggtgggccccgtgatcgcggccttcggcaacgatcagcagaaagcgcgcttcctgccgcgcatcgccaacctcgacgactggtggtgccagggcttctccgagcccggcgccggctcggacctcgcctcgctgaagacgcgggcggtgcgggacggcgatacttacgtcgtggacggccagaagacctggaccacgctcggccagtacgccgactggatcttctgcctcgtgcgcactgatccggcggcgaagaagcaggccggcatctccttcctgctcatcgacatgaaaagccccggcatctccgtgcgcccgatcatcacgatcgacgggcgccacgaggtcaacgaggtcttcttcgactctgtccgggtgcctgccgagaacctcgtcggcgaggagaaccggggctgggactacgcgaaattcctgctcgccaacgagcgcaccggcatcgcccgcatcggcctaacgaaggagcgcgtcgcccgggtgaagcggctcgcgaaggagaccccagcgggcgcaggcacgatgtgggacgacgccgatttccgggctcgcgtcgccaccatcgagatcgagctgaaggcgctggagatcacccagatgcgggtggtggcggcgcagggccggcgcgatccctcgaagcccgacccggcctcctcgatcctcaagatcaagggctcggaactgcagcaggccgcgaccgagctgctggtcgagctcgccggtcccttgagcctgccggcgccggtggcgaacgacgtcgacgcgctgggctgggaggctttcgcggcgccgacctacctcaacacccgcaaggtctcgatctacggcggctcgaacgagatccagcgcaacgtgatcgccaaggcgatcttggggctctga

SEQ ID NO: 7871 - DNA, 1155 bp, Methylobacterium sp.
atggatttcgatctcaccgacgagcagagcctgctgaaggacagcatcgcccgctgggcggcctcccgctacggcagcctggagcaggtcgaggccgcgcgccgcaggccgcagggcttcgacgaaggggcctgggcgcagctcgccgaactcgggctcctcggcctgcccttcgcggaagctgacggcggcttcggcggcggcccggtcgagaccatgatcgccgtcgaggcgctcggccggcacctcgcgcccgagccctatctggcgagcgtcgttctcggcggcggcgccctgcggctcgccggcagcgcggcgcagcgggaggcgctgattcccggcctcgccgaggggagccaccgtctcgccctcgcgcacggcgagcgtcaggcccgctacgaccgcgcggacgtcgcgacgacggcgcgccgggagggcggctcctaccggctcgacgggaccaaatgcgtggtgctgaacgccgacgcggcccggaccctggtggtcagcgcccgcacggccggcgggcggcgggatgcggccgggatcagcctgttcctcgtccccaccgacgcgcccggcctgaccctcaagccctacccgacgcgggacggcggccgggcggccgacctcgtgctggagggcgtcaccgtcccggccgacgcgctgctcggcgaggcggatgcgggcctgccggtgatcgagcgggtgctggacgagggaatcgcggcggtgagcgccgaggcggtcggcgtgatggaggcgctgcacgcgctcaccgtcgattacctgaagacccgcaagcagttcggcagcccgatcggcggtttccaggtgctgcagcatcgcgccgtcgacatgctggtctcgctggagcaggcccgctccatggccctctacgccaccatgatggcggggagcgccgacgccgccgagcgcgggcccgcggtctcggccgcgaaggtgcagatcaaccgctcggcccgcttcgtcggccaggaggcggtgcagctccacggcggcatcggcatgaccttggaatatctcggcgcccacctgttccggcgcctcacgacgatcgagtacctgttcggcgacacgccccaccacctgcgccgggtgagcgatgccggcggcctgctcggcgccgcctga

SEQ ID NO: 7872 - DNA, 816 bp, Methylobacterium sp.
atgagcgagatggccgaggctccgatcgattccgacaccgacgagggcggtccgaaggaggatcggcacttcgtgacggcgctcgcccggggcctcgccgtcctcgcctgtttcgggcgcgagcggcgcctgctcgccaatcacgacatcgccgaggcctgcggcctgccgcgctccaccgtgtcgcggctgacctacacgctgaccaagctcggctatctgcactacatcgaggagtcggggaaataccgcttcggcatgcagacgatcgcgctgagttccatggcgctcggcggcctcgacgtgcgtcagatcgcccgaccgatcctgcgcggcctggcgcagacgacgaacgcctcggtggcgctcgcggtgcgcgaccgactcagcatgcgctacatcgactgccatcggggaccggcggcgatctcactcaacatcgacacgggctcccgcctctcgatgacccgctcggccatcgggcgcgcctacatcgccgtctgctcggagcgggagcgcgccgggctctacgacgagctcgaagcctacgatccgctggcgtggccggccttgcgcgagcgcctcgacaaggcggtcgccgagcaccgggagatcggctgctgcacctccttcggcgagtggcaggaaaccgcctcggcgatcgcggtcggcttccacccgggcgccggattgcagccgatgtcggtcagctgcggcgcgccgaccgtcatcaccgatgcccgctacctgatggaggtggcccgtccgaagctcatcgaggccgtgcgcggcctcgagggcgtgatgggcgcctga

SEQ ID NO: 7873 - DNA, 147 bp, Methylobacterium sp.
atggccgccgcccgcagcgttctgaaccgtgtccgcacctacctgcgctaccgggacaccgtcgcacagctttcccgcctcagcgaccgcgagctcgccgatctcggcatcagccgctacgagatccgcggtctcgcccgcctctga

SEQ ID NO: 7874 - DNA, 1173 bp, Methylobacterium sp.
atggtcatggctgttacgacgtccggggcgctcgtcgagacgttggacaagctcgtcggcttcgagactgtcagcgcgcgcagcaacctggcgctcatcaaccatgtcgaggaccttgcccgcgcgcacggggcggagatcgaccgagtccctgcgcccgcggatgacaaggcggcgctctggatcacgatcggcccgcgggacgtgccgggctacgtgctctcgggccacagcgacgtcgtgccggtcgacgggcaatcctggtcgagcgaccccttccgcctgaccgagcgcggcgggcgcctcttcgggcgcggcacctcggacatgaagggcttcgtcgcggtctgcctcgcgttgctgcccgagatggcggcggcggagctcgcccgcccgatccacatcgccctctcgtacgacgaggaggtcggctgcctcggcgtgcgcccgctgatcgcgcggatgcgcgcgcggggccttcgccccctcggctgtttcgtgggcgagcctaccgagatgggcgtggtcgtcggccacaagggcaagagcgcggcgcggctcaccttccgcgggcgggcctgccactcggcgacggcgccgcagggggtcaacgccgtcgagttcgcggcgcgcttcatcgaccatgtccgtctgagcgccgagcgcctggcccgcgacggcgcccgcgacccgctctacgacgtcccccacaccaccgggctctgcagcgtcgtccgcggcggaacggcgctcaacatcgtgcccgatacctgcacggtcgagttcgagtaccgcgccatcgcggcggacgacgccggggcgctggccggtgccgcgatcacctacgcgaccgaggtgctgggcgccgagatggcggcgcgcgatcccgcctgcggcgtcgcggtcgagcccctcgtcgactatccggggctcgagctcgatccgcaggcggatctcgcgcggctggccaagcggctgtccggccgcgacgggcacgccaaggtgtcctacgggacggaggcgggcctgttccagacgctgggcgatgtcccggccgtggtgatcggcccgggcgcgatggcgcgcgcccacagggccgacgagtacgtcacgcgggacgagctggagagctgcgccggcttcgtccggcagttgatcgccgcctcgcgctga

SEQ ID NO: 7875 - DNA, 402 bp, Methylobacterium sp.
atgtcctctaccgccgacaagcccaacccgttcgacccgctcggcatcgccgctgtcatgggcgagtggtcctgcctcctgaaggcggcgcaggagctcagggacgtcgacgcggagatgatggacacgctgctggacgtcaacgtggccggtcccgcgccgctgggcccggaagccgccgcgaaggtgcgcagcatcgcgaacctgatgcggagcttgaacctcgactccacggccctccggcggcgcgagcccgagacgatgcgggagcttgaggcggcgtgcctgggctgcaaggaacgcggccgctgcgcgcgcgagctctgggccggcaccgccgctcgcagctacccagacttctgcccgaacgccgtgcgcctcgacaggctgcgcggtgcctga

SEQ ID NO: 7876 - DNA, 318 bp, Methylobacterium sp.
atgcattccgagcacgtgacgcacgttcaggctccacctcccaccgatcctgccgaggtcatcaagagcggcttcggtgcctggcgcgccttcgccatcgacctgccgctgcgcatcgccgccgagacgatgcgctttgcaggccaccgcttccagacacaggccgaccacctcacagcgttggccaagtgcggctcgctgaagaacgccgtcgaactccagaccgccttcctgaccaagggcgtcgccgactatcagacggagacggccaccctgtcgcatgaggtcagcgagcctgcactcgccaagacggcctga

SEQ ID NO: 7877 - DNA, 1116 bp, Methylobacterium sp.
atgcccgtctcccatgacgatctgctcgaattggtcgacgccgcgcttgcggccgactacacgcgcgtgcgccgcgtcgggagcaagatcgcaggcgacctcgacgatgagaacgtcgcgcgcgcgctgcgcaccctgatccgccgcaagggcgtgccgctgcgtgcctccggctacgcggagagcctgccggtcgacggcaagtcgcgcctacccctcatcgaagagctgtcttggccgaccacgccagtgttcctgagcgacgccaagggccccatggtcacgaccttcatcgaagacgtgcgcaatgccgacctcctatcgtccaaggggctcgcgacgcgcttatcgatgctgctctccgggccacccggcaccggcaagacgctgctcgccggccacatcgccgcgcagctcggccgccccctctacacggtgcggctggactcggtgatctcctcgcttctcggcgacaccgccaagaacatccgcagcatcttcgacttcgtgccgtcgcgcgaggccgtgctgttcatcgacgagatggacgcggtcgccaaggtccgcgacgaccgacacgagttgggcgagctgaagcgtgtcgtcaacaccgtcatccagggcctcgactccctcgacgaccgagccgtggtccttgcagcgacaaaccacccgcagcttctcgaccccgccatctggcggcgcttcccctacaagatcgacctcggtctgccggacgcggacacgcgatccgacatgtggcgccacttcctgttcgagggtgctgacggggcgcagcctctccaggtactggcgaccgtctccgagggcctgagtggggcggacatccggaacatcgctctgtcggcccggcgccacgccgcactcggcggcgggggcatagacgccggtgccgtggtctgggccgttctgcgcacccgcgaggggcagctcaccctgccgagccggcagggcgtctcggccgaacaccgcaaggaattcgccctgcgcctgaacgacatctccgtccgacaagccgagatcgcgcggctcctcggtgtctccaagccgaccgtaggcgcttacctgaaggagcctggtcatgccgccggatga

SEQ ID NO: 7878 - DNA, 228 bp, Methylobacterium sp.
acccgccgcaaggttctgctcggcgcgctcgtgctgcagcggctcgaggccggccacgatcccgccttcacccagcgcctaggcgactggctccgccgcgagctgccgggcttcctcatccgcgacgccgacagggtcctgttcgccgatctgatcgggccgccggcagacatcgcgtcggtgcaggcctcggtcgaagccgcacagggtcagaccgcagccgcctga

SEQ ID NO: 7879 - DNA, 318 bp, Methylobacterium sp.
atggcggatgcgctggtcatcgaggacgaggaagccctggcgctcgcgcgcgatctggccgagcgccgcgggacctcggtcgacgaggcggtgctgagcgcgctccgcacggcctcgtacgaggagatccgtgcccgaccggaaacgcaggcgcgtccgacaccgccgctcatcctgacgcccgatgagatgaatccggagcagcgcgcgcgctacgagcgccttcgcgcactgaccaagcgggccagcgcgttgaagaagcccggcgccacctccgatcacagcgatctctacgacgagcacggcttgccgatatga

SEQ ID NO: 7880 - DNA, 828 bp, Methylobacterium sp.
atgtcctatgagattccgaacgccgttcagggcgtggtcctggactgggccggaaccgtggtggatttcggttccttcgcccccacccagatcttcgtcgaggccttcggcgcgttcggcgtcgcggtcagcctcgacgaggcgcgcggaccgatgggcatgggcaagtgggaccatatccgcacgctctgcaacacgccgcagatcgccgcgcggttctccgagacgttcggccgcgcgccgaccgatgccgacgtgaccgcgatctacgagggcttcatgcccctgcagatcgagaagatcgccgagcattccgccatcatcccgggagccctcgacgcgatcgccgccctgcgggcccgcggcatcaagatcggatcctgctcgggctatccggcccgcgtgatggagcgcgtcgtggcgctcgcccggaccaacggctacgtggccgaccacgtggtcgccaccgacgaggtgccgaacgggcgccccttcccggcgcaggcgctcgccaacgtcatcgctctggggatcgacgacgtcgccgcctgcgtgaaggtcgacgacaccgttccgggcatcctggaagggcgcaaggccgggatgtggacggtggcgctcacctgctccggcaacgcgatgggcctgagctacgaggcctatcgggcgcttccggccgagcggctcgcggccgagcgcgcccggatcgcggccctgttcgccgattcccggccccacttcctcatcgacaccatcgccgatttgccgggcgtgatcgccgacatcgaggggctgctcgcggccggacgcgtgccgcaggcctgctga

SEQ ID NO: 7881 - DNA, 1098 bp, Methylobacterium sp.
atggcgcccctcctcgaacgcgccttgggcaccctcgtgatggggggcatcctcctcgacgtgttcctcaccgtgctctacgcccgcatcggcaccggtctgatcgccgagcgcgccgcgcggctcgcctggatcgccttccgccgcgctgccgaggcggccggtgcgcgacgcgggacggttctgtccttctgcggaccggcgatcctcctcctctacgtcctgctctgggccttcggcctgacgctcggcgccgggctcatcatacatccgggtctcgggacaggcgtgcaggcgggcgacggtccgacacccgaagacttcctgaccgcgctctacgccggcggcagcagcatggcgatcgtcggcgcgagcgacttcaggcccacgagcgacgcctaccgcgtcgtctacctggtgaactccctgatcgggctgtcggtgacctcgctggtcctgacctacgtcatgcaggtctacggcgccctgcggcagcgcaacgcgctcggtctgcagctccacctcctctcgggtgggacctccgacgcgggcgagctgctggcgcgcctcggaccacgggcacagttcagcgccggctacacgcatctcgccacgctcggcgacgcgatggccgcgatgaaggagacgcaccacttctacccggtcctgttctatttccgttttcggcaaccctactattcggtctcggcgcaggcccagctcgccctcgatacggtctcgctgatccgcagcacgctcgcgggcgaggatacggcgtggttgaaggacgccgcagcggtcgaggcgctctggcgggtggcccagatgctggtcgtcacgctcgaaacggctttcctgccgggcgatccggtggtcgccagaaccatcgatcctcgcgagcggcagcgatggcgcgcgcattgggagcgggcggtggcgcgtcttgccgaggcaggcatcccggtcgcgaagcaggagatggcggcgcaggcctacctcgacttgcgcgcccaatggtggccgcacatcgctcgacttgccccggcgatggcctaccggagcgaggacatcgaggcgcaccgatcggagaactcctaa

SEQ ID NO: 7882 - DNA, 1344 bp, Methylobacterium sp.
gtgacgaccgtgaccttgcgccttcgcaccctcctcgccaccgcggcactctcgctctgcctgcccctcggcctcgtcgcctcggctgaaaccgagccggcacccgtccagaagaaggacgtcgatacgcctcaagcggtggaggccccgaagacggcgcccgatcccgccatcgagcgcgggcgctacatcgccgtggccgccgattgcgtggcctgccacagcaatccgaagagcgggaaaccgttctccggcggttatggcctggaaaccccgttcggcacgcttttgtcgagcaacatcacctccgacccggagacgggcatcggccgctggaccgaggcggagttcacgcgcgccctgcgcgaggggctcggcaaggacgggcagcacctctacccggcgatgccctacacgagctacaccaagatgtccgatcaggacgtccacgacctgtggctctacatgaagacggtgccgccggtccgcaacgccgtcgtcaccaaccagcttccgttcccgttcaacatccgcgccctgctgatgggttggaacctgctgttcttcgaacagaagcggttcgagccgagagccgaccaatccgccgcctggaaccgcggcgcctacctctccgacgccctcggccattgcggcgcctgccacacgccgaagaacgtcctcggcggcgacaagacgagcaaggcctatcacggcgaggttctgcaatcgtggtacgcccccgacatcaccacgagcaagaccggcggtatcggcgactggtcgaagggtgacatcgtccagtatctcaagatcggcagcaaccggatggcggtcgcctcgggtccgatggccgaggcggtgacgaactcgacccagcacctgaccgacgccgacctcgcggcgattgccgactatctccagacgctgccgccgggccccgccaccgaggcgccgcgcaccgccgccaccggagcggtcatggcccagggcaagcgcgtcttcgacgcgcagtgcaaggcgtgccacgcctccgacggaaccgggatccggcacatgacgccgagctttcccggcaacaccgccatccagtcgcacgaggtcgccggcatcgtccggaccgtgctggcgggcgcgcgcggtgcgatcacggccgagaacccgacgggagcggcgatgccgtccttcgcatggaacctgtcggaccagcagatcgctgcggctctcacctacatccgcaatagctggggcaaccgcgccccgcccgtcaccgccgaggcggtcgccggcacgcgcaagagtctcaacctcaacgccgtcgggcgtgcaccccatccggcgcattga

SEQ ID NO: 7883 - DNA, 318 bp, Methylobacterium sp.
atgacgtcccacgcgcaccacgagttcggccggcctccgcatccgcaggtcgaggacgaggattggtacgacgacgggtatgacgcgcggccgcgccgcggtgtcttctcgcgcctgttcgggctcctgaagctcgccgtcttcctcacgccgctcgggatcttcctctacggctacttcgtcgccgattgccgctcgggcggcggcacggggctcggccagatcgtccaggcgggcgtctgcgcacgcggccagatcgtcgacagcgccggctccctgggcgacgggctcaggctgatccgccgcgtcatcgagtga

SEQ ID NO: 7884 - DNA, 1596 bp, Methylobacterium sp.
atgccgatgaagaacgcgctgctcgccgccggacttgccctgggacttctggggggatcctccctcgcacaggcccagaatgtcttccgcttcgccttccagggcgacatcaagtcgctcgatccctactcgctgaaggagagcttcacgatcgggatgcacggcgccgtctacgaagcgctgatcatgcgcgacaaggacatgaagttcgtgcccgcgctggccgaatcctgggagacgccggagccgacgcgctggcgcttccacctgcgcaagggcgtgaagttccacgacggctcgcccttcaccgcggacgacgtgatcttctcagtgcagcgcgtgcgcgcgccgggctcgaacttccagacgaacgtgccggccgatgccgagttcgtgaaggtcgacgactacaccgtcgacatgaagctgaagacgccgaacccgatcgcgatcgcgcagtttccgacctggtacatcatgtcgaagacctgggcggagaagaacaacgcggttcagccctcgccgccgaccgctacgtcaccgagctacgccacgctccacgagaacggcaccgggcccttcatcgtcacggagcaccagccgggtgtgcgcacggtgttcaagaagttccccggctactggggcaaggtcgagtcgaacctcgacgaagcggtcttcaccaccatcggcaactcggcgacccgcgtcgctgcgctcctctccggtgaggtcgactggatcgatcccgtgccgctgcaggaccagccgcgcgtggaatcgagcggcaacgccgtggtcatggccgggccggagctgcgcacgatctttctcggcatggaccagacccgggacgagttgaaggattcgagcgtcaagggcaagaacccgttcaaggacaagcgcgtgcgcgaggccttctacctcgccatcgacgaggacacgatcgccaagcgcgtgatgcgcggacaggcgacgccctccgcgatcctgatcgcgccctcgctctacgaccggtcgggcgagttcaagcgcccggcctacgatccgaagaaggccaaggcgctgctcaccgaggcgggctacccggacgggttcagcctgaccatggactgcccgaacgaccgctacgtcaacgacgaggcgatctgccaggccgtcgtctcgatgctggcccgcgtcggcgtgaaggtgaacctgaacgcccagccgaaggcgaagtacttcgccaaggtgctggcacccggctacgacacctcgttctacctcgtcggctggacgccctcctcgcaggacagccacaacatcctgtacgagatcgcgggctgccggaacgacccgaaatccggccgcggcggctggaacctcggcaattactgcaacccgaagatcgacgagatcgccgacaaggtcgagcaggagaccgacaaggccaagcgcgacgccctgatcaaggagggcttcgacacgatttctgccgactggggctacatcccgctgcaccagcaggcgctcgcctggggcgtgtcgaagaaggtcacgctgacccagcgcccggacaactacctctacctctactgggtgtcgaagaagccctga

SEQ ID NO: 7885 - DNA, 981 bp, Methylobacterium sp.
gtgctcgcgttcctgatccgccgcctcgcccaggccttcgtggtactgggcgtggtgggcctgatcgccttcgccatgttccggttcgcgggcgaccccgtgaaccagatcgtcgggccggacacgccggtctccgagcgggccgagatccgcaaggcgctgggtctcgacgacccgatgctggtgcagttcgggcgctatgccggcaacgtgctccggggcgatttcggcatctcctaccagttccggcagccggtgacggcgctgctcgccgagcgcatcccggcgacgcttgagctggcgttctgcgccacgctcttcgcgctcggcgtcggtatcctgatgggggtctactgcgcgctcaaacgggacaccgtcctcgccaagctgttccaggcggtctcgctcatcggcgtctcgctgccgaccttcctgatcggcatcctgctgatcttcctgttctcggtcacgctgggctggctgccgagctacgggcgcggcgataccgtgcggatcgggggttggactacgggattcctcaccgtctccgggctcaaggccctgatcctcccctcggtcaccctcggcctctaccagatgaccctgatcatgcgcctcgtccgggccgagatgctggaggtgctgcgcaccgactacatccgcttcgcccgcgcccgggggctcaccacccgcgcgatccatctcggccacgcgctgaagaacacgctcgtgccggtcatcaccatcgcggggctccagctcggctcggtcatcgccttctcgatcatcaccgagacggtgttccagtggcccggcatgggcctcctgttcgtccaggccgtgcagaacgtcgatatcccgatcatgtcggcctacctgctgctggtggccgcgatcttcgtgaccatcaacctcgtggtcgacatcctgtacacggtggtcgatccccggctccgcaccagcgtggggcgcgccgcatga

SEQ ID NO: 7886 - DNA, 657 bp, Methylobacterium sp.
atgatcgaccagaccctgcgcgacgcgctgctcgcggtgagcccggggagcctcgcccgggcgctcgcccgacgcggcctgcgggcccatgccttcgcgggcctggaggtccggtcctcgacccccgttgccgggccggcctacacgctgcggctgatccccgcccgggacgaggccgcgggcgacctcgcgcgggcgatcgggcaggtgccggcgggcgccgtgctggtgatcgacgcgtccgggacaggcagcgccctgcccttcgccgccgtcctcgccgccgccctggcccgggccggcgtcgccgggctcgtcaccgatgcgggcgtccccgacgacctcgcgcttcccgtctggggccgcgatccgggtcggtcgccgggcggcatcggcctcgcgctggcgggaacggccgagcccgtcgcctgcgcgggcgcggcggtgcatccgggcgacatcgtggtggcggggcccgacggcgccgtggtcgtgcccgccgacatggccgagtcggtcgcgctggaggcggtcgagcagcagcggctcgatctctggctcatgcgggaggccgagaagggcgtcggcctcgccgccctgttgccgccggacgcggagacccgcgcccggttcgaggccgagacgaagtccgcgtga

SEQ ID NO: 7887 - DNA, 1278 bp, Methylobacterium sp.
atgctgcgcgcggtcggaaccgttccgcgggagtggggattgcgcgcgccctcgagccttgacgccgcggtcgcggatctgcgcgatctcgcgggcagcgacacgcggctctaccggctcgcccgactggcgagcctctggctcctgcccgtgatgctggggatcgtcctcaccggcttcgagctgggcccggcgccgggacgcgactgcgccggcaacgcgctgggggtcgacttcacccaggtctgggcggccggccaggcggcgttgcggggcggggcgggcgagccctacgacctgccgcgccacctccagaacctgcgcgaggccttcgggccggagtgccgcttcgcctggcattacccgccggtcttcctgctgcccgccgccgcggtggccgccctgccgccgcccaccgccttcctggcctggacgctcgcgggaaccgcgctcttcgccctggcgctccgcttcgcggggggccgggccgcgctcctcgtcgggctcgcccacccgctggtcttctgcaatctcgcctacgggcagaacgggctcttcaccgcggggctcctgaccctcggggcgctcctcgtcgaccggcgcccgctggtggcggggctctgcttcggcctcgtcgcctacaagccgcagctcgccgcgctcgcgcccctgctgctcctcgccaccgggcgctggcgctgcctcgtggcctgcgccgcgacggtcgcggccctctgcctcggcgcattcctggccttcggcagcgcgccctggctcggcttcctcggcacgctcggtgagaccgaccgcatcatcctgcgccaggcggcggcgggcctcgacctcaacgccagcgcctacggggcggtgcggttggccggcggtcccttcgcgctggcctgggcggcccagatcgcggcgagcctcggcgccctggcgctggcctggcgggtctgggcgacctgcccggacccgctgctgcgggccgcgaccctgctcgccgccgccccgatgctctcgccctacgtgccggtctacgacctcgcgccgctcgtgcccgccacggtgctgctcgtggtggctgcgcggcgggccggcgggttgcacgcgcacgagcgctggctgctgatcgctagcccgctcaccgcggcgctccgggtcggtgcggaggcgaccgggatcggcttcggcctgatcttcgcgctggcgacgctcgcctgtctggcggcccgcgccctgccgcgagcggcgccgcgcggcctcggggcgctgccctga

SEQ ID NO: 7888 - DNA, 801 bp, Methylobacterium sp.
gtgagctccgacgacatcccgtccgcccgcgccatcgccgcacgtcggcatgacgagatcctgaagcggctcgcggccgacgggcatatcagcgtggaggagatggcggcccgcttcgcggtctcgcgcgagaccatccggcgcgatctcaaggcgctggctggtcgcgggcagctcgcgatcgtgcatgggggcgcgacccggcgctccgatgagccggcgctcgccgtgcgtcgcgaggacaacccggccggaaaggcggcgatcgggcgggccgcggccggcctcgtcgaggacggcatggttgtgctgctcgattcgggctcgaccacgctggccgtcgcgcaggcgctcgccgcccgcggcctgaccgcctggcagggcctgacggtgtgcaccaacagcctgtcgatcgggctggtgctgtgccgggtgcccggcatccggctgcatctgctcggcggtgaggtcaacggcttggacgaggcggccttcggcaccgaggggatcgccgcgctcgcccgcttccgcgccgatatcgccttcatcggggtcggcggcgtctccgagtccggtgacctcaccgatttcgcggtgctgcccacggagctgcgcgcggcgatgctcggtgcggccgaacgcggcttcatcgtcgtcgatcgaacgaagttcggccgcctgaccccgatccgcctccagcccatccccgccggcacgagcctcatcgtcgatgcggccccacccgcgcccatggcctcggcgctggcggcacgggatctcaggatcgtcgtagcgcgctga

SEQ ID NO: 7889 - DNA, 891 bp, Methylobacterium sp.
atgagcgcgacgccagacccgatccccgtctgccccgcccccgacccgagcccgcgcggcccgacgcgctaccgggtgccgatgggcgcggtcgacacccacgcccacgtcatcggcctgccgccggtctacccgctggtgcccgagcgcagctacaccccgcccgcggcgccggccgagcgctacctcgcgatgctcgacgcgaccgggatggcgggcggcgtgctcattcaggtcagcgtgcacggcaccgacaaccggcgcatggtcgagaccctgcgggcgaacccggagcggctgcgcggcgtcgcggtgatcccgctcggcctgcccgaccgggagctcgccgacctcaaggcggccggcgtggtggccctgcggctcaacgtgctgttcggcgggggcgtcggcttcgcggagctggaggcctacggcgcgctggcccgcgagatgggctggcacctgcagttcctgatcgacgcccgccagatgccgccgctggccgcccgcctcgcgcgcctgccggtgcccttcgtcgtcgaccatatgggccacatgccgaccgcggcggggctcgacgatccgggcttccgcacgctggtcgatctcgtgcgggacggggcctgggtgaagctgtcgggcgccttccgcacctcggtcgcgggcgcgccctacgcggacacggttcccttcgcccgcgcgctccacgcggcggcgcccgagcgctgcctctggggctcggactggccgcacgtcgccgcctgggcgggcccgccgcggatcggcgacctgctcgacctcgtggcggactggatcccggacgaggcggaccggcaccggtacttcgtggagaacccgcggcggctgtacgggttcggggaggctggctga

SEQ ID NO: 7890 - DNA, 1008 bp, Methylobacterium sp.
gtggaacacctccctgttgatcgggcggccaacgacctcgactggcacagcctgcggctgttcctggaactgtaccggtcaggcagcttccgcgcttgtgcggcggccctcgacatctcggtgaactcgctgaggaggcggatcgaggcgcttgaggcggcgcttcagtttcccctgttcatccggacggtcgacggcatccgtccgaccgcgggcggcgaatgcatcctgacggccgccgaggcgatggagcaggctgccttccaggtcctgcgagcgcgtgggggcatctcgacggatgtcgagggcgaggtacgcatcgccgtcacggagggcctcggcacggcgtggctcacgccgcggctcgtagacttccagaacgcttttccgaacctgcgcgtggccctcaactgcgccatgaactccgctgacgtgcttcggatggaagccgatgtcgcggttcagttgacccgtcccgaggccgccgacgtgaaggtagtgcgcctgggctaccttcacaccatgcccttcgcctcacgggcttacgcgggccgcaacggcctgcccacgaacgtggaagagctcgtccagcaccggctcatcctccagatcgcggagcaggccgcccacctgtcgatcttcggggacatgctgccgcggttcccgtacccgccctcggttcccatcacgacgaacaccagcagcgcgctcgcgctggccatcgccaacggcgcggggatcggctggttgccgacctatgtcagctcgctccaagcgggcctgctgcccgtggattgcggcctccagttccgtttcgacgtctggctgacctaccatcgggatctcgaagccatcccccgggtgcggcagacgatcaactggatgaaggcctcgttcgacgcgcgcctctacccgtttttcggggaggatttcgttcatccccgggacctgccgaccgtcgaccgccacatccccctgtcggaactctacaaaggcttcgtcccgtag

SEQ ID NO: 7891 - DNA, 669 bp, Methylobacterium sp.
atggataccttgtcgctcgtcctcgaaaccttcgcgccgatcgaggggcggcggatcctcgatatcggctgcggaccgggcgtgctggccggggcgctggtggcgcggggcgcggcggtgaccgggatcgatccgggcgaggccgcgatccgcgacgccgcggcgcgggtgccgggcgccacgttcgagcaggcctcggccgaggcgctcccgttcgaggccgcacgcttcgacggcgccgtggtgctcaacgccctccaccacgtccccgacccgggtgccgcgctcgccgaggcggggcgcgtcgtcggtccgggtcgccccgtggtggtggtggagccgctcgccgcgggcagcttcttcgccgcgctcaggcccatcgaggacgagacggcgatccgggcggcggcgcaggaggcgatcgccgcggcgatcgcctcgggcgcgttcacctgcgcgcgggacgtcaccttcgagcggcacgagaccttcccggatctcgcggccttcctggaacgcgtgacgcgcgtggacccggcccgccgagcggcgatcgaggccgatcgggcggggatccgcgcggccttcgagggcgccgcgctgcgcggtgaggacggctacggcctgacgcagcccctgcgggcgcacgtgctgatcccggccgcctga

SEQ ID NO: 7892 - DNA, 1599 bp, Methylobacterium sp.
atgacgctcaaacgtgcactggccaccctcgccctgctcggcggcctcggcgcaccggccgaggcccagacgacgctgcgcatcgccatgacggcgagcgacatcccgaccgccaccggcatgccgaacaacggcttcgaggggatgcgcttcctcggctacccggtcttcgaatcgctggtgctctgggacctcgaccggaccgaccgcccggcggggctgcggcccggcctggccacccgctgggagcaggcggcggacgacccgaagacctggatcttccacctgcgcgagggcgtcgccttccacgacggcacgcccttcgacgcggacgcggtgatctggaatctcgaccgctacttccggaacgacagcccgcacttcgaggccccggcggccggcatcacccgggcacgggtgccgctgctcgccgcctaccggaagatcgacgaccgcacggtggcgatcaccaccacgcaggcggcctcgtacttcccctacatggcggtctacatcctgttcacctcgccgcgctccttcgcggcggcggggggcgactggagcaaggtcgcggccctgccggccgcgggcaccggcccgttccggatcacccgcgtcgccccgcgcgaggcggtcgatctcgcccgcaacgacgcctactgggacgcggaccggcgcgcccgggtcgagcgcgtgcgcctgatgccgatcccggaggcgaatgcgcggctggccgcgctccgcgcgggtcaggtcgactggatcgaggtgccggcctcggacggcatcccgtcgctgaaggcggcgggtttcgcggtcgccaccggctcctacccgcatgtctggccgtggatgtacaatatcggcgccaaggacagcccgctgaaggacgtgcgggtgcgccaggcgctgaactactgcatcgaccgcgacggcatcgtggcgctgctcaacggcacggccgagccggcccgcggctggctcaaggcgggcgacccggatttcggcgcaccgcagaaccgctacggcttcgacccgggcaaaggcaaggcgctgctggcgcaggccggcttcgacgcgagcaagccgctgcgcttcggcgtgatggtctcgacctcgggctcggggcagatgctgccgatgccgatgaacgagtacctgcaggagaacctgaaacaggcctgcggcgtcgaggtagccttcaccgtggtcgagtggcaggtgctgctgaccgccggccgggcgacgcccgacagcccgagcctgcagggcgcgatggctctcaacatctcgtcgccctcctcggatgccggcgtgatggcccgctacttcgcctccgaccgcttcccgccgaacggcttcaacttcccgaactggcgggacggggccttcgacgccgcgatgatgcagctcgccggatcgaccgatccgcaggcggtcgccgccgcgacccgcgcggcccacgagcgcctcgtggacgacccgccctggctctacgtggtgcacgacctcaacgcccgggcgatgtcgccccgggtcaccggcttcgtctccccccagtcctggttcctcgacctgacgcgggtggggatgaagtag

SEQ ID NO: 7893 - DNA, 1212 bp, Methylobacterium sp.
atgcgatttaccgtaggcgcgtccgcgctcgcgctggcctgcgcgctggcgctcacaccggcccgggccgcggacccgatcaagatcggcctgagcggcccctatacgggcggttcctcctcgatgggcgtctcgatgcgcgacggcgccaagctcgccgccgccgagatcaacaaggcgggcggcgtgctcggccggccgatccagctcgtggagcgcgacgacgaggccaagaacgaggtcggcgcccaggtcgcccaggagctgatcaacaaggagaaggtcgtcgccaccgtcggcttcatcaataccggcgtggcgctggccgcccagcgcttctaccaggaagccgagatcccggtattcaacaacgtcgccaccggcacgatcatcaccaaccagttcaaggagccggactacgacgcgaactacgtcttccggaactccgcctacgacgtgctccaggccggcctgatggtcgacgaggccctggcccagggccacaagaagatcgccgtactggccgattcgacgaattacggccagctcggccgcgaggacatcgagaagtacctcgccgccaagggcgtgaagccggtcgcggtcgagaagttcaacatcaaggacgtcgacatgacggcccagctgctcaagtcgcagcaggccggcgccgaggtcatcctggcctacggtatcgggccggagctggcccagatcgccaacggcatggccaagctcggctggaaggtgccgatgatcacgagctggccctcctcgatgcagagcttcatcgatatcgccggcgccaacggcaacggcgtgatcatgccgcagaccttcatcgaggatcagacgcttccgaagcgcaaggcgttcctcgagaactattacaagacctacggcgtgacgaagattccgacccccgtggcgggtgcgcaagggtacgactcgatcttccttctcgcggccgccatcaagcaggccggtagcaccgacggggcgaagatccgcgccgccctggagaacctgaacgagaaggtcgagggcgtcgtcaccacctacgacaagcccttcacggccaaggaccacaacgcgatctcgcggaacatggtcgtgttcggcaaggtgcaggacggcaagatcgtctacgccaagcccgaggacgcgaagaacgcgggcgtcgtccgcctcaaggagaagacctcgaactga

SEQ ID NO: 7894 - DNA, 873 bp, Methylobacterium sp.
atggccatcctgctccagctcatcgcgtccggcgtcgcggtcggcatgatctacgcggcgatcgcgttcggctaccagctgaccttcgccacctcgaagacgctgaacttcggccagggcgaggcgttggcgctcggcgccctgttcggcctgacgctcgtgcccttcaccggctactggctgatgatcccgctggtcctcgtcttcggcttcgcgctgggcgcggtggtcgagcggctcggcgtgcgaccggccgtgaagatcaagtccgagtacgggtggatcatggccaccatcgcgctcggcatcatcttcaagaacgtcgccgagaacgtctggggccgcgacgacctcaagttcccctcgccgctccccgaggaggccatccaggtcgcgggcatccgaatcctgccgatggagctgctgatcgtcgcgggcgcgctgctgatgatgctcgcggtcgagatcttcaaccgcaagtcgatctggggcaaggcggtcgtcgccacctccaacgacatcgacgccgccggcctgatgggcatcaacacccagcgcgtcatcaccctgtcctactcgatcagcgccatgacggcagccttcgcgggcgtgctcgtcgcccccgtgacgctcaccggcgccacgatgggcgcggtgctggcgctgaaggccttcgcggtggccatcatcggcggcctcgaatccggcctcggcgtgatcgtcggcggcctgatcctcggcgtcgccgagacgctgaccggcttctacatctcgaccggctacaaggacgtgccgggcctgatcctgcttctcgtcgttctctcgatccgccccgtcggcctgttcggcaaggcggtcatcaagaaggtctga

SEQ ID NO: 7895 - DNA, 1170 bp, Methylobacterium sp.
atgctgaaggccgcacttttggcagcgggtgccctgttcggactgatcggcgcggttggggctgacccacagcccgcaaccccgaacgtccctaccgccttcaagcccgcccaacgcgagggctacttcttcgtcggcggccggtacgtgaccgttggcggcaaggagatcgccaccgggcacatgttcgtgcagtaccatgccccggatcaggtcacgcagccctttcccgtcgtgctggtgcacggcaccgcgcagactggcgtcaacttcctgggcacgcccgacggccgaccgggctgggtgaatcgcttcgtcgagcgcggctttgccgtctacgttgtcgatcaggtcggacgcggacgctcgggcgacaacccagaggtctacggcccctacgcccggctcagcaccggcgatctcgagagcatcttcaccgggcaggaacggttcgacctcttcccccaggccaagctccacacccagtggccgagcgggccgggtgtgaagggcaacctcgccttcgaccagttctacctctcgcaggtgccctacatcgccagcgccctgaagagcgaggagctggtcaacccggcgttgatcgccctcttggagaagatcggcccctcggtggtcctgacccactcgcaggccggcgtcttcggatgggcagtgtccgaccagcggcccgaactggtgaaggcgcacgtggccgtggagcctaacgggccaacctttttcgacatcaagttcaaaggcggctcggattggtacgagcgcgtcggcgaggcgcgtgcccgaccctacggcattacccgcgtaccgttgcatttcgagccgcccgtgagcggcccgaccgacctcacggtggtccaggccgaccagccgacccgccccgatcagatccgctgttggctgcaagctgaaccggcccggcagttgccgcaactcgcgaaagtgcccgccgtcattgtgacgggtgaggcttcgttccgggcgacgatggacaactgcactgccgccttcctcgaacaggctggcgcgaaacctgatcggctggcgctggccgaccacggcatcaagggcaacggccacatgatgatgctagaggccaacaaccacgaggtcgctgacgcaatcatcggctggattcagggtaaggtacgctga

SEQ ID NO: 7896 - DNA, 1491 bp, Methylobacterium sp.
atgccaaccgccgccaacacttggcatcgcacccgcgcccgtctcaccgtcgctcacgtcaaggcggcgcagaagctcctcgcctccggccgcatagagggccgcggccacgagtgggccgacgagcaggagcgtggcctcgtgctgcgcgtcggcaaaaccggcggggcctggtacctaaagaccgaggcccgcaccgttcgcctcggcgacatggacctgccagtcgccgcggcgcgcgaggcggcgcaacgttcccgcgtcgacctgcgcgacggccgggtgccgagccgggcgaacctgcgcgtctggcaggaagcgcaccgtcgcggcctgtccccggccgatgccctcgacgcggcgttccccgaattcctcccggagcagagccaggaggagcggcgtcgggacgggccctgggagtgggccgacctcgtcgaactctacctggagaggaagctgccaaccctccggccgcgctgggccgggcagtacgagaagcacctgcggcggtcggtgacggacgacctcgcccgaaagctcgtggccgacgtcgaccaggccgacctgctccgtgtccgggacgacgtcgcccgggagcgcgcgccgagcgcggccgccgacacggtcgaggccgtcaaggcggcgctcgactgggcgaagcggaacgagccggttcgatccgggctcgcgtcgacgccctatccttggtggcgcgacggcctcaacgtcgagtggacctcgcgggcacgggaccacacccccaccctcgccgagctcgtccgaacgctgctcctcgccgagcgacaccgctccctcggcgggaccgcgaaggagaccagcaacgggacgctggccgccctgtgggccgtcgtcctcaccggccagcgggccggggctctgaccgggacgaagcgcgcgacggtccgggactggccggagcgccccggctggcaagtgtggacgtggaccgccgaagagatgaagggcggcaaggcgccgaggccgcacgccatcccggtcccgcccgaggccgtgggggtcatggcgcgattccccgtcgaccggagttcgccgttcctgttcccctcgcgcgtcaccggcaaggcggtctacccgacggtgcttacgcagctattcggccggctgcaaggcgatccgaaggggggccgcggcgggaaggtcacgatccgcccggaggccgatctgttcgccgccaacggaatccgcccgtggacgccgcacgacgtacggcggacgctcgggacctacctcgacctggagaagctgggtggtgcaggttcggccatcctggcgcacaaggcggccgcccggggcggggccgacgcggagcgcgagctcgcggccgccatcaccctcaggcattacattcattcgcagcgcctcgacctcaaagccgaggggatgaccgtttgggtgcaggcggttctcgacgcctacgaggccgagcgggcgagcctcgacggctga

SEQ ID NO: 7897 - DNA, 1056 bp, Methylobacterium sp.
atgtacgatacgccggccgacgcccgcgcccagctcgcccagcaggacttcacccgcccgcagatcgagatgatcgtgggtgcgctcgtgccgacgctgacgttccggccggaggcgggcggagcggcactccggatcggggccacccggatcggcggcacgcccgacctgccgcctggcctcgcatggcccgtccgcgcggcgccgccggacgccgaggccatcgccgggcgcggcaacgtggaggcggccgagggcatgcgccggcacttccgcgcggcgctgccctacgccttcttcgcgcaggtggacctcgccgaggcgcgggggcagggcggcccggccgcggacctccccgaggacgggcggctgctgttcttctacgatcttattgccgggccctgggacaccggcggcggcgccgtccgggtgatctgggacccgagcccgcgtgcggcgctggcggcgcaggccgtgcccgcgccgctcgccgccgccgccgcggcgcaccgggccgagatcgcgcaggtaaacgcggcgttcaagctgccgccgccgaagcccgaggcggcgacaccctacggcgcgcctgggcggccgatgcgtctcgcagcgcgcctgcgcccgccgaacccgcacagcctcgaatgggcgggttcggccaagctcagggccgcctatgcggaggaagaggcggacgattttcgtgaggcctacgacgatctgttcgcgcacgccttcgatccgcattacggggccgccaattccgggcgccgcaaccagctgctgggcagcccgctgcccgagcagggcgacccgcgctacgaggccgaggtggcgagccgcttcggcgtgcagcatctcgatgccgagacccggcgggcgcgctggccggagatcgaggccggcgcgcgcgactggcgcctgctcctgcagatcgacatcgccgacttcatgcaggcgcgggaggaggggaccgtgtacgtcctgatccgcgccgaggatctcgccgcccgccggttcgaccgggccgccgccgtctaccagcagacctga

SEQ ID NO: 7898 - DNA, 684 bp, Methylobacterium sp.
atggcggcccttgccggcaacgcctccaccgcgcaggctgcggaactcagcggcgagatgccctgggagcccggtcaggcgaacgttccgccgctgcccgattccgggtcggagcgcttcgtgttcttcacgcctgcggaagccgaggccgtgggcgccatggccgaccggatcatcccggcggacgacctgagcgtcggcggccgggaggcgggctgcgtccgcttcatcgatcgtgagctcgccggcccctacggccgggcggcgacgcagtaccgcctcggccgcttcgtcaagggaaccgccgagcagggcatccaatcccctctcgccccggccgaccgctaccggctcggcctcgccgccctcgatcgccactgccgcgcggcccacggcaagggctacgcgagcctgcccccggacgagcaggacaaggtcctctcggcgatggaggccggaacgctcgacctcggcgaggtcgatgcgaaggagatgttcgagcggatcctgcagaacgtccgcgaaggcttcctcgccgacccgctctacggcggcaacaaggatctcgtcagctggcggatgctcgggtttcccggagcacagtacgatttccgcgacgtcatcgacttgaagggaaagaagctcgacttcgttccggtcagcatgatcgacaagtccctttga

SEQ ID NO: 7899 - DNA, 876 bp, Methylobacterium sp.
atggacctcgcggacgcgggctcgcccgaggcgctcgtcaaacgcatcctccaggccgagccgaaccttcccgtgcccgtgccgatccaggaactttgcgcgcgtctcggcatcatcgggatcgaggacctcgacagcgacgcattcgagggcggcctcgtgaccgacgcaaagcggtccgaaggcaccatcctcgtcaagcgcgggggcgaaccgcgtcgccgcttcaccatcgcgcacgaactcggccacttcctgatggcgcaccacgtcccggatcagcccggccggttcctgtgcaagggtgcggacatgctccgtctcacggccaatgcgggcgaccagcggcagcgcatggaagtcgaggccaaccgcttcgccgccctcgtgctgctgcccccgcacctgttgcgaggggccatggcggcgtttcgtgagcctgatctgcagcacgttcgcgtgctcgcgcgcgacttcgcggtcggcaaggaggcggcggctcgggcctacgtgcagtaccacccggagcggatcgcggtcgtcgcagcgggcaagggccgggtgcagcggtgttaccgcagcctctccttcccggacatcatctgcgggatcggcagcccgatcccgacaggctcgctctatcacaacggttcgcatcggcccaacagcgcgagcgacattgccgcgtgccctcccgatctctggatcgacgtgaagcgcgacctccgcgcgccagccctctacgagcaggtgtaccttcagccgaacggcttcgcgatgatcctgctgcgtctggcccccgtcccggaagacagcgcggaggagcgcaggctcgaggagggttggcgtcaccgcttccactcggggcgacggtag

SEQ ID NO: 7900 - DNA, 240 bp, Methylobacterium sp.
atggcgatgggggagcaggttcgcgtccgcctcgtccgaaccccggacggacagcggctcgacataccgcccggcttcatgctgggcggggacgaggcgatcctgcgccacgacggagaccggctcgtccttgagcctgtccctgagctctccctcctcgcgatcctcgatcgcctcgatgatctcgatgaggattggccggagatcgtggacctgccgccggacatcgtgcggctgtga

SEQ ID NO: 7901 - DNA, 1014 bp, Methylobacterium sp.
ttgagcaagcgcgacatcatcgtcatcggcggctcatccggtgccaccgtcccgctgaaggcgatcctcggggcgctccccggcacgctcgccgccgcggtcttcgtggtgctccacgtcccggcccggagcctcggcctcctcgccacggtgagcgcggccgcggccgacctgccggtccaccccgccgaggacgggatgccgatcgcgccgggccacatctatctcggcgtgcccgatcaccacctcatcgtggcggacgggcggatccggctcgggcggggcccgcgcgagaacatggcccgcccctcgatcgacccgctgttccgctcggccgccgcgacctacgggccgcgggtgatcggcgtcatcctgagcgggctcctcaacgacggcacggcggggctcgacgcggtgcggcgctgcggcggcgtcgcgatcgtgcaggatccggccgaggcgatcgccgacgagatgccgaggagcgccctcgccgcggtggcggacggcctcgccgtgccggccgcccggatcggggacgtgctcgccgacctcgtgcaggagcaggcgggcccgcgcctgccggtgccgcccgagatccgcctggaggtcgacatcgcggcgggcgagcgggtcgacagcggcctgctgcgccgcttcgccaacccggccgccctctcctgcccccattgcggcggcgtcctctcggaggtgcgcggcgccaggcccctgcgcttccgctgccaggtcgggcacgcctacaccgcggaagcggccgccaaggcccaggagggcgcggtcgacgaggcgatgcgggtggcgctgcgcatcgtgggcgagcgggcggaactcgtcgcccggatggcggccgatgcgcgcgccagcggccgcgacgccgtcgccgagatgtacgaggcgcgcgcggccgagtatcgggaacacaccgacacgctgcgccgggcggtgctgcgggcggtcgagtcctccggcggcgacgggatgccggagatctga

SEQ ID NO: 7902 - DNA, 708 bp, Methylobacterium sp.
atgtcgcgtagcgccccggccaaggccatggacttcatcgcagccttcaacgacccgcaggctgccgcgcagtatgccgaggggccacgccgcttcgtgccgggctacgaggcgctgcatcggatgaccgcgatcctgctcgccgaaggtacgaggcccgatgcacgcgttctcgtgctcggcgccggcggcgggcaggaactgcgggcgttagccgaagcgcagccgggctggacgttcgtcggtgttgatcccgcgccagagatgctgcgcgaagccgcgcgggtgctcgggccgctcatggaccgggtgacgctcgtggagggctatatcgacgacgcgccggccggcccctttgatgccgccacctgcctgctgaccctgcacttccttgaggccgcggagcgcgcggcaacggtgcgcgcgatccaccagcggcttaggcagggtgcgccgttcgtcgcggcacacggaagttttccgcaggcggaggacgagcgcccgagttggctcgaccggtacgaagcttatgcggttgcctcgggcgcggatcgtgagcaagcccgcaaggcgcgcacagccgtcggcgcgcatcttcccaccctgtcgcctgagcaggacgccgacatcctgcgtgagggcggatttccagacgttgccctcttctttgcagcgttcacatggcgcggctgggtcgggcgggcctga

SEQ ID NO: 7903 - DNA, 708 bp, Methylobacterium sp.
atgtcgcttagcgccccggcggaagccatggacttcatcgcagccttcaacgacccgcaggccgctgcgcagtatgccgaagggccgcgccgctttgtaccgggctacgaggcgctgcaccggatgactgctatcttgctcgccgagggtacgaggcctgatgcgcgcgttctggtgcttggcgccggtgggggccaggaactgcgagccctggccgaggcccagccggcctggacattcgttggcgttgatcccgcatccgagatgctgcgcgaggcggcccggacgctcggaccgctcatggagcgtgtgacgctcgtcgaaggctacatcgacgacgcacctcccggtcccttcgatgccgccacctgcctgctgacgctgcactttctggaggttgcggagcgcgctgcgacggtgcgtgcgatccatcagcggctgaggccgggcgcgccgttcgtcgcggcacatgggagtttcccgcaggcagaacacgagcggccgcgctggctcgatcgctatgaagcctatgcggtggcgtcaggcgcggatcatgagcaagcccgcaaggcgcgcgcagcggtcggctcgcaccttcccaccctgtcgcccgaacaggacgcagacatcctgcgcgagggcggcttctcggaagtttccctctttttcgcagccttcacgtggcgcggctgggtcgggcgagcgtga

SEQ ID NO: 7904 - DNA, 810 bp, Methylobacterium sp.
gtgcggatcaccggcgccagcaagaacacggtcgccaagctgcttgtagacgccggccgggcctgcgccgcctaccacgacgcccacgtccgcggcgtccaggccgggcgcgtgcaggtggacgagatttggagcttcacccactgcaagcagaagaacgtcgccaccgcgaaggccgcgccggacgatgcgggcgacgtgtggacgtggaccgcgatcgacgccgacagcaagctcgtactggcctacctagtgggcggccgtgatgccgagtacgccaatgccttcatgctcgacgtggcggaccggttgaacggtcgggtgcaactcacgtcggacgggcacaagccctacctcgaagccgtcgagggcgcgttcggcgcagacgttgactatgctgtcctgcagaagacctatggcacggctccagaggccgccaaggggcgctacagcccgcccgtatgcaccggggcgatcaagcagcggattgagggcaagcctgacgacgcgcacgtctcgacgtcgtacgtcgaacgccagaacctcaccatgcggatgcatatgcgtcggttcacccgcctcacaaacgccttctcgaagaaggtcgagatccacgcctacgcggtggcgctgcacttcatgtactacaatttcgtgcggctgcacgagaagctacgggtgagcccggcgatggcggcgggcgtaaccgaccgactatgggagattgccgacatcgtgtcgctggtagaggcgatagatgctaagccgggcaaacgcggctcctataaagccaaagcgtttgaggtctaa

SEQ ID NO: 7905 - DNA, 1110 bp, Methylobacterium sp.
atggcttcctccgcccccatcctcctgacccctggcccgctcaccaccaccgagcggacccgcgcggcgatgctgaccgactggggctcctgggacggcagcttcaacggactcaccgccagcgtctgcgagaggctcgtggcgatcgcgaacggttccggcagccatgtctgcgtgccgcttcagggcagcggcaccttcgcggtcgaggcggctgtcggcaccttcgtgccgcgcagcggcaagatgctggtcctcgtcaacggcgcctatggcaaacgtctcgccaggatctgcgagatgctcggacgggaccacagcgtctacgagacgcccgaggacgtgccgacgacgccggaggccgtcgaccggctgctcagccaggaccgggcgctcacccatgtcgggctgattcactgcgagacctcgaccggcatcctcaacccgcttcccgagatcgccgccgtggtggcccggcacgggcgacgcctgatcgtcgacgcgatgagctcgttcggtgcgctcccgatcgatgcgcgggccatcccgttcgaggctttgatcgcggcctccggcaagtgcctggaaggcgtgccgggcatgggcttcgtgctggcgcgggaggaggcgctcctggcggccgagggcaacatcgcctcgctcgcgctcgatctgcgcgaccagcacctctacatgcagcgcaccggccagtggcgcttcaccccgccgacccacgtggtggcggccctgcacgaggccttgctgcagtacgaggacgagggcggcttggccgcccgccacgcccgctacgcgcgcaactgccggaccctgatcaccggcatggcgcgcctgggcctgcgcagcttcctcgcacccgagatccaggcgccgatcatcgtcaccttccacgccccgcgggacggccgctaccggttcggcgatttctaccaggcggtccgtgccaggggcttcatcctctacccgggcaagctcacccaggtggaaaccttccgggtcggctgcatcggggccgtcgagcccgccgacatggagcgcgcggtcgaggcggtcgccgagacctttcgcgacctcgacatcgagaccctctga

SEQ ID NO: 7906 - DNA, 882 bp, Methylobacterium sp.
gtgaacctgttccagctccgcgccttcgatgccgtgtcccgagagggcagcttcacgcgggcggccaagcggctgagcatcagccagccggcggtcacggggcacgtgaaggcgctggaggagcgctacgacctgatcttgttccgccgcaccgcccgcagcgccgagctgacgccccagggcgaggcgctggcggccctgacgcggccgctgttcggactggtcgagcaggcggaggatctcctgctcgccaaccgtgcgctcgtcaccggccggatcgaggtcgcggccgactcgccccatgtcgtgatgccgctgctggcgcgcctgcgcgcgcggcatcccgggatcaccgtgggtctgagcctcggcaacgccgccgagacctacgaggccctgctggccgagcgcgcgagcatcggcgtcgtgacggaggcggagcggcgcgacgagctccacgtggaggaactcgcggtctcgcatgtctgggccgtgctgccgcgcgaccatgccctcgccacggaagcgccgatcgatctcgacgccctcgacggtcagccgatggtgctgcgcgagcccacttccgtcacacggaggaccttcgatcgcgcctgccgcgcccgcggcatcgagcccgccgtcctgatggagctcgacagccgcgaggcggtgatcgaggccgccgcggccggcatcggcatcggtatcgtctcctccctcgaatgcggcgaggaccggcggatccgtaccgtcccgatcaccggggcggacctcacgaaccgccacgccatcgtgtgcctcgcccgtcgccgttcgctgcgcctaatccgggccgtgctggatctcgccgtcgaggggcagccgatcggaggacggccgtga

SEQ ID NO: 7907 - DNA, 261 bp, Methylobacterium sp.
gtgatcgtcgatgctgccggggcggcgcatcgcgccacccgcgtcgtcggcgccgcggcgcggcggctcgacgcgcaggaccgcctgctgcacgcgatcgtggcggcgctggcgcctccggaagcggagacggagggctcgggattcgaggacctgatcgccgtgctggccgacctgacggaagcggtcgccgacgtgacgcaggccgtgcaagccctgcgctccgacgtctccgcgcgcttccctacggtcagggcctga

SEQ ID NO: 7908 - DNA, 1743 bp, Methylobacterium sp.
gtgatcgtcggtctcggctggtgcggctcgctcatggccgaggagctgacccgggccggcctcaccgtcgtcgccatcgagcgcggcccctgggtcgagacggccgtcgatttcccgccctccgtcgatatggacgaactgcgctgggacacccggcgggcgatgctgctgccgccggcgatcgagaccatcaccttccgcaacgacccgacccagaaggcgctgcccgcgcgggactggaacttcaacgagtggggctacaatgtcggcgggtcgggcacccactgggccggcatggcgtggcgcttcctgccgttcgacttccagccctacagcatgaccgtcgcgcgctacggcgccgagcagctcctcgacggcctgatcgtgcaggattggggcgtcacctacgacgacctcgaaccgttctacgaccggttcgagaagatcgccggcgtgtccggcaaggccggcaacctcaagggcgagaagatccccggcggcaacatcttcgagggggcgcgctcggacgagtatccgctgccccccctcaagacgacccgcctgaccgacctgttcaccgaggcctcggccagcctcggctaccatcccttcatggttccggcgggccagacctcgggggcctacaccaacccgctcggcgtccggatggggccctgcacctattgcggctactgtctgtattacggctgcggcaactggtcgaaatcgacgcccaacaactgcgtcgtcccggcgctgatgcagcgcaagaacttcagcgtcctgaccgaatcgacggtgctgcgcgccaacctcgccccggacgggaccaccgccaccggcgtgacctacgtcgacaaggacaaccggacctgggagcagccggcggacatcgtcgtcttctccgccttccagatgcagaacgtgcggctgatgctgctctcgaagatcggcaagccctacgatcacgcgaccggcgagggcgtcgtcggccgggcctacagcttccagaccgtgtccggcgccaacatcttcttcgagaacgagtacctgaaccagttcatcggcgccggcgccctctcggcccaggtcgatgacttcaacggcgacaacttcgaccatgccgggatgggcttcatcggcggcgccggcatcctcgtcgtctcccgcggcgcccgcccgatcggcaatgccgacttcctcccgcccggaacgccccggtggggcagcgcgtggaagaaggcctacacccacagcttccagaacgggacgttcctgttcggccagggcacgagcttcgcgcacaaggacgcctatctcgacctcgatcccgagtacaaggacatccacggcctcccgctcctgcggctcacctacgactacaacgagaacgaccgccgctcggcgaagctgatcgaggacaagagcgtcgagatcggccggaagatgggggcgaaggtcgtcgtcggcacgaacgcgaccaaccagcacgcctcgccctaccagctcgccagcgaccacaccaatggcggcgcggtgatggggctcgacccgaagaccagcgcgctcaaccgtttccagcagagctgggacgttcacaacgtcttcgtcctcggcgcatcgtcctttcccaacaacgccggctacaacccgaccggaacagtcggcgccctgacgctctggactgcgaaagcgatcatcgagacgtatctcgacaagcgcggtccgctggtggcgaattga

SEQ ID NO: 7909 - DNA, 975 bp, Methylobacterium sp.
gtgcccacgcttctgcgtgaacgcgagccgctgcgagaccgtgcccgcggccgctggctgagcctgctccctcagctcggcgtggatgctcgcttcctgaccggcggcaagaacggcccctgcccgatgtgcgccggcaagacccgcttccgcttcgacgacaaggagggccgcggcacctggatctgcaacaactgcggcgccggggatgggcctgcgctggcgatgcgggtgctcggcatcgagttcaaggaactggccgagcggctggatccgctgatcgccgaggcgcctatcaccgccccgcggcccggacgctcggccgcggacaagcgcgaggccctgaaccagctctggcgccgggccagcatggtcgagcccgacgatccggtggcacgctacctccgcgcccgagtcggcctcatcaccgtgccgacctgcctccgctacgtcgacagcctgctctatcgggacgatccgtcctcctaccacccggcaatgatcgcgatggtggcgggccctgacggatcggctgccaccatccaccggacctacctgacccaggacgggcgcaaggccgccgtcgaggtgccgcgccgcctgatgccgggcacggtcccggacggcgccgcgatccgcctgttcccgccggccgtgaccatgggcatcgcggaagggatcgagaccgcactcgctgcggccgcattgttcgggctgccggtctgggctgcggccaacgccaccatgctcgcgaagtggcagccgcccgagcaaacccgcgaggtcgtggtgttcggcgacaccgaccggaagttcggcgggcaggcagcggcctacgcgctcgcccaccgccttgccatccacgaccgcaccgtccgcgtcgagctgccccgcgaggccggcaccgactggaacgacgtctggctccggcagcgaacggacaccgaggccagagcccttgaggccacggcctga

SEQ ID NO: 7910 - DNA, 981 bp, Methylobacterium sp.
atgagcgacactgtcctctccgtgcgcgacctgcgcgtcgtcttcgagacgcgccggggcacgctgaccgccatcgacggcgtctccttcgacatcgcccgcggcgagatcctgggcgtcgtcggcgaatcgggggccggcaagtcggtgacgggctcggccgtcatcggtctgatcgacccgcccggccgcatcgccgggggcgagatccggttgcgcggcgagcgcatcgacaacttggcccccgagaagatgcgccgggtgcggggccggcgcatcggcatgatcttccaggacccgctgacctccctcgacccgctctaccgggtcggcgagcagatcgtggagacgatccgcacccacaccgacctctcggccaaggcggccaggacccgggcgatcgacctcctcaccgaggtcggcatcccggcccccgagcggcgcatcgacggctacccgcacgagttctcgggcggcatgcgccagcgcgtggtgatcgcgctggcgctcgcggccgagcccgagctgatcatcgccgacgagccgacgacggcgctcgacgtctcggtccaggcgcaggtgatcacgctcctgaagcgcctctgccgcgagcgcggcaccgccgtgatgctggtgacccacgacatgggcgtcatcgccgaggccgccgaccgggtcgccgtgatgtattcggggcgcgtcgccgagatcggccccgtcgagagcgtggtgcggcgcccccaccatccctatgcccgcggcctgatgggcgcgatcccgacgctgagcgacatcgccgagcgcctgacccagatcccgggcgcgatgccgcggctcaccgcgatcccgccgggctgcgccttcaacccgcgctgcccgaacgtgttcgggcgctgccgggccgagcggcccgagccgctcccggtcgagcggacgcgcgtcgcctgccacctctacgacgagcgcggagaagccgcatga

SEQ ID NO: 7911 - DNA, 993 bp, Methylobacterium sp.
atgagtgcgggcgcctatgtcgcggtcgaggacctgcgccgggtcttcgacgtgtcgaagccctggctcaaccgggtgatcgagcgcgcgccccggcagactctcaaggcggtggacggggtcggcttcacgatccggcgcggggagaccttcgcgctggtgggcgagtcgggctcgggcaagtcgaccgtcgcccgcatggtggtggggctgctgccgccctcgtccggcgaggtgcgcatcgccgacatctcgatgaccgacccgcgccaggcggcggcccgccggcgcctgcgcgcccggatccagatgatcttccaggatccctacgcctcgatgaacccgcgctggcgcgtcggcgcgatcatcgcggaaccgatccgggccttcaacctgatccacggcgaggcggcgatccgctcccgtgtcggcgagttgctgcgcctcgtcggcctgcacccggacgacgcgcgcaagtacccgcacgaattctcgggcggccagcgccagcgcatcgccatcgcgcgggcgctggcgagccaggccgagttcctggtcggcgacgagccgacctcggcgctcgacgtgtcggtgcaggcccagatcctgaacctgatgcgcgaccttcaggaccggctcgggctgacctacctgttcatcagccacaacctcgccgtcgtgcgccacatggcgacgcggatcggcgtgatgtatctcggccgcctcgtcgaggtcggggacacggccgcgatcttcggtcgcccgcggcatccctatacccgcatgctgctcgacgcggttccggacctcgcccatatcggccgcgcccgcacaccggtctccggcgagatcccgaacccgatcgacccgccgccgggctgcaccttcaacccgcgctgcccgcacgcgaacgcgcgctgccgggccgaggtgccggggctcatcgacggcgtggcctgccacgcggtggaggaggggcgcctgagcgcctga

SEQ ID NO: 7912 - DNA, 366 bp, Methylobacterium sp.
gtgaccgcctatgtgagcgggaacgccgtcgcggcctcggctctcgatggcctgttgcgcgatgtggatcaggcgcttgctggactggcgcaaccgcccgcggtcaagatcagcaagcccagcccggcggagatccgcgcctcgatccggccggatggcttggtgagcttcgaggacgggcgggtctacaaggctctgcgccgccatctcaccacccgcgggctgacgccggaagcctatcgagcaaagtgggggctacctgtggattatccgctggtcagcgccgattacagcgcgcgccggtcgaagatctcgcacgccatcagtcgcaggcgggaaaccggcggacggctcgcggcggaataa

SEQ ID NO: 7913 - DNA, 423 bp, Methylobacterium sp.
atgcccaaaaccgctgcgctgtcggcgaagccgaaacagaccacggaaaccgatcacagcatcggcaaccgcatcgctcttctgcgctcggcgagcggcatgagccagaccatgctggccgacgcgctcggcatcagcttccagcaggtgcagaagtacgaggccgggaaaaatcggatcggcgccggccgcctgcgcgcgatcgcggatcggctgggggtgccggtctccgtcttcttcgcggaggatccgggaccagaggcgcgcgtcagcggcctcgacatgctgcaggagagcggcgcgctctctcttctgcaggcctacgagagcatagcggacgaggacatgcgccgcgagatcctgaacttggtcaaggcggccgcacgcatcagccagcgcacccgtaccgacgacgtgcagtga

SEQ ID NO: 7914 - DNA, 432 bp, Methylobacterium sp.
atgagcgagcaggggcggcagctggccgaggagaacatcgcccgggcacgggcggcctacctgcgctgcgtcgaggccggcgaggtcgccctcaacgccttcgaatcctccgccgcccggacggccggcctgatggggatcgggctcacggcggacggccgggacgccgacacccccgcggcccgcggctgggccgcgatgcgggcgatggcccagaccctgctcgtggccaacgacaccaacgtgcgggcgggcttcagcttcgcctcccggctggtgcgggcggaggatgcccgcgcggccgtcgacctccagagccgctacctgcaggagcagagcgagcgcttcgcccaccagatgctcgacctacagcgcacggcgctgcgcgcggccggcgacgtcgcgcgcgggaccggcgccgggccgctgtga

SEQ ID NO: 7915 - DNA, 186 bp, Methylobacterium sp.
atggccagatcgcagcagccggggcgccccagcgtggagccctgcaccgacaagcccggcacgttccggtggcagatccgtctggagaacgggagcgtcgtgcgcgcaccctacgccttcgcgacgcgcggcggggcggaactctccgccgatctgtgggtgaagcagttgcgcgcggcggcctag

SEQ ID NO: 7916 - DNA, 489 bp, Methylobacterium sp.
ttgcaccgcatcgctctggccgccgccctctcggcgagcgcgctctgcgcctccggggcggtggcgcaatccgccctcccctccgccgccgaggcggtgcggctggtgcgcgatcaccggaccaacggttccgtcacggtggcccagaccctggccttcgcggcgcgcgagcgccccgagagcttccgactggccgacatccgggccgagcggcgccccggcgagggcttcgcccgggtccggatctgctactggctgcgcccgcccggaacccgggcgttcccgggctgcgggatcggcttcgtggtcacgacgaatccgccgcatgtcgagccggaggagcgcttcgcggggctcggccgcgacctccaggacggacgggaggccttcctgcgcggcctcgaccgcgaactcgcgctgatcgccgatccgcagacgcggacgctgcgcaccctcctcgacccctacgacatctacgacgaccgctga

SEQ ID NO: 7917 - DNA, 468 bp, Methylobacterium sp.
atgaacagggagcgcctgatcatgatccgcgtgttcttcaacatccgcctcgacgacgcctatctgccggagcgcaccggccagtgggtggaggacgaggcggaggcgcgcgacctcgcgcgcatcatcgtgcgccggctcgtggccgatcacggcggcgagcaacgcctgctcaacgccgaactggcagtgaccgccgagggcggcgtcagcctgttcgacgtctcgttcttcgaggctctgtacgtcccggtggcctcgcccgagtcggtcgaacccctgcggcgcaccgggacgatccggccgcgctcgcgcctcggccacctgctcgcaccgtggcgggcggaggctctcgccctggcggcgacatggcgcgggcgcctcgccgggctggccgcccgcctctccggacgtgggggcgccgcaccgcgcgggcgcttccgtctcggcttcgagcacggggcctga

SEQ ID NO: 7918 - DNA, 441 bp, Methylobacterium sp.
gtgctcggcagcgtgacgacgatcttcggtgggctcggcgcgaggctggagcaggccctcgacgccaagggggcggacggcctggcgctggccgcggcgaagttcttccccggcggcctgccggccctgctggacgggctgcgtgcgcacggccacggcggggccgtggattcctggatcgggcgggacgcgaacgaggccgtcccggccgaggccttcgcccgccttctcccgcccgcggtcacggaggccttcgcccgcgatctgggcgtgcggcccgagcgggtgccggtggcgctcgcccagttcctccccgccgcggtcgaccgcgagagcccggacggcgaactccgcccgcagccgcagttcagcacgcaggcgatgcccggaacgccggacacgaccgaggcgacccgggccgcgaagatggctgcggagtag

SEQ ID NO: 7919 - DNA, 498 bp, Methylobacterium sp.
atgaccgcgtcgtccagcctgcccggccacaacgcgatgccgcgcgtggccgatgtctgcggcgacgacgcggacgtcctcgccctgtcggtcgtgcgcttcgtggcggccggctacatgacgagcgacgtggcctgctgggacgcggccttcgacggggccgagcggcttctcggggccgacgagggtgggcgcttcgtcgcatgcgcggtcgggatcgtgcgcgcgctgcgggcggagcgggaccgggactggtccttcatgcccgcgacctgctgccgcgtcaccgggcacgaatgcgccctggtcgggctgatcggtcgcggtcggcgctgcctctgggaggaggtggcgcggggagccgccgagatcaccggtcgagccgaggcaccgcggctcgtcgccgcgctccggacggcggccggagcgatcaatgcggcggcggaccggctcgggcccggcctgccgcgcaggccggcgaggagcgccctccactag

SEQ ID NO: 7920 - DNA, 312 bp, Methylobacterium sp.
atgacccacgacaccgacaccgaaatcgacgacgcggacgaggtgcgcgatctcgaagcggaagccaaggccaaggccgagaaccgcgcggagcgggcggagcgcgccgagcgcatggcccgcgagggcgcgcaggcgatggccgagcatctcgcgcagatcaaggtggtggacgagcgcacgacgcgcctgcgggccctgcgcctcgccaaggaggcggccgacgcccaggcgaaggctgccgaggaagccgccaaggccgaggcgaaggccgccaaggccagcgccaagaaggccgctcggaaggcctga

SEQ ID NO: 7921 - DNA, 294 bp, Methylobacterium sp.
atgagcgccctcgactggttcgggctcaccctggccttcctggcgccgctgccgcccgagcggccggtgccgccggagccgatgcggggcagcgcgctggcggcggccctggtgatcggcagcatctgcctcgtgatggtgctgccgatggtgatgatctggaccttccaccggccggagggcgagttccgccggcactgcgaggccaggggcgggctggtgcggccgacctatctcgacggcagcggcccgcagcgctgcgacctcggcagccggcaccccgcggcctcctga

SEQ ID NO: 7922 - DNA, 783 bp, Methylobacterium sp.
atgctgcacgccgctcaccgccgctccgataccccgaggccggccgtcgggcccgcgccgcaggtgttctccgcggtccggtcgcacggcagcctgccgcaactcgtcgcggaggccgccaccatccatgggccggccccggccttcgcgggcccggagggcggcgcgagctacgccgagctcggctccgcgctcgcccgctacgcgcgctacgccgaggcggaggggttcggtcgcggcgacacggtcgcgctgctgatgggcgcgtgcgccgagcgccacgccctctggctcggcttcgcgcgggccggcgcccgcgtcgcgctggtcgatccgggccttgccggcccgcgcctcgcccgtgccctggcggagatcggagcgcgcctgatcgtcgccgatccggaccgcgccgaggcgatcggcggcctggccggatcgatgtccgagatgccggcggtgcgctggcacgggccgggcgccgatttcgcccggatcgacctggaggccgcggagtacgaggcgggcccgctcgccgggccggaccgggccggtcccgacgatcccgccctcgtcgcctgccagggcaaccggggcgggacgccgaccgtcgcctcggcgagccaccgccagatcctggcctgggcccagggtgcgagcctcggcctgcgccgtgccggcgaggtctgcccgccggcgttccgcgacctcgccgaggtctgcggcgcgctgctgcggggcgataccgtcctgcccggggccggggggcacgccctgtgctag

SEQ ID NO: 7923 - DNA, 279 bp, Methylobacterium sp.
atgaagatgattctcctggccgccgtcgccgcggcctctctcgccacgcccgcctcggcgcaggcggtgatcgagaccccgaccggcaccgcggtcgtggtcccgcccggggcgccgggcgtggtgacccggcagaccggctcgaccggcgagcccggcgcgatcaacgtctcgccgaccggccagccggcggacgtgatctcgaacgactcggcggcggccggcaatgccggccagccctcccgcgtcgcgccgcagggcggcggcggcgggcgctga

SEQ ID NO: 7924 - DNA, 810 bp, Methylobacterium sp.
atgacgcgcgcgaccgagcggaagggcgtcagcgagccgggcggcgtggaggcgcgccgggcggcgatcgtcgccgcggtgcgccagcgcggcttcgtcaccatcgaggcgctggccggccagttcggcgtcacggttcagacgatccggcgggacctcaatgaactcagcgccgaggggcgcctggagcgctaccggggcgggggcggcctgccgtcgagcgtcgagaacatcgactacgcggaccggcgcgtcaccctgctctcggagaaaactcggatcggtcggctggccgcgagtcgcatcccctcgcactgctcggtcttcgtcaatatcggcacgacgcccgaggcggtggcacgggagctgacgcgccacgacgacctcagcatcatcaccaacaacctcaacgtcgcgatctcgctcgcggagacgaccgagttccggatcgtggtggcgggcggcaccgtgcggaaccgcgacggggcggtactcggccagctcacctgcgacacgctgagccagttccgggtcgacgtagcggtgatcggcatcagcggcatcgacgcggatggggcgctgctcgactacgattacgaggaggtacgggcgacgcagaccatcctggcacatgcccgaaagacctatctggtggccgaccacacgaagttcgggcgccgcccgatggtgcaggtcggacggatcgagcagatcgacaccctcttcaccgacctgccgccgccgctgcccatcgtcgcgctgatggagcggcacggcgtgacactggccgtggcgaccgacgacctgtag

SEQ ID NO: 7925 - DNA, 1374 bp, Methylobacterium sp.
atgctggccgatgcagcccaggccgaggcacggacctcttcgcgcgggctctcgcgcgcgcccacaatcaccgagatgaaggtcgtgcccgtcgccggtcgcgacagcatgctgctcaacctctcgggcgcgcacggacccttcttcacccgtaatctcgtggtgctcaccgactcgaccggcgccaccggtctcggcgaagtccccggcggtgagggcatccgccggacgctcgaggatgcgcgcgacctcgtggtgggccagccgctcggcgcctggaacgcggtgctcaacgccatgcgcacccgcttcgccgaccgggattcgggcgggcgcggcctccagaccttcgacctgcgcatcaccatccacgcggtcacggcggtcgaatcggccttcctcgacctgctcggccagttcctcgacgtgccggtggccgccctcctcggcgagggccagcagcgcgacgcggtcgagatgctgggctacctgttctacgtcggcgaccgccgcaggacggacctcgcctaccgggagcccaccgcccgcgacggctggttccgcttgcgcgacgaggaggcgctgacgcccgagaccgtcgcgcgcctcgcggaagccgcctacgagcagtacggcttcaacgacttcaagctgaagggcggtgtcctggcgggcgaggacgaaatcgccgcggtcacggcgatccacgagcgctttcccggagctcgcgtgacgctcgacccgaacggggcgtggtcgctcgccgaggcgatccggctctgcaagggccgtggcgacgtcctggcctacgcggaggacccgtgcggggcggaacagggcttctcgggccgcgagatcatggcggagttccgccgggccacgggcctacccaccgccaccaacatgatcgccaccgactggcgccagatgaaccacgcgatccagctcggatccgtcgacatcccgctggccgacccccatttctggacgctggccggctcggtgcgcgtcgcccagctctgccgcgaccgcgggctgacctggggctcgcactcgaacaaccatttcgacgtgtcgctcgcgatgttcacccacgtggcggcggccgcacccggcaccgtcacggcgatcgacacccactggatctggcaggacggggagcgcctgacccgggagccgctgcagatccgcggcggcctcgtgcgggtgccggagcggccgggcctcgggatcgagctcgactgggccgaggtggagcgcgcgcacgccctctaccgcgaccacgggctcggcgcccgcgacgacgcagctgcgatgcagttcctgatcccgaactggaccttcgacaacaagaagccctgcctggtgcgctga

SEQ ID NO: 7926 - DNA, 489 bp, Methylobacterium sp.
atggaggcagccggcccgggacgtctgctcgaccgcctgcagggcgaatcgcatcgcggcgatcccttcgcggcggcggtgcgcgccacgcggatgccgatgatcgtcacggacccgcaccagttcgacaacccgatcgtcttcgccaacaacgccttcctggcgctgaccggctacgggcggctcgaggtggtgggccgcaactgccgcttcctgcaggggccggagaccgatccggacgcggtggcgcggatccgcgcggcggtgcgggccgaggcaccgatcacgatcgacctcctgaactaccgccgggacggcaccaccttccgcaacgccctctacatgggcccggtccacgacgatgcgggggcgctgcgctacttcttcgcctcgcagctcgacgtgagcgagcgctacgggctgctcggcgagatcgcggacctcaaggcccggctcgccgcggcggaggcccgcctcacgggcgggtga

SEQ ID NO: 7927 - DNA, 180 bp, Methylobacterium sp.
atgtccgagttcgacgccatccgcctgcaactgtcggtcgccgcggccttgcaggcgatcgccatcgtccgcgccgagcgcgacgtgcccgccacgcacgccgctcgccggcatctcggcgaaatccatggcgcgactcgcctgcgcaagcgcctggagcgcgaccggcgggcgggatga

SEQ ID NO: 7928 - DNA, 261 bp, Methylobacterium sp.
atggcacgccgcgttttctgccggatcgtcgataggcctgacggcctgttcgacgtcaccgccacgatcgagcccgacaagacgtttcgccgcgagggggtcgcctcgctcgccgaggcggagcgctggatcgacgggttgcgcacgctgatgacggcgctcggcgcccccgtcctgcgcgtcgacgccgcggagggcgagacggcagccgactccgctcaggccgggacggcgcggctcgacagcgggtcgggatcgtag

SEQ ID NO: 7929 - DNA, 123 bp, Methylobacterium sp.
atgcgggaggacggcatgtcgcctgaactcagggaatcgcgcgcggccctgatcctgctcgccgttgcggtcgtctcggtgctggccttcggggctttcacgttgctcacgcagatcggctga

SEQ ID NO: 7930 - DNA, 240 bp, Methylobacterium sp.
atggaactcctcctgatcctgggcgcggtgctcgcctgcacggtcgtgggcgtgatcgcggtgcgcctgtcggcccagagccggcgcccacccctgcggctcgacagcgaactcgacgcgcgcgacgaggatctgctcacccgcgtcggaccggcgcgcagtcccatcgaccgctcggcggaggtgctggacgtcgagccgatccggcccgcctccggtcgtcccggcgagaagatgtga

SEQ ID NO: 7931 - DNA, 993 bp, Methylobacterium sp.
ttgtcttccttctgcgccgtgctcgcctgcctcggggcggcgcgggcggaggctcagagctcggacgcgctcaaggagccgtaccggcgcccgagcgcgatcccgttccccgaggcggcgccctacgcgccccagatggcgacgctcggcaagatgctgttcttcgacccgcgcctgagcggcaagcagaacctcagctgcgcgagctgccacaacccctccttcggcttcgaggtgccggtgcccggcgcgatcggggcgaccaacaagccgctgccgcgcaaggcgccgaccgtgctcaacgcggcctggacgccggtcctgttctgggacggccgcgccccggacctcgagacgcaggcggcggggccgatcaccgcggatgccgagatggacggcaagttccccgagatcgtcgcccgcctcaaggccacgcccgaatacgccgcctggttcggcaggctgttcccgcgggacggcgtcacgcagggcaacatcctcacggcgatcgccacctacgagcgcacgatcgtctcgggctgggcccccttcgaccgctggatcgagggggacgccacggcgatctccccggccgcgcagcgcggcttcgcgctgttcaccggcaaggccgcctgcgcgggctgccacagcggctggaacttcaccgacaacaggttccacgacctcggcatcccgacccgcgacatcggccgggccgccttcgagcccgacaatcccctggccaagcacgccttcaagacgccgggcctgcgcaacctgacctaccgggcgcccttcggccatgccggccagttccccgacctcgaagcgatcgtcgcgttctacgagaccggggggctggcgcggccctcgaaatcgccgctgatgaagccgatcagcctgaccggcgaggagcgggccgacctgctggccttcctgcgctcgctcacggccgagcagacccgcaccgcgctgccgaacctcccgaactga

SEQ ID NO: 7932 - DNA, 1164 bp, Methylobacterium sp.
atggcccacgcgatcgctctgccgcgcctgatgcggatcggcgccggggcctcggcgctgctgccggaggtgctggcgcagctcggcctgcgccggcccttcatcgtcaccgacccctacctcgcgggcagcggccgggtcgaggcgctggtcgccgggctcgccgcggccgggtgcgaggccgccgtcttcagcgacacggtgccggacccgaccgtcgccgcggtcgaggcggcgctcgccgccttgcgatcgggcgagcacgattgcgtcgtcggcttcggcggcggcagcccgatggacaccgccaaggccgtggcggtgctggcccaacacggcggcgcgatgcgggcctacaaggcgccccatctccaggacgcgccgggcctgccgatcatcgccatcccgaccaccgcgggcaccggctcggaggcgacgcgcttcacgatcgtgacggacgcggagaccgacgagaagatgctgtgcatcgggctggcctacctgccggtcgcggcgctggtcgattacgagctgactctgacgaagccgcgccggctcaccgccgataccggcatcgacgcgctgactcacgcgatcgaggcctacgtctcgaagcgcgccaacccgttctcggacggcatggcgctcgcggcgatgcgggcgatcgccccgaacctgcgccgggtctgggccgatcccggcgaccgggcggcgcgcgaggcgatgatggtcggcgcgacgcaggccggcatcgccttctcgaacagctcggtcgcgctggtgcacgggatgagtcggccgatcggcgcgcatttccacgtcgcgcacggtctctcgaacgcgatgctgctgccggccgtcaccgccttctcggcgcccgccgctcttgcccgctacggggcctgcgcgcgcgccatgggcgtcgcggcggacggggagggcgacggtctcgccgtcgagcgcctgatcgcggaactcagggcgctcaacgccgagctggaagtgccgagccccgccgcctacggcctcgacgccgcccgctggcgggagctgaccccgctgatggcgaagcaggctctcgcctccggctcgcccgccaacaacccggtcgagccgagcgcggcggagatcgaggcgctctacgtcgaggtctgggcgggctga

SEQ ID NO: 7933 - DNA, 357 bp, Methylobacterium sp.
atgccgattccgacgcggaccccgaccctccggatgccgaccctgttcctcctcgtcgccgtggcgctgcccggcgcggccgaggcccaggtcacgccggacctgaacagctggaaccgctcgctctcctaccagagcgacatgcgctcgcagcagctctcgcagacgagcgagctgaacaccctgcggatgcaggcccagcgcaacgtgcagttcgccccggcccccatcgtcgcgccgggcgcggtcctgcgccgcggcggattctcggcccgcggcccgcgccactcgggcgtgcgcaccggccgcaccgggctcgaccgctccctcgacaccggcgtctgcatcggctgctga

SEQ ID NO: 7934 - DNA, 552 bp, Methylobacterium sp.
gtgttcctggcgggcaactcgcacgcggagatcgtcgctcccgccctcgcgcggcggatgcccgtggtcaatggcgggatcggcggcacctcggcgcgcggctacgccgcccagctcgatgcgttgccgttcggtgctcgggccggcacggcggtgctgtttgtcggcaccaacgacatcctgcgccgggcagatccgctgtcggagagcacccgggccgggttcgaggatgccgcggcccggatcatcgactggctccacgcgcatgcggacgccgtgctcgtcgccgccgtgccgccgctcggcccggaggcggcggcaatccgcgatccggcggcggtcgacgcctacacagcggctttgcgcagcctgtgtgggcgacacgggtgtcggctcgtcgatccgttcgcgcgcctgcgcgatggcgagccgggcctgaccacccaggctgctccgcccgatggcctgcacatgcgcgattacgacacgctggcggtcgaactggcggggctgctgcagcgtgcgggcgggactgaaccgcctgcggattga

SEQ ID NO: 7935 - DNA, 195 bp, Methylobacterium sp.
atgagcagcaccaccgacaagatcaagggtgccgtcaacgaggcggtgggcaatgccaagcagggcatcggaaacctcaccgacaacgaccggctgaaggccgagggcaaggcgcaggagctgaagggcacggcccagcgcggcgtcggcgaggccaaggacacggtgaaggacgctgtcggcggcaagctctga

SEQ ID NO: 7936 - DNA, 258 bp, Methylobacterium sp.
atgcgcacctacacgctggcgatcgccgacgacgtcctcttcgtgtgccttcccgacgaggcggatatcggagaggcgatccgggagacgaccgcgaccgcctacgggcatgggatcgagctggagatcagccgcggcgcggtcctcaccgaccggcccgaggccgacgaccacgtgatctggaccgatggtcccgacggcgaactgaccgatgcggagggccgcgcctaccgctacgccgtgcgccggaagtcctga

SEQ ID NO: 7937 - DNA, 285 bp, Methylobacterium sp.
gtgccacggtccagcctcgtcgtcctcgcgctcctggctctcgtcccgtccggagcgcacggagcggatctccacgcgcgcccggcccccgccgccgggcgcttcctggcgacctgcgaggatctcggccggttctgcttcgccgaagggtgcgggcgcgaccagatcgacgccgcgttcgcctgccgggcggcctgccccgcctccgccgtcctcaccgtgcggccgaccgcctgcccgatcccgaccccgccggtgcgcgcggtgctgcgccgcggcggctga

SEQ ID NO: 7938 - DNA, 339 bp, Methylobacterium sp.
atgaagcagctcgacgccatcatcgcctggacgcccgcccgctgggcggagctgcggcccgagaccgccggccaggtcgcggtgctgcccctgtccgacgcggagggcgcggcccggcgctacatgatgcgcgcgggcgccagctcctcggccctgcaggccctgtccgaggaggcccgcatcgcccgcctgttcatcgacttccagacgctggtggtgcgcgacgggctcgacccgcaggcggtgcaccgggcgttcctcgccatcgacgagtaccgcttccgcatcgccccggacacggagggcgcggcgttcgaggacccgcccgaggaggattga

SEQ ID NO: 7939 - DNA, 171 bp, Methylobacterium sp.
ttgactgccgcctcgcctcgttccgcccgccgcctgccgcgcaagcaccggctgatgctgcttctcgccttcgagatcctcgtcttcggcctcggccaagcgcacttcaacccgatgaagcgcggcgtcgtggtcgatgtcagcaccacgcccaaccatgtggtgacctga

SEQ ID NO: 7940 - DNA, 219 bp, Methylobacterium sp.
gtggcgccccgcttctacctcgacctgaccgacggggacgagaccgtccccgacgagggcgggctggagacgcccgacctcgacacggccaccgcccacgcgcaggcggtgctccgcgagatccgcatggccggccgcctcaccggggcccatggcccctgggagatcgtgatccgcgacgcgcggggccggccgctccggcgcatcgcggtgtcctga

SEQ ID NO: 7941 - DNA, 408 bp, Methylobacterium sp.
atgcgccgcctcgccctcgcgctcgccgccgtggccgccctgagcggccccgccctggcggtcgagaacgaccagaagacgccgacccgcgcgccggaattcaccagcgtgccgaaggacgccgtgctcagctacaacctgatcggcctcaacgtggtcgacgggcagcagaacagcgtcggcgagatcaaggacatcgtcatcgagaacgggcagctcgccggctacatcctgtcggtcggcggcttcctcgggctgggcgagcgctacgtcgcggtgaagcccgattccgtctcgctcggctacgacgccgacggcaagaagtggaaggcgatcatcggcgccagcaaggaccagctgaaggccgcgcccgagttcaagtacgagggcaagttcaaccggacgtga

SEQ ID NO: 7942 - DNA, 129 bp, Methylobacterium sp.
atgaagaccgtcgcgctgcgccgcgcccgtccgcacgacctctggcaggcgatcccgctcgagtgcttcgtctgcgccgccgccgtgttcctggccgccggcctcaagctcgccggcctgatgccctga

SEQ ID NO: 7943 - DNA, 792 bp, Methylobacterium sp.
atggatcccttcgagagcgtgaaggcgatggcggagctgtggggccggagcgcccgctccgtcgccgaagcgcaggccaacatgatgggcgccttcgcggccggccctgcccccgcggcggacaccgaggcggcgcggaaggcgcaagccgcctacgcccgcgcctgggccgacgcgcaggcggtggccacgagcttcaccacgagccttcaggacaaggagggccaggacccggtcgcggccgaggtgctggccaaggtgttcgacccgcgcggctggctctcggccaccagcgaggtcgacgcggcactgagccggatggccgaggggccgcaattcgccgacctgttccaggtcgagcgcaagttcgccgcgctcaccgcggcctggacggtgctcaggcggcgcaacctcgagcacaacaccctgatgctggaggcctggacgcgggcgaccggcgccttctcgcaggcggtgaacgcccgcgcggaggccggcaagcccctcgaatcggcccgcgacctgatggcgctctggatcgagacggccaacgacgtgctcgtcgagacgcagcgctcggacgccttcctgacgagccagcgggactcgctgaaggcggccaccgacctgcggctggcgcagggggaactggccgagttctacagccggatgttcggctacccgacccgctccgagctcgacgacctgcacaagaccgtcaccgaactgcgccgggagctgcgggcactcaagcgcgcgaagcgcgccggccggatggaggcctccgcgtga

SEQ ID NO: 7944 - DNA, 270 bp, Methylobacterium sp.
atgcagcccgccatccagcacgtgatccgcgcgctcgccgaggatgggcgggacggcgctcaggggatcgccgagtacgccgtcgacaccttcgcggcgtcctgcccgaccgagggcgaccgggcgctcgccctcgacatcctgctgcgggatctcgcgagcctgcggggcgtggcgccgcatctggccgccttcgtcggccggatcgaggcctacgtcacccgcctgaaggccgtgaagcggccgctcgtcgtcgccgaggcggcctga

SEQ ID NO: 7945 - DNA, 231 bp, Methylobacterium sp.
atggatgtgacgcgcagagagcttctggaacgcctcgatacagccatcgccgccctcgggccgcgggcgccgacgaacttcaacagctcgctcttcggcgacgccgccctcctcaagcgcatcgaggccttcgaggcgcagatcaacgttcccgagaagccgaaggtcgccgactacaccggcaacatgttctcgcgcatcgccaaccgccgggccgccggcgccaagtaa

SEQ ID NO: 7946 - DNA, 957 bp, Methylobacterium sp.
gtgctggtcacgggcgcagccggcttcgtcggacgctccgtgctcgcggctctcgcggaggaaggcgggcgggcgctcctcggcatcgggcgcgggcagggacatggcatgcccgcgggcgtgccgttccactccgtggacctcgccgacggatccgcgttgcgcgcgcaggtcagggccttccgcccgagccatgtccttcacctcgccgcgcagtcgtccgtcgcgcaggcgtcgcacgccgccgcggagacgtggcgcacgaacgtcgtcgggtcgctcaatctggccgaggcgatccgcgcggatgcgccgggagccaccgtgctgttcgcgagttcgagcgaggtctatggccgctccttcctgtccggcgagccgctcgccgaggacgcgccgctccagccggtcggatcctatgcgcgcacgaagcgtgcggccgaggatatgctggcggatgtgttggccggcagcgacaatcggctgatcatcgtgcggccgttcaatcatacgggcccggatcaggacgagcgtttcgtcgtcccgtccttcgcgggccagatcgcccggatcgaggcagggctggcgccgcggcggctcgaggtgggcaacatgagcgccgagcgagagttcctggacgtccgggacgtcgcccgggcctatgcctgcgtgatcgacggcgccgaacggatcgcatccggcacggtgctcaacatcgccagcggcgcgccgcggacgatcgccagcgtcctcgaggatctgcgcgggctgtcgagggtgtccttcgaggtcacggtgagccaggaccgcctgcgtcggtcggagatcccgagagcggccggcgacgcttcgcggcttcgggccctcacaggctgggcgccggtcataccctggggacagacggtcgccgatgtcctggcgacggcccggctgaggcacggcgccgcgaacgcctag

SEQ ID NO: 7947 - DNA, 1260 bp, Methylobacterium sp.
atgacgggaacgaagcgcgcagggcagcccctgcgccggccgacggggcggccgatgagacggctctcgcggccgcgcctggggcgcgtcctgggagggatcgggctcggcgcggcgatccttgcgggcgcggcgctggccgaggaggcgccgcgcccgccggtggacggcggggacccccgcggggcggcacccgccgccacggtcgcgggctacttctacatcggcggccgctaccagcgggtcgaggacaagaccctgatggtcgggcagatgttcgtccagtcgcgccgcccggcccagatcacgcaaccctatccggtggtgatggtgcacggcgcggcgcagacgggcgtgaacttcctgggcacgccggacgggcggccgggctgggcccagcgcttcgtcgagcggggcttccaggtctacgtggtggatcaggtcgggcgcgggcgctcgggcaccaacccggaggtctacggcccctacacgcgcctctccgcccgcgcgctggaggagacctacacggcccaggaggtctacgacctgttcccgcaggccaagctccacacccagtggcccggcgggccgggggtgccgggcaacgccgccttcgaccagttcatggcgagccaggtgccctacctcgccaacacccagcagaccgaggagctgatggccccggcgctcaccgcgctggtggagaagatcggcccggcgatcctcctcacccacgggcagggcgggctgttcggctgggcggtctcggacgcgcggcccgacctcgtgaaggcgcacctcgccatcgagccgaacggcccccccttcttcgacgtgcgctaccgcggcggcaaggagttctgggagcgcaccggtgagggccgcgcccgcgcctacggcctcacccgcatacccctgggcttccagccgccggtgagcgcgcccgaggacctcaccgtggtccaggccaaggcgcccgcggcggagggccgcatccgctgctggctccagggcgagcccgtccgcaagttgccgaacctcgcccgggtgccggccgtgatcgtgacggccgaggcctccttccgggcaccggccgacgattgcacggccgccttcctggcccaggccggggccaagcccgagacgctccgactcgccgaggccggcatccgcggcaacggccacatgatgatgctggagaagaacagcgatcaggtcgccgacgccctggtcgcctggatcgccggccgggtgcgctga

SEQ ID NO: 7948 - DNA, 225 bp, Methylobacterium sp.
atgtgcctcgacccagtcgcgctcgcggtggccgccttgttcaccgccggctgcgccacgatccatgccctgcgccgctatgccgacgcagtcacgctcgtcctaagcctgctggcctacgcgctcgccacagtgctgggctcggcgcttgcgggccgcggcggcctcgtcgtgctgcccgaccccgtccacgcctgggggttcgcggcagccgcgaacatctaa

SEQ ID NO: 7949 - DNA, 486 bp, Methylobacterium sp.
atgtccgaacagatgacctcaaccctcatcacggtcgagcacgtgacgctccgctcacccaaaaccttcgaggcggtgcgcgccgccctggaggcttcggtgcctcccctcgaccacgcctatgccggcttgctccgcgacgggaaggtggacgcggcgcgcgatctcctcgaacggcaggcgccactctcgatcttcggcgcccgcgaccatggcggtctgcttctcaccgccgggctgacccgcaaggccgtccagtacgacatcggcaatccgctcacggctgcgcggatgacccggcacgtcctctccgccgccctgtacgcgccgatccgggtactcctgcgcgaggatgaggagggcggcgtcgcgtttgagtacgaccgcccagtcactaccttcggacaattcggcaataaggaaatcgacgccgtcgcggctgacttagacgatcagctccggggcgtgctcgccgccgcaacttga

SEQ ID NO: 7950 - DNA, 1062 bp, Methylobacterium sp.
ttgtctttcaaggatttgaactcggagcaggcgcgccagaccgtcgatgtcgagcaagtcttctccgcctaccaggcatcgcgcgagacgttcgagcggcgttttgtcggcgccatgtcctggaagaccgtccgcggtcgatcctatctctatcggaagcggcgcgaccgctgggagtccttggggccgcgaagcgcggaaacggaggccgtccacgagcgcttccatgcgggccgtgagagcctgcaggatcggctatccggcctcgccgaacgcctcgatgtcatggctccggtcaatcgggcccttcagctcggccggcttccactcatcgcagcccgggtccttcgagcgctcgacagagccgggctgatcggccacgggctcacggtcgtgggaacgaacgccctgttcgcctacgagcgcctcgctggcgtccagatcgcgagcgcccatctggcggcgggcgacgtcgatctcctgttcgatgcgcgccgatccctgcgcctgatcgctcccgacaccgccgcatcgggcgtgatgaggatcctgaagaaggtcgatcactcgttcggacctttcggccgctccggcttccgcgccgtgaacagggacggctatctcgtcgacctgatcacggccgccggcaaggacccgatgcggaccaccccgccggctcggatcggatccgatccggacgatctcgaagcggccgcgatcgaaggcctcgcctggctcatcatcaacggcccgaaggtctcggccaccgtcctcgacatgcggggctatccggtcaccatgcacgtgccggacccgcgcacgttcggcctccacaagatctggctcagcgagcgcgcggaccgcaatccgacgaagcgcctgcgcgacagggcacaggccgacctcgtggtcgatctcgtgcgcacgcgcctgccccacctcaccttcgacgatccggcgctgagcgcgctgcccgccgccctgcgcaggcgagccccgatcctgggcacgcagcacagcgagccgcggcagggcggctcgcgtctggaaccggattggtag

SEQ ID NO: 7951 - DNA, 273 bp, Methylobacterium sp.
gtgattcgccggcagggcggcgcccgggtgatgacgatcccgcccatccttctcgcttcccttggggccgacgagggcaccaagctggcggtcgacgtgaagggcggcaagctcgtggccgagccggtcacggccgagcctgcgcccgcgccggtcgcgcgccgccgctacacgctggacgagctgctacagggggctgagcacctgccggcgctctacgcctcggtggcgggcgcgctcgacggtgagcctgttgggcacgagatcggctga

SEQ ID NO: 7952 - DNA, 210 bp, Methylobacterium sp.
atgctcagcttggacgacatcgcggccgcggccgccggcgaggagcgggacgccctgtggcggtccctggtcgaggacatggaggaggccgccgggcgtcgccgcggcgggcgcggattcgtgcaggccgaccgccccgcggatctggcgcgggccctcggccgggaccggcgggttcagccgtcgaggctcgcccgctcggcctcgtag

SEQ ID NO: 7953 - DNA, 621 bp, Methylobacterium sp.
atgcgccgtttcgccaagctcctcgccctagtcatggccgccatggccgcctccgcccagcgcgtctgggacggcacgaagtggatcgcccgcgcagccttcggcccgcccgtccccgcgggcgccggcatcgaagaggctttcgacgacgtcgcgcaggccctgcgccccgtgacgccgtcacagcccgccgccgaagccgtgacgccgtccgcccccgcgcccaagcccggcccggccaaggtcgtggagatcgaccccgtcctcgcgcggggccgcgtcgcctacgccttcgcgcacgccatgctgacggccgacgagccctcgaccgccggcctagacgacgccgcgagcgcgtggctgaactccctgaacgcgagcgagctgatgaaaatccaccagtacggcgcgcaccgcgtgggggcccacatggcgggcctccgccccatcgagggcctgcccctgtgccccagcatggcggagtaccgtaatgcgctgtgcgccgccgcgcagatcacgccccagcagcgccgggacgtcgcggagtggcaacagatgctcgaccgggccttcgaagagatggtcgaggaccccgcttacgaactgaagtgcggtatctga

SEQ ID NO: 7954 - DNA, 828 bp, Methylobacterium sp.
atgagcgcggcgcgcgtgaggggttccggccgttccctggagatcatccgccgaagaccggcgcgggcgctcggccggccccggctcctgttcgtccacggcatctcggtcggcgcctggatctggggcgagcacgtgctgccctggttcgccgaggccgggttcgaggcttgcgccctcagcctgcgcggccatggcggcagctggggccacgaccggatcgccgactggcggctcgccgactacaccgccgacatcgatcaggccgcccgcagcctcggcggtccgctcgtggtggtgggccactcgctcggaggcgcggtgatccagaactgggtccgcaccggcgggcggccgctcgggatggcgctgctcgcagcggtgccgccctggggcctcgcggtctcggcgctgcgcatgggtctcctgacgccggccctgttccgcgaggttctggcgatgagcctgcacggggcgcgggcggccgatccggcgatcctgcgcgccggcctgttctcggaggacgtcgcggcggagagcttccgccgcttcgtggcgcggatcggcgaggaatctcgactgatcgggcccgagctccagggctggccgcccttcgcgcccctgccctgggaggcgccccgcaccttcgtgctgggcggggcggacgaccgcttcatcccggccgacgaggtctggcgcacgggcgcctattacggctgccgtccccacatcgtgccgcgcctcgcccacgcgctgatgctggagccgcgctgggaggaggccatggcccccctgcgcgactggctgctcacgctgccgcggacgtaa

SEQ ID NO: 7955 - DNA, 588 bp, Methylobacterium sp.
gtgctgatctacgatccgaaggacccgcaccgcatccgggacctgctcttcatcacgctggtgctgctgctgctcggctacgtcgccctgaacgccgtggtgccgaacgccgacatcatcatcgccgcccgggtgctgcaggcggcggcgagcgtggtggtgctctacgtctacggcagcgacgcctgggcggccttcacccggccgcagcctgagcgctcggacttcctgatcctgggcatctggctcgggttcttctccgggctggcccaagccgtctacgccatcctgttccgactcgccggggcgccggcctggatgctctacatggagacggtggcacccacggtgctgatctcggtgctggcggccgtgctgcatgtggcggccccgggcggcctcgacggcaccgtgccccggcgcaacaagatcgcgctgggcgccatgttcgggctcggggtcgtcggcgtcggcgtgctgctgttcctgcggccggacctcgccagcgtgatcgagcgcaccccgatgtggttgcgggacttctgggaaacgggcctgctgatggagccggggagatccgccggatga

SEQ ID NO: 7956 - DNA, 2523 bp, Methylobacterium sp.
atgatcaagacctttattcccaacgatcccctcttcggcgcgcagtggcacctgcagaataccagccagaccatcatgggtctgccgcaggccggcggggcgtaccggaacgacatcgacgtcacgaaggtctggccggactataccggcaagggcgtcatcgtcggcgtgatcgacgacggcgtccagatgaaccatccggacctccaggcgaacctgctgctgggcaagttctacgacctggatgccggcaaggccggtacgcccaacgggaagcacggcacggcctcgatcggcctcatcctcgcgccgcagaacgaccagggcggcgtcggcgtcgccttcggcagcaagggcatcggttacgtggcctcgccgggggtgttcaacctcgtcgcccagcgcatgctgacggacggcgtcgcggtcagcagcaacagctggggcctcgtcgggcccgaggacacgacgccgttcaagtacgcggaggatcaggccgagttcgacgccgtgctgaccaacctcgcgaaggccggccgcaacgggctgggcaccgcgaccctgttcgccggcggcaacgagcgggtggaggggagcaacacgctcttcgacctgaccagcaactcggcctacaccatcgccgtggcggccgccaatgcggacggcaccgtggcgacctactccacgccgggccccaacgtgctggtcgccgcgccgggcagcggcaatggagccggcagtgcagcgcaggtcgccagcatggtcaccaccgacctcctgggcaccgcgggctacaaccaggccgtggacggcaactacaccaacctgtcgaacacgggcttcaacggcacctctgcggcgactcctgtcgcctcgggcgtggtggcgctgatgctggaagccaatccgaacctgggctaccgcgacgtccaggagatcctggcctacagcgctcgcacccccgaaggagtcgcgacctggagcaccaacggcgccaccgactggaacggcggcgggcaccggcacaacgcggatctcggcttcgggctcatcgacgcgcacgcggcggtgcgcctggccgagacctggaacaagcagagcaccttcgcgaacatcgccggggcgacgagcagcttcacaggcacgggcagcgtctcgctcgcggccggccagagccggcagttcacggcctccttcgcgcagccgctgcgcgttcagcacgtcgccgtctcggtggacatgagcatggccggcggcagctccaacctcagcgccgtcacgctgacgctcaccggtccgaacggggcgacgacgaccgccctgatcgacccggcctcctactcggaggaccagaagaccaagatggcgagcacgctgacctacacgttcgactcggtgcagaactggggcgagctgagcaattccggggcgtggaccctcagcgtctccaacgccagcacgggcagccggctggacatgaaggcctccatctcgctgatcggcgatctcgccaccggcgcccagaccttcgtctacaccgacgattacgcgtacctcgccggcagcgagaccgcgcgcgccgccctcgaagcgacggcggccccgaacgtgctgaacgccgccgccgtcaccagcgacacgaccgtgaacctcgcggagcgcaccgcgaccatcgcgggcgtcgccacgcgccttggcgagagcgcgcgcttcgcgagcctgatcggcggcgacggcaacgaccgactcaccggcaacgacgccgcagatgtgctcgtcgcggcccgcggcaacgacgtgctgcagggcggcggcgggacggacacgctcaccggtggccagggcagcgacacgctgatgggcggcgcggacgctgacctgatctacggcaaccaggatgccgacctgatctacggcaatcagggcggcgacaagattttcggcggccagggcgacgaccgggccttcggtggtcagggtgacgaccagctcgtcggcggtgccggtgccgatacgctgctgggcaatgccgggtccgacctcgtctacggcaacctgggcacggacgtgatctacggcaaccagggggcggacacgctgttcggcggccaggattccgatacgctgatgggcggccaggacacggacgtgctcttcggcaacctcggtgccgacgtgatctacggaaacctcgggagcgacgttctgtacggcggccagggggcggacacgctttacggcggacagggcgacgacgtgctggtgggtggcctcggcgacgatgtgctggtgggtggcctcggagcagaccgctacgtgttcgcctcggaccccggcgggcgcgacctgatcgtgggctttcagcaggcgtccggcgatcgcatcgtgctcggcggccagggctacaccctcggcacggcccggaacggcgacgccctgctcacgctgacgggcggcggcgtgatcgacctcgcgggcatccgcgccgatcaggtcaatgcgagcttcttcgcagcggcctga

SEQ ID NO: 7957 - DNA, 963 bp, Methylobacterium sp.
atgcaccctccgatcgccttcctgggcaacctcgcggccgatgaggagacccgctaccgcgcagctctcgcggcggccctgcccgacgagcgcatccgcccgttccgtgcgctgaccgctgccgagcgggcggcggtcgaggtcgcgatcgtcgccaatcccgatcccgccgaggtggcgcagctgccgggcctcatctggatccagagcctctgggcgggggtcgagcgcctcgtcagggatctgaagcccgggacggtgccgatcgtgcggctggtcgatcccgaactcggacgcacaatggcggaagcggtcctcgcctggacctattatctgcagcgcgacatgccggcctaccggcgccagcaggaagctggcctctggcggcagcgaccctaccgcgcgccggtcgacacgacggtcggcctgctcgggttcggcgtgctgggcagggcggcggccgaccggctcgtgcgggcgggcttccgcgtcgcggcctggagccggtcggctccatcgatgagcgctgcgggttcagcctccgccatcgagacctgggctggtcccgagggcctgacgcgtcttctcgggcgcagcgacatcgccgtctgcctgctcccgctgacgccagagacgcgcggactcctcgatgcggcccgcctcgccgaactgaagccgggagctggcctgatcaacgtcgcgcgcggcgggatcatcgtcaccgaagccctgctggcggccctcgatgccggccatctcgaccacgccgtcctcgacgtgttcgagaccgagccgctgccggccgcctcccccctgtggcgtcatcccggcatcacggtcctgccccacgtgacggccccgacgaatccggtcaccgcggcggcggtggtggccggcaacctgcgggcctatcggacgaccggacagattccggcggctgtcgacgtccggcggggctactga

SEQ ID NO: 7958 - DNA, 501 bp, Methylobacterium sp.
atggcggcacgcggcgaggagaagaggggtttcgacgtgatcgacgcggtggaccgcaggatcctggacgtgctgcagcaggacgcgacgctgccggtcgcgacgatcgccgagcgggtcggcctgagcccggccccgtgctggcggcgcatcaagaagctcgaggcgagcggcatcatcacgcgccgcgtggcgctggtcgaccgccgcaaggccaacgtgccgacgacggtcttcgtcgcggtcaaggcgccccgccacgctgccgagtggtccgaggccttccggcgggtggtcgagggggttccggagatcgtcgaggcgtggcggctcaccggagagatcgactatctcctgcggatcgtcgttcccgacatcgcgacctacgacgcggtctatcagcgcctgatcgcgcggctcgaattctccaatctctcggcctcgatcgccatggaggagatgaagttcaccaccgccgtgccgacgatctacatggcctag

SEQ ID NO: 7959 - DNA, 525 bp, Methylobacterium sp.
atgacacccgaccagccgaacgccgcccgcgccgccgacctcctcgccgcgctgccgctctcggcgcgcgggacccctgccgcctatctggacgccgctcgccgaaccctgcaggtgctgatgggacgtcccgatctcctcgacggcgtggcgctggagcggcgccccggcggctacgcgcgcaacctgctgttcggcgggggcggcctcagcgtctgggcgatggtctggagcccgggcgcgcgcaccacggtgcacgaccaccactgctcctgctgcttcggcgtctggaagggcgcgatccgggaggtctggttccggccgatcggcgcgcgcgaggccgtcgcgaccgcggacgcgacgcgcccgcagggctacgtcgcctgcatgatgccgaccgggccgaacctgcaccagatcgtcaatccgggcccggaggaggcgatctcgatccacgtctacggcttcgaccacgcggtccacgcctcctcggtgcaccgggagtaccgggtggtggccgcctga

SEQ ID NO: 7960 - DNA, 639 bp, Methylobacterium sp.
atgctcaccctcgaccacctcgcaatcgtcgccccgagcctcgcggagggcgtggcgcatgtgcgcgagagcctcgacctcgacatccccgagggcgggcgccacgccgagatgggcacgcgcaaccacctgctgcgcctcggcgacgcgctcttcctcgaagtgatcgcggtggacgcgcaggcgccccatcccggccgcccgcgctggttcggcctcgacgacgcggccgcggtccgggcggattgggaggccgggcggcgcctgcgcgccttcgtggcccgcaccggcgatctcgacggtgcggtggcccgccggcccggcctgttcgggcgcccggcccgcatgacgcgcgggctcctcgcctggcgcttcgccctgcgcgacgacggggcgctgccgctggacggcctcgcgccctgcctgatggcatggggccccgagggcaatccggcccgcgccatgccggatctcggcgcgcggctcggggccttccgcctcgaccatcccgaccccgagggcgcggccgcgctctaccgggagatcggcctcctcgacccgccggagattcgcgaaggtcccgtattccgctacacggcggagatcgagacgccctcgggcccgcgcacgctggcctga

SEQ ID NO: 7961 - DNA, 462 bp, Methylobacterium sp.
atggcgcgtctgaacgtcaacggcgtcgtgcgtgaggtcgatgccgagcccgacacgccgctcctctgggtgatccgcgagcagatcgggctcaccggcaccaaatacggttgcggcatcgcccagtgcggtgcctgcaccgtgcatatcgacggggcggcggtgcgtgcctgctcgctgccgctctccgcggtcgagccggggcagaagatcgtcacgatcgaggggctcgcgccgggtgccgatcacccggtccagcaggcttgggccgagctcgacgtgccgcaatgcggcttctgccagcccggcatgatcatggcctcggcggccctgctggcgcagaacccgcgcccgagcgaggatcagatccgccaggagatcaccaatatctgccgctgcggcacctacaaccgcgtgctggcgggcatcaagctcgccgctgagcgcggtcagtccggctga

SEQ ID NO: 7962 - DNA, 2193 bp, Methylobacterium sp.
atgagcatcgacgtccgcgcccccctcccctcgcgccgcgccctgctggcgggcgccgccggggtgttcagcctcggcttccacatccccttcctcccgcccgcccgagccgcgaccctcgacgcggcaccctccactccagaggtgaacgcctgggtcgtggtgaagccggacgagaccgtggtgatccgcatcgcccgctcggagatgggccagggcacgctcaccggcctcgcccagctcgtcgccgaggaactcgactgcgactgggcccgcgtcaccaccgagtatccgagcccgggccagaacctcgcgcgcaagcgcgtctggggcgactactcgaccgggggcagccgcggcgtgcgcgactcccacgaatacgtgcgcaaggggggcgcggccgcccgcaccatgctggtcgccgccgccgccaagggctggggcgtgcccgcggccgagtgccgcgtcgagcggggcgtgatcacccacggtccgtccggccgtaacaccacctacggcgccgtcgcggaggaggccgcgaagatcgagccgccgaaggacgtggtcctcaaggatccgaaggactggacgatcgccggcaagccgctgaagcggctcgacacgctgccgaagctcgacggcagccaggtctacggcatcgacctgaagctgcccggcctgctcaacgccgccatccgcgactgcccggtgaccggcggcagcgtgaagagcttcgacgcggcggccgtgtcgggcatgcccggcgtcaagcgcgtcgtgcaggtcggcgacacggccgtcgcggtggtggccgacacgttctggcgggccaagaccgcgctcgacgccctgccgatcgtctgggacgagggcccgaacgcgggggtctccagcgagaccatcgcggcgaccctgcgcgcggggctcgacgccgagcaggccttcgtcggcaacagggccggcgacgtggcgggggcgctcaagggcgccgccaaggtggtggaggccgtctacggcgtgcccttccagaaccacgccacgatggagccaatgaacgccaccgcgctctggaccgcggagcgctgcgaggtctggacgccgacgcagaacggcgaggcggcgctcgccgcgaccgccgacgccgcgggcctgccggcgacggcctgcgaggtctacaagatccatctcggcggcggcttcgggcgccgcggcgccacgcacgactgggtgcggcaggcggtgctcatcgcgaaggagatgccgggcacgcccgtcaagctgatctggacccgcgaggaggacatgacgcacggccggtaccacccggtcacgcagtgccgcatgcgcgccgcgctcgacaaggacggcaacctgaccggcctgcacatgcgcatctccggccagtcgatcctggcctcggtcgcgccccagcgcatggtcgagggccgcgaccccgtcaccttccaggggctcaacccgggcggcccggaggcggcgatcggctacacgatcccgaacatcctcgtcgatcacgccatgcgcaacccgcacatcctgccgggcttctggcggggcgtgaacctgaacccgaacgccatctacctcgaatgcttcatggacgagctggccgacgcggccggccaggatccgctggccttccggctgaagctgatgggcaaccacccgaagcaccgggccgtgctggaggcggtggccgagaagatcggctgggacagcaagccgcccgagggggtgtatcgcggcatctgccagacgatgggcttcggcagctacgtggcgggcgcggccgaggtctcggtctccgatgcgggcgagttgaagatccaccgcatcgtggcggcgaccgacccgggccacgcggtcaacccgcagcagatcgacgcgcaggtggcaggctccttcgtgtacggcctgtcggcggcgctctacggggcctgcacggtgaaggacgggcgcatcgagcagacgaacttcgacagctacccggtcatgcggatggacgcgatgccggcggtcgagacgatcctgatgccgtccggcggcttctggggcggcgtcggcgagccgaccatcgcggtggcggccccggccgtgctgaacgcggtcttcgccgcgaccggaaagcgcgtgcgccagctgcccctgaaggacacggacctgcgccgggcatga

SEQ ID NO: 7963 - DNA, 324 bp, Methylobacterium sp.
atgcgccattcctcacgtccgctgttcctccgcctcctcgcggcctcggccgcgctggccgttctcgcgcccgccccggccggcgcgcagggcgtgggctttgccaccggcctgccggggcgtgaccccgccggcgaggacgcgattggctggggcccggcctaccggcccgaaaccagcttctcgcagcccggcaccccaccgacgccgggcgactacgcgggcgctgcctaccgggcgcgcaccggccgcggggtctacgatcggggcgtgtccgcccgggtcgagcgcgcaccgcagcggcggcgtcaccgcgactggtga

SEQ ID NO: 7964 - DNA, 1026 bp, Methylobacterium sp.
atgaagaccttccatcaccccgaccaggcgctgcaccacccgcgcacctacttctcccgcgggcagatgcgcgagccgcaggaggtgccggcccgcgagcaggcgctgctcgccgcggtgcgcgatctcggtttcccggtcgaggccccgccggatgccggcgcggcgccgatcctcgccgtgcacgggatggactacctgcgcttcctgcaggacgcgcacgcggactggaccgcgctcggcccggactggggcggggaggtggtctcgaacatcttcgtgcgcgagccgaacgcgctccggggcgtgctggcacaggccggacgctacatcgcggacggcagcgccccgatcggtccggacaccttccgggccgcctacgcctcggcccagtgcgcggtcgcgggcgccgacgcgctgaacgcgggcgcgcgggaggcctacgccctgtgccggccgcccggccaccacgcgcgccgggaggcggcgggcggcttctgcttcctcaacaacgcggcgatcgccgccgagcgccttcgcgcgcgccacgcccgcgtcgccatcctcgacaccgacatgcatcacggccaggggatccaggagatcttctacgaccgggcggacgtcttctacatctcgatccacggcgacccgacgaacttctaccccgcgacggcgggcttcgcggaggagcgcgggagcggggcgggggagggctacaacctgaacctgccgatgccgcacggttcggacgaagaggtgttcttcgccgagctcgcgcgggcgctgcgggcgctagcgctctaccagccggacgccctcgtcctgtcgctcggcttcgacatctacgcgggcgatccccaggcgaaggtcgcggtcggcgcggacggcttcgagcgtctgggggcggcgatcggcggctttcccgcgccgaccttggtcgtgcaggagggcggctactgcatcgcggcgctgaccgagctgtcgcggcgcttcttcacgggtttcgccgcggcccgcggctga

SEQ ID NO: 7965 - DNA, 165 bp, Methylobacterium sp.
atgggatcgatgctgaagaacgcgatacagccgcccctcgccgggcccaatcagaaccctgtcctctacggtgtcgcgaacggactcgcgaagctgttcccgcccgtggagcagcccgagaaccgcgcccgggcgggcgctcagccccgcccgacgcgcggctga

SEQ ID NO: 7966 - DNA, 1518 bp, Methylobacterium sp.
atgaacgatctggtcatcagtcgcgccaacgccatcggcaaggccgtggcggtgcgcaccgccccggtcaccgggcggatgcgcacctacatctcgggctcctcgctgctctcgggccgttcggacgacaccgagttcctgccggcccatctcgagatcctcgagacgccgcccgcgccccagcggatcgctgcgctctggctgctctgcggcgcgctcgcggcggccctcctctggagctgcttcgccaagctcgacatcttcgccatcgccaccggccgcgtgcaggtggcgggccgctcgaaggtgatccagccgctcgaccccggcgcggtgaagtcgatccgcgtcgagaacggcatacaggtgaaggcgggcgacatcctgctcgaactcgatcccacggtggccaacgccgacaagcaggcctcatcctgggacatctggtccctgcgcgccgagatcccgcggcgccaagccgagatcaaggccttcgagagcggcgccacggccccgcccaaggtcgatttcccagaggatatcggccccgagatccggctgcgcgaggagagcgtgctcgccgccgagttcgcccagtacatgtcggccaaggcgagcctcgagggtcaggtcggcgagaacgacgcgctgaaatccaggctcgccggcagcgtcgcggcccgtacgcggctgatcgatgttctgaaggagcgtctcggcatgaagcaggagctcgtggtgcgtgccgccggcacccgcgccgccctgctcgaatcgcaacaggcgctcgagagtgagcttacgaacctcgcctacgacaagggccagatgatgcaggcggaggccgccggcgtctcgctcgcgaagaagctcgagcagctccagaagcagtcggtggctgagcaggcccagaagctgaccgacgcccagcgcaagctcgaccggttcaaggaagatctcgcaaaggcgagcttccgggtcgaccgcacgacgctgcgcgccccgatcagcggcaccgtgcagcagctcgccgttacgacgatcggtcaggtcgtcaccaccggccaaccgctcatggtcatcgtgccgagcgagggcaacatcgagatcgaggccctggtgcagaacaccgatatcggcttcgtcgaggtcggtcaggaagcgacgatcaaggtcaacgccttcccgttcacccgctacggcactctcgacggccgcgtggtgcgggtctcgcgcgatgcggtcgacgcgaaggacgcctcgcagacctcggacgccgcgaccgcctcgcgggctcagaacagctcaatcttctcgtcgacgcccgccgcgcagaatctcgtcttcccggtggtgatcgcgctcaacaagacgtccctgctggtcgacggcaaggacctgccgctcacccccggcatgaccgcgaccgtcgaggtccagaccggctcgcgccgggtgatcgactacctcttcgcgccgatccgcgagacgacctcgactgcgggccacgagcgctga

SEQ ID NO: 7967 - DNA, 717 bp, Methylobacterium sp.
atggcgcggacgcggggggctgcgacggcagttcgggatcaggaggctgagcgccgtccttccctggtcgacgacgcctacgcggccctgaagcgggcgatccaggactcgagcttcgcgcccggctaccaagcgtcggagcaggagatcgccctgcgcctcgggatgagccgcacgcccgtgcacgaggcggtcatccgtctgcaggaagacgggctggtgcgcgtgctgtcccgccgcggcgtcctgatctgcgccctggctcctgaggacatgcgggagatctacgacgtcatcgtcgccgtcgagggccgcgcagccgaactgctggcctcacttccggatgcggcgcgcgaggccgcggtttccgagctggccggctacaccgagaccatggcccaggcctggcaggccggggacctcccggtttgggggcaggcggatgcgcgcttccatcgggcgctcgtcgagcgggcgggcaacgggcggatgacccggatcatccagaccatcaccgatcagtcgcatcgcgcccgcatgctgacgctcaagcttcggcgcgaactcggggcctccgtggccgagcaccgcgccatcatcgacgcgatccggctcggggattcggtggccgctcaggggcgcgtccacgaccatcgcctgcgtgcccgagacgagcttctgcctctgctggaaagcttcggcctcaggcatctctga

SEQ ID NO: 7968 - DNA, 888 bp, Methylobacterium sp.
atgacacacggaacggcaaccgccctcggcttcggcgcgatcctgctctggtcgctgctcgctgtcctcacggcggcttcgggcgcggtcccgcccttccagctcgcggccatgacctttgcggtgggcggcctcctcggctgcgccagctggctcgtgcggccgggaggcctgcgggcgctgcgccagccctggccggtctggctcctcggggtcggcggcctgttcggctaccacgcgctctacttcgccgcgctccgcctcgccccgcccgccgaggccggactgatcaattatctctggccccttctcatcgtgctgctctcggcgctgcttccgcgggccggagggttgcgggccgcgcatctgatcggcgccctcctcgggctcgcgggcgtggtcgcgctgttcgtgggccgcgggaccctcgatttcgcggccggcgccgcgccgggctacgccgcggccttcgccgccgccttcgtctggtcgggctactccgtgctctcggcccgggtcggcgcggtgccgaccgatgcggtcgcgggcttctgcctcgtcaccgccgcgctgagccttctctgccatctggccgttgagaccacggtctggccggcggacgcgccgcaatgggccgcggtcgcggcgctcggcctcgggccggtcggcgccgccttctatctctgggatatcggggtgaagcgcggggacatccggctcctcggcgtggccgcctacgcggcgccggtcctctcgaccctgctcctcgtcgcaaccggctacgcgccggccacgcccgccctggcgctcgcctgcctcctcatcgtcgccggcgccctggtggccgttcgggcctcgcgccggctcccgcgcgaagcggctctctga

SEQ ID NO: 7969 - DNA, 1449 bp, Methylobacterium sp.
atggatgtcaccagacggatcttcgctgcgggcgcggccacgctgcccttcgttggaccgggcctgccgcgcactcaggctcagagcacggggcaggacgcgccgattatcggcaatcacgcggtggcggatccgctggagctcgcggtcgacgcctacatctacggctacccgcttgtcaccgtggaaatgacccggcgcgtgctcaccaacgtggccgcacccgagggcaagaacgccccgatgggccagttcgccaacctgcgggagtacccggacgcgaaattcagggccgtcactgccccgaacgcggacacgctctactccagtgccttcgtcgatgtcggcaaggagcctcacattctcagcctcccggacgaggacgggcgctattacctgatgccgatgctgagcgcctggacgaacgtcttcgcggtgcccggcaagcgcaccaccgggacggggccgcagacctacttcatcgcaggccccggctggagcggcagcgtgccgcccggcgcccagctgatccaggcgcccaccagcctgatctggatcctcggccggacctactgcacaggcacgcctggggattaccgggccgtgcacgcgctgcaggaccagtatcggctcatcccagcgagcgcggccggccgggcgtacaccccgccgcccggccggatcgacccaagcatcgacatgaagacggccgtgcgcgagcaggtcgaccgcatggacgcgacgacctacttcaacctgctggcctctctgatgaaggacaacccaccggcgctggcggacggtgttccgctcgccaagatggcctcactcggaatcatgcccggtcgctcctttgacccggcaagccagccgcccgccatccgggatgcgatcgggcgggcaccgaaggaggccagcccgcgcatcatggggtatctgaaggcaacgggcaggcacgtgaacggctggaccttcacgactgacggcggcgactacggcaaggactacctacagcgcgccctggtcacggcggtgggccttggctgcaacctgccccaggacgcggtctacccgctgaccacggtcgatgccgccggccgacggctaaacggcgcctcgaaatacgtgatgcgcttcccggccggcgagctgccccctgttgacggcttctggtcgctgacgatgtatgacgccgactacttcttcgtcgacaacccgatcaaccgctactcggtgagcccgcgcgacgatctcaaggccaaccccgacggctcggtcgacctcttcatccagacggagagccccggtgcaatgcgagagtcgaactggctgcctgccccgcgagggccgttcgtgctgatgctgcggacctattggccgaaggacgctctgctgaacggatcgtggtcgccgccgccggtcacccgcagcgcgagcgccaccctctaa

SEQ ID NO: 7970 - DNA, 1113 bp, Methylobacterium sp.
atggacagggacggcgccgagaacgcgaaggccgagattttccagcgcgccttcggctacgcggaggtgccgggcgcgcaggacgttcaggacggcgcaccgatcttcgaggccgcaccggacagcgccgcgggcgcgcggatccgtcaggcccggcaggagaggacgctggcgcaatccgagcagatcgcggtcggcatcctgcgtccacaggacgcgggccgtgggggccgggcggccgagatcggactcttcgtccagcgcaagaggctggccgatcaccgcatcgtggaagcggcccggcggatcgcgcgcaacgaggtccgcatcgtcgtcaccgggccggtgcggggccaagccgccaatgccggccgctgccgcccgctgcgcatcggcgcctcggtcgggcatcaccgggcgacggccggcacgatcggctgcttcgcgatctgccggaagaccgggatggtgggcctcgtgtcgaacaaccacgtgctggcccaatccaaccgggccgccgcgggcgacgacgtgctgcagccgggccggatcgacggcgtccgcgacggccgcagcctgaaccgcatcgcgagcctgggcgccttcgtgccgatcgacttcacgccgaacgcgccgaactacgtcgattgcgccttcgcgccgctggccggatcacccgggcacgatgggagcacgatcgccccgctggacgggtcggtgccaaatcagcccatgggtatctgcgaagatctgatcttcgaccgggtcgaagtccgcaaggtcggccgcacgaccggtccgacgaaaggtttcgtccaggcgatcagcgtggataacctcaccgttcaaatggcctccgggccgagaccacggtacgctctgtttcatcggcagatcgccatcagcggcgtcgagcggcgtttctcgaagcctggcgacagcggctcgttgatctacatcaggaacggcaatcccgtcgccctcctcttcgctggcgcggcgtccggcggcgatttcgggcacggcgtaaccttcgccaacccgatccaggcggtccttgatgcgcttgagatcgacctctacactggttcctcaggaggttcgcatgtctga

SEQ ID NO: 7971 - DNA, 1479 bp, Methylobacterium sp.
atgagccgggtgctgcgcccgcaccagacccggatcatcgaccggctgcgggaatcgatgatcgccgggcgccgccgcccgatggtccaagcgcccaccggggcgggaaagaccgtggtggcgggtgcgatcgtccggggcgctcgggccaagggcaaacgggtgctgttcgtggtcccggccatcagcctgatcgaccagaccgtgcggtcgttcttcgccgagggcatccacgacgtcggcgtgatccagggtagccacccgatgacggacgccagccgtccggttcaggtcgcttcgatccagaccctgcagcgtcgggccatcccgccgttcgacatcgtggtgatcgacgaggcccatcgctggttcgagatgctgggcacgtggatggccgcgcccgattgggccgcggtgcccttcgtcgggctctccgccacgccatggaccaaggggctgggccggcactacgacgacctgattcaggtcaccaccacggctgagctgatcgcggccggctacctcgccccgttccgggtctacgcgccctcgcaccccgacctcgacggggttcgcaccgtagccggcgactaccacgagggcgatctgggcgaggcgatgaaccggcccgagctcgtcgccgatgtcgtccggacctggcagcagcgcggggagaaccgcccgaccttcgtgttcgcggtcgaccgggcccacgccaagcacctgcagggcgagttcgagcgggcgggtgtggcctgcggctacatcgacgccttcaccaagtccgacgagcgggaggcgctgttccagcgcttcacggccggcgagctgcgggtgatcgccagcgtcggctgcctcaccaccggcgtcgacctcgacgtgcgctgcatcgtgctggcccggccgaccaaatccgagatgctgttcgtgcagatcatcggccggggcctgcgcacggcgccgggcaaggacgattgcctcatcctcgatcatagcgacacgcacctgcggctcggcttcgtcacggacatccaccacgatgctctcgacgacggccgggagcggcagaagcaggaccgcaagcgccggcccgaggccctgccgaaggagtgccctggctgctcgttcctgaagccggccaagagcccgaagtgcccggcctgtgggttcaagcccgagcgtcagtccgagatcgtctgcgaggacggcgacctcgtcgagatgacgccgaagcgcgagcgcgcgaacagcgccgagaaaggcctgatgttcggccagctccggcactacgcccggacccggggctacgcggacggctgggcggccaacaagttccgggagcgctacggggtctggccggaccgctaccacaacgctccgctggtccagcccacgcccaccacgctgtcgtggatcaagtcccgccagatcgcttgggtgaagggcaagggaggcgcccgtgcccacgcttctgcgtga

SEQ ID NO: 7972 - DNA, 300 bp, Methylobacterium sp.
atgagcgccgagctcagcgaggccatcgggcgagccgcccgggatgaggggcttaccgcgggagcctgggtccgccgcctgctgctggaacggctcgacctgaaatccgcggaggacgcccgcagcggtcgtccggttcgcgtgcccgaggggcatcacgccgccctcgcaggcgccctgcgcgagctcgcctccgccggtgccgcggtccggacgggtgacgaagtcgaggcggctcgcgcccttcaggccgcacgggatctgctgatcccgctcgccctgcgccggtcggcgccgtga

SEQ ID NO: 7973 - DNA, 1845 bp, Methylobacterium sp.
atggaacagagcacgctctctgatagcacccgcatgcccgcagcgcaggtggaaacgcgagaccacgcgcaggaagcgcgggtggccgccctgctggcggcgcccagcattgatccgggttcggacggggcgctcctcgcccttggtcgcgaactcgatgtcgccattgcagcggagcacgacgcgtgcgcgcgcgccgacgccgcagtgcgtgaggctggcctgcgcaagacgactcgtcccgcgtgcctcatcttcggcgaagacgatgcgccgctgaagctccgtcagcgctacgagcatcctgccgcgctcgtgggctccccggttcgggaggcagatgtcgactggatgcgtcgccggatgccgatgcagcatgaggtgctgcgcccgatccgcgagggcgagcgggcgcacatcgatcatcctggccacaagttcgagatcgtcccgcatcccgaggcccaagcgagggccgaggagatcatcgcggcgtggcaggcgtggggcgaggcagtcgaacgaatcaatgccgaatgcggcgttccagaagcagaagctgttgccgagaatgctggcgaggcggcctccgctatagccttccgtatcgctgagcttcccgcccggacggcggaaggcctacgggcgaaactccgtgccctgatccactacgatccgaatgcgctgccaatcgacgctccagaggagcccgatccgggtcaggtcttggcacgatcgatccggcttgacctcgcccgcatccaagatgagccgcgtgcaactcaggcgccgcctgttgcgcacccggatccgatcttcgcggcaatcgagaaggatcgcgcgctcgccgccgagcacatccggctcctcggcatctcgggcagcaagcccgacgaagatccatcgtgggagccgacgcacgacgccagcgatgccctgtgggcccattgggacgacgtgctactcaagaccgtgccgaccaccgcctccggctgcgcggctctggcccgttacgtgaacgagtggtccgagcgcgaaggcctggatctgagcgaggccgggccgaagatcttcgacctgatcggccgcagccctctgctgcaatcagcggcgccgagcgatgccgccgagcccgatcccatctttgccgcactggacgcctgccgggctccggaagccgaaaggaaagcgttccacgctgtgcactctgtcggcaagaccggtcccggctacacgttcgaacgcgagacggccctggacgacgcggtggatgcggctttcggcgccgtgttcgccacgacgccgacgacgcgggccggtcgcctcgcgctgactgcattcatcgagcgccgcatcgagtggagcgcgtgcccagacggatctccgcaggagggcgaggataccgttttcgccgatgcctacagggctctcgctcgtgtcatcgaggccgaggtgcctgaggttgccggagagggtatcgcggaagcgctccaccgcgcggtggatctgaaagccctggacatcaaggatctgagccatctcgccctctggacggaatcgctcattaccatggccagcgggctggcccagcgcggcggtcggcgcccgctcggtcgcttcttcgatcaggtcagcaatgccctctgcgatgtggtcgtggaggcacaggacgagcttcgggctcgcacgccggctgacgctctggaacgggagtaccgagcgaagacgatcgccctgccggtgatcgagaacggcgacgccgatgagcttgagagcctgatcgccgaccttcaggtcgaggtcgcgtacctccgccagcccatgactgcggaggccgctcgatga

SEQ ID NO: 7974 - DNA, 543 bp, Methylobacterium sp.
atgaccgaccgatcctttccccctgctctggaggcggcgggcatcatcggcacatggcagaccgacgtcgcggccggccgctcgatcctcgacgacggggccgccgcgctgatggcgggcgatgcggggctggcgggcaagccgctcaccctcgacgtcgcgctcgggcgcatccacccggacgaccgggactgggtgttcgcgcagatccgccgggcccgccgcgcgggcggcccgttcgccgccgagttccgcgtgcaggcgccggggggcgccgtgcgctgggtgctcaaccagggccgcctgcccgcggagggaacgggcgggatcggctacggcacctacatcgacaccacgcaccgccaccgggacccggccgaggcgccggacggggagcggcgcgactggctggagaccgcggccgaccactgcatcgccgcgcgcgaggcgatcgaccgcagcggcaagccgttcctgcgcctcctcatcgacgcgctgctcctcgagatcggccgccacctggtgcgccgccgctcgcactga

SEQ ID NO: 7975 - DNA, 207 bp, Methylobacterium sp.
atggccgccacgaccctatcgcccgcccgcgcggacgctttccctgcgcgcgcgacatccgcccgccccgccttgctgcgcctctggctcggccgcatccgcgcccggcgggcgctcgccgccctgcacccggatcaggtgcgcgaggccggcctcgacccgttccgcctgcgcgccgagatcgccaagccgttctggcgggcatga

SEQ ID NO: 7976 - DNA, 216 bp, Methylobacterium sp.
atgcccggatgccgcaagctcgacgccttcccgaccacgccccgtccagcggacgggcgggtggtgctgtcgcactacgtccggctccgcgcccgaccaccccggcccgcgaacgacaaccggcgcgccgccggcccggccctctggcactgggcgctcctcgtcggcatcggccccgtattcggcctgatcgccgcggtctccgccctgatctga

SEQ ID NO: 7977 - DNA, 1050 bp, Methylobacterium sp.
gtgccgagaaacatcctgatcctgggagcctcctacggctccctgctcgcgaccaagctgctgatggccggtcacaacgtgactctggtctgccgacgcaagaccgcggacctcatcaaccgcgagggaaccgaggtccggatcaagctgcgcgacgagccgaaccaccgcgcgatccactcgcgcgacctgcccgggaccctcgacgcgacgccgcccgaggacgtcgacgtgtcccgctacgatctcgtcggcctcgccatgcaggagccgcagtacaacaaccacacgatccgcgtgctgatgatcaagatcgcggaggcgaagctgccctgcctctcgatcatgaacatgccgccgctgccctatctcaagcggatcccgggactggcgggcatggacctcgaggaggcctacaccaatgccggcgtctgggaccggttcgagccgggcctcgtctccctgtgctcgcccgacccgcaggccttccggccgccggaggagggggccaacgtcctgcacgtgggccttccgacgaacttcaaggcggcgaccttcgcggacgagacccacaatcggcttctgcgcgagctagaagccgatatcgacgcggtgcgcctcgacggacaggacgtgccggtcaagctgaaggtgttcgattcgctgttcgtgccgcttgccaaatggtcgatgctgctgaccggcaattatcgctgcatcacgcccgacgagccccgctcgatccgggatgcggtgcacggtgatctggcccaatcccgcgcgatctacgagcatgtcgacgcgctcgctcggcggctcggtgccgacccggccgatcaggttccgttcgagaagtacgccaaggccgccgagagcctgctcaaaccgtcctcggccgcccgggcggtcgccaacggtgcgcccttcatcgagcgggtcgaccttctggtgaagctgatcgcgcaccagctcggcgagccggatgccgagatcgaccggacggtggcgacggtggaccggaagctcggcgagcggatcatcgagggctga

SEQ ID NO: 7978 - DNA, 972 bp, Methylobacterium sp.
atggcgggcttcatcgcgcagcggctggccaagggcgtcctcgtccttgctgccattgtcgtcctgaacttcttcctgatccgcctcgccccgggcgaccccgccctggtgatggcgggggaggcaggggcgaccgacgagatcttcgtgacgcagctgcggcagaagttcgccctggacaagccgctccccagccaactcgcggcctatctgggcagcgtcgccaccctcgatctcggctactccgtgcgccagcagatgccggtggcgacgctgatcggcgagcgcctgccggcgacgctcctgctcaccggctgcgccttcctgatctcgatcgtgctcggcgtcctgctcggggcgctcgccgcccgccgggccggcagcctcgccgataccgcgatcaccggcctcgcactgctcttctacgccacgccgctgttctgggtgtcgctgatggcgatcatcctgttctccgtgcggctcgaatggctgccgagcttcggcttcgagacggtgggcgcgggctataccgggctcgcccgggccagcgacatcgcgcagcatctcgtcctgcccgccctcaccctcggcctattcttcatggcggtctacgtccggatgacccgggcctcgatgctggaggtctcgcgcctcgacttcgtgaagacggcccgggccaagggcctgagcgagggcgtgatccagcgccgccacatcctgcgcaacgccctgctgccggtggtcaccctggcgggcctccaggccgggacgctcgtggggggcgccgtcctcaccgagaccgtcttcgcctggcccgggatcggacggctcatgtacgacgccctgctccagcgcgactacaccctgctgctcggcgtcttcgtcgtctcctccgccatggtcctgatcttcaacctcgtcaccgacgtggtctaccgcatggtcgacccgcgcatcgaggccgcccgatga

SEQ ID NO: 7979 - DNA, 243 bp, Methylobacterium sp.
atgctggtgctgtctgctgcgcaaccgatcgcgcgcggcgcattcgccgagaggcgggcaaccgccatcgtgaatgccaactggtttcgcgccctggcttggcgcgccctgcgcgacggtcagccccggggcgcgttgcgagcggccaatgcccgcgccgccgcacgcatcgtcctgcggcaggccagacgggacgctcaggtcaacagcctcgtcatggaagcgctggccgacggtgcgtga

SEQ ID NO: 7980 - DNA, 531 bp, Methylobacterium sp.
atgacgccgatgctgcgcgcggcgaccgcggacgatatccccgcgatcgcccggatctacgcggaggccgtgctgaacggcaccgcgaccttcgagaccgagccgccctccgaggccgagatggcgcaccgctggtcggacctcgttgcggcgggcctgccgtggctcgtggccgtccgcgggagcggcgtcgtcggctacgcctatgcgggcctctaccggacgcgcgcggcctaccgctccacccttgagacctccgtttacgttgcgccggaggcccgggggctcgggatcggacgtgccctgctcgacgcgctcatcccggcctgcgaggccctcgatgcgcgccggctcgtggccgtgatcgcgcatccgggctccgaggcctccgtgtccctgcacgcgggcgcgggcttcgtgcccgcgggatgcctgcaggcggtcggctacaagcacgggcgctggctcgacaccctgctgatgcagcgcgcgatcggcccgggatcggacggaccgccgagccgggtctag

SEQ ID NO: 7981 - DNA, 1176 bp, Methylobacterium sp.
ttggcggaggtcgacgttctgctgggggccgtcgagaggatcgacggcggcgcgatcgcgggctgggcctgcatgcgtcgccccgacggcagcgagcgcccggccatcctcgaagtgcgggccgacgatgtcctggtcttccgtttcgtcgccagcgcggtccgggaggacgtgcgggcgcgcggcgcctgcggcatcgaccggaccggcttccggctggaccacgcattccccgccggcacgaagatcgccctgaacagcgccgagaccggcgccctgctgggcgaggcgccgcgcttcgtggcgccgccgctctccccgcggatcgggctgatcgcgcccgcgcgcgacgaggcacccttcctcatggaatggctcgcctaccaccggacccgcgggatcgagcggttcttcatcgccgacaacggcggcgcagacgccacctcggacctgctgcggcggctcgaccgcgccggcgtcgtgacgcgctacgactatctcggccggagccatttccagacggatttctacgccgagacggtcgcgcggccggaggtgcgggagagctgcgacctcctggccgccctcgattgcgacgagttcctggtcgcgaccagcgggaggccgatccccgccacgctggcggagctgttcgccgacgcggcggtgagcgcggtggcgctgaactgggcgaattacggtaccgcgggacgcgaggagcacgatcccgggcgcctcgtcatcgagcagtacgaccggcgggcggtggagtcgaacccgctcaacacgcacatcaagtcggtcttccggcccgagcgcttccgcggcttccgcgtgaacgtccacgcgatcgacatggattacgggctctatcgcgcggcctcgggcgcggaggccgactgggacaggacccgcgcggcgcgcgggatcacccgggtgccggactggaccaacctgcgggtcaaccactactcgacgaagagccggagtgccttcgtgcagcgcaagctcaggggcagcgccgcggacggggccgccaccgaggcgttccggcgccacgcggactacttcgccctgcatgacaccaacgacgtgcaggaacccgtcgtcccggccgtgatcgccgagacccgggcggagatcgcccggctcgaggccctgatcgcgaaggcttga

SEQ ID NO: 7982 - DNA, 1350 bp, Methylobacterium sp.
ttgttctacgagttctcgctcgatacccacgttcccgtcgatcatctgctgcgcgccatcgatcgcttcgtcgacctgtcgggcctgcgcgcgcatctgcggcccttctacagcacgacgggtcggccttcggtcgatcccgaactgatgatccgcatgctgctcgtcggctactgcttcggcatccgctccgagcgccgcttgtgcgaggaggtgcacctcaacctcgcctaccgctggttctgccggctcgggttggaaggcgcggtgcccgaccactcgaccttctcgaagaaccgccacggccgtttccgcgacagcgacctgctgcgcgaggtgttcgagatcaccgtgcaacgctgcatcgatgcggggctcgtgggtggtgagggcttcgcggtcgacgctagcctgatccgggccgacgccaacaagcagcgctctgcggacgcttctgagtccgtcgattgggacgacttggcccggactcgccggtcggtgcgcgagtacctcgacaccctcgacgaggctgcctggggagccgcgagcgagagcacgccgaagttcatctcccgctccgatccggcggcgcagtggacgggcgcgatgaagggccatgccttcttcgcctacgccaccaactacctgatcgacctcgaccacgccgtgatcgtcgacgtcgaggccagccgtgcgatccggcaggcggaggtcggggcggcccgtaccatggtcgcgcgcacgcaggatcgctttgggctatggccggcgcggcttgcggcggacagcgcctacggctcggccgaacacctcgcctggctggtgcacgagcgcgggatcgagccgcacatccctgtcttcgacaagtccgagcgcagcgacggcaccttcagccggtcagccttcacgtatgcccctgaagccgacgcctacacttgcccggccggcaagccactgcggcaacgccagaaggtctaccggacgccgcccccgctggtcgatgcggatgggatgatgcgctaccacgccagcaagcgtgactgcgacgcctgcgcgctgaagcctcggtgctgtcccaacacacccgcccgcaagatcccccgctcgatccacgaaggcgctcggcagatggcgcgcgacatctgcgcctcggaggagggccgcacctcacggcgggagcgcaagaaggtcgagatgctgtttgcccacctcaagcggatcctgaagctggatcgactccggctacgggggccgaacggggctcgggacgagttccacctcgccgcggcagcccagaacctcaggaagctcgccaagctgatcccggtgccgcagccgagcccggcctga

SEQ ID NO: 7983 - DNA, 933 bp, Methylobacterium sp.
atgcgctgcttcgtgcgcgtggtcgagcgcggcagcctctcggcggtcgcgcgtgagctcgggatcggacaatcgacggtcacccggcagctgcgtgagcttgaggccgcgctcggcgtccgcctgatcagccgcaccacccggcgcctcgccgtcaccgacgagggcggccgctactatgcggattgcctagagattctgcgccgggtcgagcgggccggagaggctgtgcgggaccggagcggcgcggccgccgggacgatccggatctcctgcacggcagcgctcggggtgctgcacgtcacgcggctggtcttcgcgttccaggacagtcacccgggcatcgagatcgatctggggctcaccgacgagcggatcgacctcgtgcgcgagggcgtcgatctggccctgaggctcggcccgctcgcggacagcgcgctccggttgcgcaccctcgggcaaagcaggcggctgctcgtcgcggctcccggctacctcgccgcccgcggccggccccgcgttccggaggacctggccgcgcacgagggcgtacggatgacgaacgttgcgggcagcgacacgttggtgctggagggggcggacggcgcgtgccacgctgtcgccttcggtggtcggctacgggtcgaccacgggctcgccgcgcgcgaggcgttcgtcgcagggcgcggcatcgggccgacgcatcactggctggtggccgaccatctcgcggccgggcggctggaggaagtcctgccggagtaccggctgcccgccgtgccgctcagcctcctgatcgtgccggagcgggctgagatcggccgggtccgcctgctcgtcgatttcctcgcggcggccgtcggcacaatcccggggatcgtcacgccgcgccccggtcctgcggcgcgactggcgaccacccctctgggatag

SEQ ID NO: 7984 - DNA, 990 bp, Methylobacterium sp.
atgctgccctatcccgtgctcctggcagatatcggcggcacctacgcccgctttgccatcctcgccgcgccggaagcatgccccggcccgatccggaaggtgccgacagccgccttccccgagcccatcgcggccctgcaagcctacctcgacggtccggggacgccgcagccgcgctccgccttcctcgccgccgcggggcgcgtcgacgggcaggccacgcgcatgaccaacgcgccctggctgttcgacctcggcgacatcggcgtcgccctcgggctggaggcggcgcggctggtcaacgactacgtgccgcaggcggccgcgttgcacgtgctcgacgaggcgaacgcggccgacttagcgcggatcgggcccgtcgcggccggaagggggccccgcctcgtccttggcccgggcaccggcctcggcgccgcggccctggtcccggtgggcgaccgcctcctggtccagacgaccgaggccggccacgtcgggttcggcccgtgcgagcgcgacgaactgccgtggcaggccctgatgccggcggaggggaggcttaccgccgaagccctgctgtccggtcccggcctcgccaggctcgcgcgggcgctggcggcgttgcgcggcgtagccgcctggcaatcgccgccggaggtgctcgaagcggccaaggtcggcgatccgctcgcgcaggaggccgtccgtcagttcgcgcgcctgctgggccggttcgccggcgaccttgccctgatgttctcggcgacgggcggcgtctatctcgccggcgggatcgcgccgcgcatcgtcgaggtcctgcagggtgaggcgtacaacgcggccttcgaggacaagcccccgttccgcgaggtgatgcagaccatcccccgcttcgtgatcacgaggcccgagccagccatcgacgggttggcgtcgctcctgcgcgcggcggaccgattcctgttccccggccaggactggcgggcttga

SEQ ID NO: 7985 - DNA, 1437 bp, Methylobacterium sp.
atgacggcctatttcatcacctgccatgcatccgtcgcctacgttcgtgaccagttccggtcgctctatgggccggagcacctgctgctctaccacgtggacgcgaaggcgcccgctgccctgcacgagacggtgcggcgcttggcggagaccttcccgaacgtcgtggttctgccgagtcggcattacgcctgggccggctactcgcaggtcgccacgacgctggcggcgatcgactgcgctctggcatccgggcccgattggtcgcatctcgtggctctcagcgagcagcattgccgtgtgctggacgaggcggagcttgtggcggcgctgacgccgggcgtgtcctacgtcgattccacacctttcagtgccatgaatcccggctttcaagccgacatcgcccatcgcttcagcatggattatcgtgagctgccgggcatcggcagcttcggaatcgcgccggtcgcgcccgacccggacttccttggccgccttcggcacggcagcaactggtacatcctctcgcggcaagcctgcgcctatctcggcacggccgcccgcacggccccggatgccgcgcgcctgcgcgctgcggtccatccggacgagaacatgctccagacgctgctcgcggccgacggcggacgcgcaggcccgatccagcggcgcgagaccaccttcgtggcctggccgcacatctcgggcaatcccgacatgaccttccgggcggaggatttctcggccgctcgcgcgggcgaccggctgttcatccgcaagcgaccggcgcagttgcctgcgccagtcgccgccctgcttgatgactgggcgtctctgagcgaggctgagctctccgagcggatcggtgccccgctggagctcgcgccggaagcccccgaccccgagggaacggcgctggcccgccgcgtggcgagccgggtggtgcggcgcgggcgcggcgtgcaggccgacctgccgaacctccggttcggcctgcgcaacccgcgcttcagcctgcgcttccgcacggcgcggatcccggatggcatcgacgtgcgcatcctctcgcaggatctccggcacttccgcgtcctgcttctggaggccgagcggccggagatcgacttcgcgccgcgccggctccacggccggccggccccgctcctgcggatccgcgtccccgaattcgatttccgacgggagatcctggtgttggaggacccggcgcacggcttctggacccggccggaggatggcagcgtgaccgggctcgtccggctcatcgagctctatctccgcgtggccgaagacctcgcgcagacgcgggcgcccgaaccggcccggggccctgccgcggcgcggcgcgagatgagcgcgcgcgcgcggagtttcgcctggagcctgcgccggctcctcaaacggaaacggccggcctga

SEQ ID NO: 7986 - DNA, 789 bp, Methylobacterium sp.
atgaacgtcttcctcgtcctcgcgcatcccgatccccgctcgctcaacggtgcattccgcgacgtggccgtcgccgaactccgggcgcaggggcacgaggtgcaggtctcggacctctgcgcggccggctggaaatccgcggtcgatgccgccgacttcccggctcgcgcagttggggaacggctctcggtcgcctcggcctcgcagagagccttcgcggccggcgcactcaccgacgatgtccgcgcggagcaggagcggctcctctgggctgatgccgtgatcctgcaattcccactctggtggttcggcatgccggcgatcatgaagggatgggtcgaccgggtctatgcctgcggcttcgcctacggcgtcggcgagcacagcgaccggcgctggggcgaccgctacggggagggcaccttcgcgggcaagcgggcgatgctgatcgtgaccatgggcggctgggccgaacattacggaccgcggggcatcaacgggccgatcgacgacctgctgttcccgatcaaccacggcgttctgtactatccgggcttcgcggtgctgccgcccttcgtggcctaccgcaccgaccggctcgacgcggccgggttcgagacggaagcggagcgcctgcgcgcccggatgcgcagcctcgccgacacggcgccgattccctaccgacgccagaacgggggcgactacctgatccccagcatggagctgcggccggaactcggcgcaccgggagcgaccggcttcgcgctgcacctgcgcccggaaacctga

SEQ ID NO: 7987 - DNA, 282 bp, Methylobacterium sp.
atgcgtaccgtcctcctcatcggcctcgtcggctgcgtcgcggctgccagcctcggccatgccgtcaccgccgccgagccgcccgccttccgcgccgtcgccctggtgtgcccggccggtatcgagggccccgactgctcgcgcgagaacgccctggacatcgccgtccagccggtcgcgcatgagaccgagtgcgggctggtcgggcaggtcctggcctcgcacctcacgctgcagccgggcgagcggcacaagatcgcctgcgagcggcggaggggctga

SEQ ID NO: 7988 - DNA, 1248 bp, Methylobacterium sp.
gtgatcagcggcgcgacgcgcggtaccgggcgcggcggggccctcgcgcgccacctgatgaaggacgagaacaaggccgtgctgatcccggcgcgcgccctcggcagcccggacctggcgggacagctgcgggagttggtggcgcaatgtgccggcgggcggaccgaccggcccgtctaccatgtgttctgcagccccgatccggccatcgccgacaacgcggcggcccggtcacgcttctggaacctctttgaacacgagttcggcatgaccgaccagccctactgcggcgtcgagcatgccaaaggcggtcgcctgcatgagcatcgcgcctacggcctggtccatccgacgggcgcggtggtcgacctgtcctgggactatgcccgccgcgagaagtgcgcgcgtatcgtcgagagcgagttcgggctgtccccggtggcgtcgaagcacgcgcgggccgtcgagcgcgcccttcgccgggagggacgctccgacgtggccgactggctcgccgcgtccggggcgaccgtggccgagcggccgatcgcgcggctcaccccacgggagcgcctgatcgaggagcgcacgggcgtgccgctcgacgacctccgacgtcaggtgttggcggcttggcgcgagaccgcggacggccctgccttcgcggcggcactcgcggctcgcggcctcgtcctgcggcggggacgggtcggacccgtcatcgtcgacgcgagcggcacggcgcgcgcggccacgcgcctcgtcggtgcggcggcccggcgcttcgagggcacgcgcatccgggcggcgacggtgaaggagcgcctagccgggctgaggttggaaggagttgacgatggacgatgttcaggtctcgcggcggctggccgcgatggaggcgctgttgcagggcatcctggcggccctggcgccgccgggatcggagtcggaggggtcgggcttcgacgacctggtggaggcgctgtcggacctgacggtggcggtggccgacatggcggacacggtccgggcgctgcgctcgaccggctacgtgccgcctccggcgcccgccgcgccatgatgcgtcgccacctcgcgggcctcgacgtgtccctcgaccgctaccgggccgccgccgagcgcgcccgtgcagccgccgagcgcctcgacgaggttgccgacgcccgccagaggcgagggatggcgctgtggggcgtcaccgacatctggggcctgccccttcaatga

SEQ ID NO: 7989 - DNA, 432 bp, Methylobacterium sp.
atggtcatcccggcccgcggcctcggcagcgcggatctcgtcactcagatccgcgaactcgtcgcgatctcgctgggcgggcgcacggaccggctcgtctaccacgtgcatctcgaccccgacgtggggatcgcgaacgaggctcgcgcaagggcgcggtggtggagtctgttcgaggcggagttctgcctggaagcgcagccgtactggggggtggagcatcgcaagcacggtcgccgccacgagcaccgcgtctacggcctcgtgcgcccctccgggtccgtggtcgacctcgcctgggattacgcccgccgcgagaagtgcggccggatcgtcgagttcgaattcggcatggcgccggtcgcctcgaagcatgcccgcgccatcgcccgccacctccgcgaggagggtcgcgcggaggtggccgactga

SEQ ID NO: 7990 - DNA, 819 bp, Methylobacterium sp.
atgcgccgcggcttccgcacccggctcctcgggatctcgggcaagctcatcgtcgggctgatcctcgccttcatcgtgctgccggccctcgtggtgacgctcgccgccttcaacgaccgggcgatcctgagcttccctccggccaagtactcgacccgctggttcacccgggccctgacctaccgggacttccagaccggcctgtggaacagcctcgtggtcaccgcctgggcctccacgatcgcgctcgtcgtcggcaccggcttcgcgatcgcgctgaagcgctacgccttccgcttcaaggcggcgctcgagggcgtgctgctctcgccgctgatcgtgccgcacttcaccatcggtctcggcctcctggtgctcgccaccggcatcggcgcggcgcggggtttccccgtcgtggtgctcacccacgtcgtggtggtgctgcccttcgtgatccgctcggtctacatctcgctgcagaacatcgacgagcggctggaactcgccgccgccagcctcggcgcccggccgggccgcgtgctcggcaccatcaccctgccgctcctcgcgccgggcctcgtcagcggctggttgttcgccgcgatcctctccttcaacgagttcaccgcctcgctcttcgtgacgggccaggcgacccagaccctgccggtcgccatgtacggctacgtccgcgagttcgcggacccgacgctggcggccgtctcggtcatctacatcgcggtgacggcgctcgccctgaccgtcgccaacacgttcctcgggctcggcaaggtgctgaatgttgagcaaggccgttga

SEQ ID NO: 7991 - DNA, 1167 bp, Methylobacterium sp.
atggcgctcggcatcacgcagatcatcctgtggggcggcaccttctttctgatcgcggtcgtctccgggcccatcgtcgcctccacgggatggccgcagggcatcgtcgtcggcgctctctcgctcgccatcttcgtctcggggctgcctgcgcccctcgtggggcgcttgatccggcgccacggcggccggccggttctggtggcaggttccgtgctcgtcgccgcgggcctcgcgctgatggccgctgcgcacagcctgccgatgttcctgctcgcctgggccgtcacaggcatcggcatggccgcgagcctctacgatccgctcttcgccgcgatcggtcaggcctacggcaccgccgcacgcggtgcgatgacccagatcgcgatctcgtcgggcttggccgtctcgctctgctggccggcgacgagcttcctggtcgaccggatcggatggcgtggggcgtgcctgacctacgcggtgctggcggtcgtcgtcgtcgcgccgctctatgcctgggctctgccccgacaggggcggatgaacgccgccgaaccggagccggcgaccgatcccgcgccggtcgctccaccggttcctgcgcgcctgccgggtgagcgcatcctggccgcgacgttcacgacagcggccatgatcatgacggcggtctcggtgcagctcccgctgctgctccaggccctgggcatcctggggagcacggcggtcgcgctgaccacgctgattggcccgtcccaggtgggcgtccgcgtggtcgaactcgccttcggccaccgtgcccatccggtctgggcgcttctgatgtcgagcgcgagcgtcggactcggtctgctgctcctcgcggcggccccatcggccgcgtggctcgcgatgattctgcacggggccggcaacggcatgcgcaccgtcgtgcggggcaccttgccgtacgcgctctacgggcagcgggagtacgcggcggcgatgggccgtctcgcgcgcctgccgcttctcggccaggcggtgacgccgctcgcctgcggctacctcgcggaatggttcggccccctggcgctcctccacctgctgctcgtcgtcgccctggtcaatctcggcctctccctgctcgtcgtccgccatgccaggcgcccagcgatcgaaccggcctga

SEQ ID NO: 7992 - DNA, 192 bp, Methylobacterium sp.
atgcccgcgccctggctcggggtcctccggctggcgatccgcttcggcctcccgatggccggcctcgtggtgatcggccacgcggtgatcatctcggtcggtggcgacatcgagcgctggcagttcgcgctcggcgccctcctgatcgcgtcgagcttcgccgcccgtctcgtcccgcgaggctcgccatga

SEQ ID NO: 7993 - DNA, 1869 bp, Methylobacterium sp.
gtgagcgcgtcccgtccgcttcgttcccaccagcgcgccctgctggccctcgtcggcgcgatcgcgcgcggcgaggcgacgggggtgagcgatatcctggccgcggtgacgcccggcggcggcaagtcgctgctgccggtgatcgccgccgccgaactcatcgcggctggccggatcgaccgcgtcgtctgggtggtgccgcgcgattcgctgcgtctccaggcggaggaggccttcgccgacccggcctggcgcgccagcctcggccacgccttgagcgtgcgcgccgccgacaacgagcccgatcccgcccggggactcagcggctacgtcaccacctatcaggcggtcgccgccgcgccggccctgcacctcgccgaggcccgggcgcaccggacgctgctcgtcgtcgacgaggtccaccacctccccgtgccgaacgccgtgcgcggccgggacggcgagccctccgacgaggaggccgaggccggcgcctggagccgggcgatgctgcccctgttccgggcggccaccctgcgcctcttcctctccggcaccctggagcgggcggacgggcgccgcatcctcgggctgccctatcacccggcgagcgcgggccgggggccggaggtgaacatcgaggcaccgggcctcgcggtgatcggctattcccgcgtgcaggcgttggccgagcgcgcggtgctgccggtgaatttcggcgcgctcgacggcgaggcgagctggcttgaagcggggcaggcggcgggcgccgcgccgcgggtgggtccccaccggcttggcggaggcgtgcgcgtgaccacgcgtcccgccctgttcacggcgctccgcacgggcttcgcccgcgacctcctcggcgaggccttccacgccacccgccgcatccgcgcccggcgtcgcaccgagcgggggctcggaccggccgagccggcgctcggcctcggcaagctcctcgtcgtcgcccccgatcaggagagcgcccggcgctaccaggcgatgatccagggctggatgccgggaccacaggccgagcgggacgtgcgcatcgccacctcctcggctcaggacgcccacgcggcgctcgccgccttccgcctgctcccggagcccgccatcctggtcaccgtggcgatggcctacgagggactcgacgcgcccgaggtcgcggtggtggcggccctcacccatatccgctcccggccctggttggagcagatgctggcccgcgcgacgcgggtcgacccgaacgcgggcgcctacgacggccagcaggcgctggtcttccaccccgacgacccgctcttcgcgaagttccgcgaggagctggagaccgagcagggcagcgccccgcgcccgcgggagaaaccgcgcctcaccgccgtcacccccgagccggtgcgctggcgggacgagacgccccgggggatcacgccgctggagagcaacgcgctcggcctgcgctacgccatgctccgcccgcgcacgccggcgccggatgcgcccttgcgggacgcggcgcccgcgcgggacggaccgccctcactgaccgagcggtccctgcgccagcgcctcgcggcgcaggtcgccgcccaggccgtcgaggacgaggcggcctggcaggcgccgcgcggcggcaatctcgcccatcggtacaacgcggtgttgaagcgcgtgaccggcaaggaccggggctcgatgaccctggccgagctggaagcggccctggcctggctggagcgcaaccgcctctccgaccatgcgcacctgctcgaaggcgacacccgctatgcgtggtccgtccgccagcgccgccggagctgggcgccggccggacgccgggcggagggctga

SEQ ID NO: 7994 - DNA, 939 bp, Methylobacterium sp.
atgaacagcacagacctgatgtttttcgtggcagtggccgaggcaggcggcatcggccgcgcggccgccgcactcaacacggtgcagtccaacgtcacgggtcggatccgtgccctagagcaggccttgcacacgccgctgttctaccgcggtacccggggggtgacgctgacccgagccggagaacgcctgctcccctacgcgactcaggtcgcgcgcctcctggccgatgccgagcaggccgtcctctccgacgaggtcccccgagggcccttgcgtctcggctcgatggaaacgacggcggcgttgcgcttgcccaagctgctgaccgcctatgctcagcgctacccggaggtggacatcgagctggtgctaagcccgaccgaggcgttgatcgcggccgtgctggagcgcaaggtcgaggccgccttcgtctgcgggccaatcagccaaaatgatctggcttccgtccctgtgctggaggaggagttggtgttggtggccggcgcccgaatccggaactacaacgaggtcgtggcgacaatggcgagccggcgcgaggcgcgggtcctcgtgttcagaacgggctgttcctaccgctttcgcctcgaagcctttctggcggcccacggcttggtgcacgttcgtcggatggagttcggcaccctcgacgggatcatcggctgcgtcgaggctggcatgggcgtatccctgctgccgcgagtcgtcgcggagccgatgcagcaaactggacgggtgtcgattcacgcgctccccgaggggacgggcatcgcgcagacattactagtataccgcaaggacagcttgctcactgcggcgtatgagcgttttctcgaccatatctatgaggtcttcggcctgccgtcacatgtcgatgtgtcgcccccttcccatgagaggcatgtctcgagcagctga

SEQ ID NO: 7995 - DNA, 1419 bp, Methylobacterium sp.
atggcgccggacacggtcgccctcgatctgccggaactcggcaagggtcgtcacaccgcccgcctcagcctgatcggcgtgatcgccaccttcggcgggttgctgttcggctacgacaccggcgtgctgaacggggcgttgtcctacatcgccgactatttcggcctgtcgccgctccaagaggggttcgtcaccttcagcctgctgatcggcgcgaccctcggcgccctggccggcgggcggatctcggaccggatcgggcggcgggtcaccatcacaggcctcggcgccctgttcttcgtcggcgcgctcggctgcgtcctggcgccgacctacgacatcctcatcgtcttccgcgtggtgctcggcctcgcggtcggcggcgcgtcggtcacggtgccggtctacctctccgaggtcgccccggcggagcagcgcggcagcatgatcggccgcaacgacatcatgatcgtgtccggccagttcctggccttcctgttcaacgccgtcatcggcaacgtgctgggcggcaacgagcacgtctggcgcatcatgctcgccgtcgcgctcctgcccgccgtcgtcctgttcctcgggatgcgccggatgcccgagagcccgcgctggctgatggcgcagggccgctcccccgaagccctggacgtgctgcgcacgatccgctccgaggcccgcgcccaggccgagatggaagaggtgcgcgtcctcgcgcggctcgacgcggtcaagcgctcgaccagctggcgcgacctcgtggcggagccctggctggtgcgcctgctcttcgtcggcatggggctggccgcgctcgcgcagctcaccggcatcaactcggtgatgtattacgggacgcaagtcctggagcaggccggcttcacccggaacacagccctgatcttcaacgtgctgaacggtctgatcagcatcgtggcgatgctcgtcggcgtgatggtggtcaaccgcgtcggacgccgctcgatgctgatcctcggcttcggctgcgcgacggcgctgcacgtcttcatcggcgtgatcggcatcgtcgtgccgctcgacaacccggcccggccctacctcctgaccgtcggcatgttcggcttcctcgcgatcgtgcaggggaccatccagctcgtgagctggatcatgatgtcggagatcttcccgctgcgggtgcgcgggctgatgatcggcgcgagcgtcgcggttctgtggctcaccaacgcgctgatctcgctcgccttcctgcctgtcgtgcagaccctcgacttcgcgaccttcttcctgttcggcggctgctgcctgttcggggtggtcttcacggcgcgctggctgccggagacgcgggatcggagcctggaatcgatcgaggcggagctgtccgcgggaggcgcccgtgtctga

SEQ ID NO: 7996 - DNA, 297 bp, Methylobacterium sp.
atgcgccgcgccgccgaccgtcgtcaggacagctacgcgatcgagaccctgagctacagcccgacccggatggtcaagctcggccgccgcaaggtggcgatgctgttccagcccgcggaagcgggcgcgccctggcagctctacccgaaccccgacgccttcccgggcctcggcttcgaggggctgcccgcgccgctccgccccgagttcatgagcttcccggacctcgccgcggtcgaggtttttctcgggatcagaggcacttcgagcgatgcggcgatgcccctggccgcctga

SEQ ID NO: 7997 - DNA, 1773 bp, Methylobacterium sp.
atgagccgatcgcaggatcgccgggtcgtggccgaagagctgcgcctcgtgctggacggcgtctctcaatcggtcgccgtgggattcctcgtctcgacgctgatgctggtcgtgctctggacgcccgcgccccgcggcatcctcctgagctggtacgccgcgttcctcatcgagcggatcgcggcggccctctacgcgcgacgcgcgcgccatgtcgtggaccgtcccgaccgcgcgcgccgggtcgagcgcatcgtcttcctgagcaagatcatcgagggctcgatcctgggctcgctgatctggatcgcgctgccgctgcagattcccgcggtcagcatcctgacgatgtccctgctgggggcgacctgcagcaacggcgtctcccttctggcgccgcgccgccatctgtatctcgcgctcgtcatccccgtcgccatgctggccgcgggagcgctgtggtcgctggggggcgctccctaccgggccctggcgatctgctcgatcctgttcgtcgtcgggcagtacggacaggtcgtgctcgccagccgccgcgtccgcgagtcgatcgaattgcgcttcgagaacatggctctcgtcgagcaattgcgcggggagagcgcggccgcccacgcggcgcgtcgagacgccgagcgcgcgaacgcagcgaaatcgcagttcctcgcggcggcaagccacgacctgcgccagcccgtccatgcccttggcttgttcctgcaggccctgagccagacggatctcgtcggcccgcagcgtcggatcctgcagaacgcccaggccgccaacgtcgcctcgacggacatgctcaacacgctcttggatttctcgcgcctggaggccggagtcgtcaccccacggccgagagccttcgaactccaaccgctcctcgacaagatcgagaacgacctcgcccatctggccgatgcgagacgcctgatctaccggaccgtcgaaacggaccgggcgatcgtttccgacgccgcgctcctggaactggtcctgcgcaatctcgtcctcaacgccatccgctacaccgatcgcggcggcatcctcatcggctgccggcgacgcgggaccaacgtctcgatcgacgtctacgacacgggaatcggcatcccggaaggcaagcgggaggacatcttccgcgagttctatcagctcggcaatcccgagcgcgatcgccagaagggcctcggactgggactcgccatcgcgcgggggatcgcgacctcactcggacatgcgctgtccctgtcatcgaaggaggggcacggcagcgtgtttcgcatcctcgtccctggaacggatgagaccgtgcccgacgtcgatgtcctggccgacatcccgaatcccagcgggctcgccggcgcgcgcgttctggtcgtcgatgacgacgccatcgtgcgcgacgcgatgacggcgctcctgaccggctggggatgccggtgctgggtcttcgaaggtccggacgacgtcgggcggcaccccgcgtccgaaccggctccggatgcgctgatatgcgacttccgcctgcgcgaggggcgaacgggcaccgaggccatcgcgctgctgaggcggcattgggggcgcccgatccccgcgatcctcatcaccggcgacacggcaccggcccgcttgcgggaggccttggacagcggaatcccgctcgttcacaagccggttcgccccgacatcctgcagaatgccctgctgtccttgatcgcgccggggcgaccgaccggaagcctctga

SEQ ID NO: 7998 - DNA, 807 bp, Methylobacterium sp.
atggatcaggcccgaaccggaccgccgccgctgctgaagatcaggaagctgcgcaagagctacggcacgaacgaggtcctgaaagggatctccctcgacatccacgagggcgaggtggtgtcgatcatcggcgcgagcggatcgggcaagagcacgttcctgcgctgcctgaacctgatggagacgccgacctccggcttcatggatttcgagcgcttcgccttcgactacgaggagggcgcccgccgccagccgacgccgcagcagctctgcgaattgcgggcgcggatcggcatggtcttccagagctacaatctctggccgcacatgacggtgctggagaacgtcaccgaggcgccgatccgcgtgcgccggatgccgcgcaaggaggccgtggcggaggccgaggccctgctccagcgcatcggcctctacgagaagcggcacgcctatccgtcgaagctctcggggggccagcagcagcgggtcgccatcgtgcgggcgctggcgatggcgccgaaggtgatgctgttcgacgaggtcacctcggcgctcgacccggagctcgtcggcgaggtgctggcgctgatgggttcgctcgcggcggacgggatgacgatgctcctcgtcacccacgagatggccttcgcccgggacgtcgggacccgcaccctgttcttcgacggcggcgtgatcgccgaggacggcccgcccgccgagatcatcggcgcgccgcggagcgagcggctccggcagttcctgcggcgcgtcctgcacgatccggcccggctcggagcgtcggcgtga

SEQ ID NO: 7999 - DNA, 414 bp, Methylobacterium sp.
atgcccgcgctcgacggtgtcctggagacggtcctgtacgtggaggatctcgcccgcgccgacgcgttctaccgcggcgtgatgagcctgtcctgcatccacgaggatttccggatgcgggcctacgacgtggccggccgcggcgtgctgctgctgttcccgcgcgggggctcgctggagccgatcgagatccctggcggcaccatcccgccccacgacggctcggggccgcagcacgtcgccttcgcgatcggggcggacaccctgccggcgtgggagcggcacctcgccgaggccggcatcgccgtcgagggccgcacccgctggccccgcggcgggcagagcctctatttccgcgatcccgacgggcatctcctggagatcgcgacgccgggactctggcggggctactga

SEQ ID NO: 8000 - DNA, 828 bp, Methylobacterium sp.
atgagcgacgccgacctcctggcgcccgtcagtgccaccgcgaccggtcgccccgacgacggccacgccccggcccagaccaagcgcgtcaccgacgcgctgctctacctcgacgacctcaaggtcaccttcgacggctaccgggcgctgcgcggcctctcgctcaccctcgaccggggcgagatgcgggcgatcatcggcccgaacggggccggcaagaccacgatgatggactgcatcaccggcaagacgcggcccgataccggcaccgcgctcttcgacggcacgcacgacctgacgaagctcgacgagccggcgatcgccgacctcggcatcggccgcaagttccagaagccgaccgtgttcgagagccacacggtggccgacaacatcctgctggcgctgaaaggtccgcgctcggggatggcctcgctgttcggctggcgcaaccgggtcgcggccgagcgcatcgacgcgctgctgacccgggtcgggctgatcgcgcaccggtcgcgcccggccgccgacctctcgcacgggcagaagcagtggctggagatcggcatgctgctggcgcaggaccccaagctcctgctggtggacgagccggtggccggcatgaccgatgccgagaccgccgagaccgcgacgctgctgcgcgagatcgcccgcgaccacgcggtgatcgtggtggagcacgacatgcacttcgtgcgcgccctccggtgccgcgtcacctgcctgcacgagggcgcggtgctggccgagggctcgatcgacgcggtctcggccgacccgaaggtggtcgaagtctatctcggccggtga

SEQ ID NO: 8001 - DNA, 696 bp, Methylobacterium sp.
atgctgacggtcgactccatcgatctgtactacggcgccgcgaaagccctgcggggggtctcgctgacggccgagcccgggcaggtcaccgccgtgctcggccgcaacggcgtcggcaagacctcgctgatgcgggccatcgtcggccagcagccgatcgccaagggctcgatccggctgggcgacacggtgctgtcggggctcgccccctacgaccgggcccgggccggcgccgcctacgtgccgcagggccgcgagatcttccccctgctcaccgtgaaggagaacctcgagaccggcttcgcgccctgcaagcgcgcggaccgctacgtgccggccgagatctacgacctgttcccggtcctgaaggacatgctgcaccggcgcggcggcgacctctcgggcggccagcagcagcagctcgccatcgcgcgggccctggtgacgcggcccaggctcctcgtcctcgacgagccgaccgagggcatccagccctcgatcatcaaggatatcggccgggcaatcacctatctgcgcggcaagggcgagatggcgatcgtgctggtcgagcagtatttcgagtgggcgcgcgacctctgcgacacctacgcggtgatggaccgcgggcaggtggtcgatgcgggggcgcggagggagatggacgaggcccaggtgctgcgctggctgtcggtgtag

SEQ ID NO: 8002 - DNA, 261 bp, Methylobacterium sp.
atgagcagcgaccgcgacgccccccaggacgacccgctcgacgacgcctcgcgcctccacgcgaagatcgccgcgctggagatcgtcctgggcgtcctgatcgggcgcctgtccgaggagaacccggagatccgcgaggacgtgaagcgggacgtctccgtccttctggccgacatggccggcggctcggagagcgaggagatgatcgtcgccgaggtccggcgcgcggcggacgtgctcaccggcgtggcgatcggctga

SEQ ID NO: 8003 - DNA, 762 bp, Methylobacterium sp.
atggtcaggagtgacagacccgcgtcggtcaggccgaccctcgccgacgtcctggcggtcccggacgcgacgctgaagggcaaccaggcctacgacatcctgcggcgcgagatcgtctcctgccgcctcctgcccggcacccgcttcacggaggccgaggtgatggagcgcttcgagatcgggaaggcgagctgccgcatcgctctgcagcgcctgacccaggacggcttcgtgacctcgatgccgcgccacggctaccggatcgtgccgatcaccgtgaaggacgtggacgaggtcttctcgctgcgcgtggagctcgagcccctggccgcccgcggcgccgcgggccgcgtgaaccgcgcgcagctggaacggctggagcaggcctgccggcagcgcgtcacggtcgatgtcggcaaccagatcgacttctttctggaggccaaccgcagcttccacatggcgatcgcggtcgcggccggaaatcagcgcctctgccggatgctgtcgggcctgctcgacgagatgacgcgcctcgtcgccctcggcttcggcgtgcagggcgtgcggccgaacatcgagaacgatcacacggcgatgatcgagcatctggtggcgggcgatgccgagagcgccgccgtggtggcgcggcgccatgtcgagaccttccgggcgatgaccatggagaaggtcatcgcgagcctgcgcgacaccgccgtggtgcccgccgggctcgcgcggacggatgggagcgcgcggtga

SEQ ID NO: 8004 - DNA, 1422 bp, Methylobacterium sp.
atggcgatcatcgcgtcgattccgagccgcatcctcagcgccgtcaaacggtcgttccgacaatttctcactctgcccctcgcgaccgtgatcagcttcgtggttctgaatgccctggtttatctcgcggatcggtcctggtccggcggccaagcgccaaccggttaccgctggctcggggcgctgatcggggaccgcgctgcgctggggagcctgctcgcgaccttggcgacgagcatcatcacggtcacgtccatcaccttctcgcttcttcttcttgccgtgcaacagggcgcggccgccctgacagcgcaagtcacagatcagttcatggcgcgcaaagtcaaccaattctacttcggatatttcgtcggcttgtcgatttttgtcttgatgaccctggtcgcgaatacgagttttcaccggccggtccttgcaacggctctggctcttctgcttgccgctcttgctctgtgcctgatcatcgtgatgatctacaacaccatcgaccagatgcgccccgagcagatcatccagctcatccacgacaaggtgctggaagcccgcggtgcggaacttggtctgctcggagccacgcggcgggagcctcggcccggctgggccggcatcgcgtcgatccgctcccgcgagagcggctacgtcgtgggtctcgaccgcgtccgcatcgagaaggccgtggcacagtatgcaccgggcaacgtcgagatcgagagcctcgtcacggtgggaacatatcgcgccgtcgaggatcccgtgttcgaactgcggagccggcccggaagcaccctggacgcggatgcatgcacgggcatcgtcgacgcggcactggcggcgctcgcctatgacgacggacgcgatctcaggaacgatgcggcgtacggcctgcaccagctcgcgaccatcgcctggacctcggtctcgacgtcgaaatccaatcccagccccggcctcacggtggttcgggccctgcgggatatcatcgcgcggtggagccgcggtgagcgcgatctccgcggcgacaccagatcctgcatcgtctaccgggacgcggcccccacgatcgcgaccgatgccttggaggcggtcatcgtggtcgcgtcggaatcgatccaatcccagaccctgacggaggcggtcgatacgctcaccatccttctaggccatgtcgatcagcagactgcggagagacttgccgacgtcgccaatcgcgcactgtcgagtctcggagagcacgtcctcacgcggcaactcgacgtcgcgctggtcgatctcacgaaggctctcgaaggccgcggcttcgtcgccgttgccggagccgtctccaaggcttcgaccgagctcgcggttagccttggaaagctcaactcgcgctcaactcgggtaccgggagcaacgtcatag

SEQ ID NO: 8005 - DNA, 510 bp, Methylobacterium sp.
atgggggcgctcatgagcctctcgggcgaactctgcattgcggcgatcgacccgggcctcactggcgcgctcgccttctacttccccgcgctcccagaacgggtgagtgtcgaggacatgccggttgtggccaacgaggtcgatgtggcctcgctcgccaggcgcatccggcagatgggtcctagcttcgccattgtcgagcgggtcggacccatgccgcgggatggatgccgccaggcattcggcctcggcaccgcctacgccgcggccaaggcgacggtgacgctttgcgaggtgccattgcacctggtgtcgcctcagagatggaagcggcaccatcacctgcttggcgttgagaacggaaaggaggccggccgcgcgctcgccctccgcctcttcccggccagcgccgagcacttcgcccggaagaaggaccacaatcggagcgacgccgcgctgatcgcagcctatgccgcgagcgtccccgactatgcgggaggcgcccgatga

SEQ ID NO: 8006 - DNA, 1017 bp, Methylobacterium sp.
gtgtctgagcgtatccgcttcggggtcagccccatcgcctggatcaacgacgacctgcccgaactcggggccgggacaccgctggagcggatgttccacgaggccgccgcgatcggctacgacgggatcgaactcggcggcgccttcccccgcgagcccgcggcactctcggccctcctggctccgtccgggctggccctggccgcgggctggtacgccagcagcctgctcaccgtcgatgccgaggcggagatcgaggcgctccagccgcatcttcggctgctgagggcgatgggatgcgacgtcttcatcgccgccgaatgctccacctccatccacggcctgcgccgcgtgcccctggcccaccggccggtgctggactgggcgggctggcgccgcttcggccgggagctgacgcacctgtccgagtacctggcccgcgagggcttccggctggcctaccaccaccatctcggcaccgcggtccagagcgtgaccgacctgagcgcgatgctcgcccacaccccgagccatgtcggcctcgtgctcgataccggccacgcggtcctgggcgggatcgatccggtcgcgctgatccgcgaacatccggaacggatcgcccatgtccactgcaaggatgtgcgcccaccggccttcgccgccgtcgaggccgcgggaggcagcttcctcgacggcgtcctggcggggatgttcacggtgccgggggacggcagcctcgccttcggccctgtgctccgcgcactcgccgacatcaagtatcgcggctggctgatcgtcgaggcggagcaggatccccagatcgccgatccgcgcatctacggtcggatcgggctggagaccgtgcgtcgggaggcgatcggtgcgggcctgacgacatggacggggtcgctcgcccgcgcagcggtcggagcgccttcgcccggcaacgccccatcgcaatcgcccgcagcgacgctgttcccgctcgcggagctggccctgtccgggctcgcctag

SEQ ID NO: 8007 - DNA, 471 bp, Methylobacterium sp.
atgccgccagggttcaaggcgccgcgccgtggcgacattctctcgatcaacacgaaccccgtcgccggccgcgagatgcgggaccgccattactggatcgtgctcacccccgagccggtgaacaggctgggcctagccatctgcgtcgtcgtctcgaccgccgcggagggcgccagggcggcaggccttacggtacgggtcgtcgcggacggggtgaccggcgtggccatctgcacgcaggttcggagctttgatctgatggcgcggctccaggacggttcggcgacccgggcaagcgcggcgccggccgacgtggtggacgagatcgcggcgcggatcgccagcctgatcgagcaggcggcgcctgctacgccgcctgcgtgggcgcaggctcccaaggccgagccggcaggcacggcggcaggacagcgagccccggtaaatccgaaaggacggaagcgagagcggtaa

SEQ ID NO: 8008 - DNA, 618 bp, Methylobacterium sp.
atgaagctgttctacgcgcccggcgcctgctcgctctcgccgcacatcgtgctgcgcgagctcgatctgccgttcgctctcgaagccgtcgatctgaagagcaggacgaccgcggccggcacggacttcacggccatcaatccgaaggggtacgtgcctgccctgcagctcgaggacggagaggtgctgacagaaggcgcagcgatcgttcagtacctggccgacagatacgctcccggcaccctcgcccccgtcgccggcacggtcgagcgcgcacggctcaacgggcacctgaacttcatctccgcggaggtgcacaaggcgttcggccccctgttcgacccggcgctcgcatcggaggcgcgcaccgcgtcgatcgcgaaccttggtcgcaagctcgacgtcgtccagggtacgctggccgacggacgccccttcctcaccggtcaggacttcaccgttgccgatgcctatctcttcgtcgtgctgagctgggcgccgcatctcggcgtcgatcttgcccgctggccacgcctcgccgagttcagccatcgcgtctcggcgcgccccgccgtgcaggccgcgatgggggcggaagggttgcggaagccggcctga

SEQ ID NO: 8009 - DNA, 672 bp, Methylobacterium sp.
atgcaattcagagatgcacagtgcctggcgggcgcgcgccggtccgccgttgcgggcctgctggcgatcgcgctggtcggccccgtcacgaccgcggcaggtctggcggtcccggcggaggcgaccgacgatctccggacgctgctctggcccgggcccgacgcccccgcgcgcacggaccaccgcggccgcaccctcgcggcgtcggccctgcgggaccggatcgccgtggtcgccttcgtgggggccgattgctcgatcgtctgcgtgctccgcacgctcgcgctcgacaaggtcgcccgcgaattgcccgacgcgctgcgcgaccgggtcgtcgtgctcgggatcgacaccgacccggccggcggtccggggcgcctgcgcgccttcgcggacggcctcgtcggcgccgacacgccgctgcggctcctgcggagcgatgccgccggcacggccgcgctcgccgcgcgcctgcgctacccggcgcaggcgctgccggagccgccccccgtcgtgctgctgttcgaccggcgtgggcagatcgccatgacctacggcagcgacccgctcgacggtccgcgcctgctcgaggacgtcgcccggctcgagaccttcgcggacggcctcgaccggccggccgaagcctcggccggcccgagccccaccctctga

SEQ ID NO: 8010 - DNA, 618 bp, Methylobacterium sp.
atgagcggtcacctcccgaacaagcagcacgcgcacgccgagcgcggcaacgacctctacgagacacccggcgccgccgtgcgcgcgctcatcgccaccgagtggctgccccagcggatctgggagccggcctgcggtcccggcgcgatcgtgcgcgagctgcgcgccgccgggcatgacgtcgtggcgtccgacctagtggactacggctgccccggtcaggcggccggggtcgacttcctgaccgtccaggcggcgcccgacggcatcgactgcatcgtcggcaacccgccttacaaggacgccaacgccttcgtggagcgcgccatcgcgctctgcccgcgcgtgatgatgctgctgcgcttctccttctacgagagcatccgccgcggctcgattctcgacaccggcacgctggcccgggtgcactgtttccggaagcgcctgccgatgatgcaccggcatggctgggagggcccgaaggccgcctccgggatggccttcgcgtggttcgtctgggaccgctcgcaccgcggcgccacgctgctcgaccggctgtcctgggaggacttcgccgacgaggccgaatccgctcccgtcctcgcggcggcggagtag

SEQ ID NO: 8011 - DNA, 1572 bp, Methylobacterium sp.
atggcggaggcgtcctgccgcgccgtcactgtggctacgacggcgatcagcctcgtcctgtgctccccggcggcggccgcgccgacgaacgaggagctgtacgcaatgctgcgctcggtccagaccgagcaggcgcagctgaggcgtgagaacgccgaggccaaagccgacctcgccgaggcgcggcggcagttgcgggaagcccttggatccgcgcggctcctgcacaggcgcgatcccgccggcctcgctacggtgagcgttcctgcacctgtgcccgtcgcgcggcggctcgcaccgccgcccgccgtgtcgggagtcgtcggcgcggtcgagggcggagccggcggcttccgggcgggagcgggtggctacgccgcgggatcgctggcttttcccgtcggccggtcgttcggattgcaggcggatctggccatgatggccaacggcggcgatctcggcctgggcgcggccggacgcgccttcctgcgtgattctaacaaagggctgatcggcctttacggatcagtcgattacgccagcgcgatccgaagctacggccttcaggacgtgggtaccacgaccggccgcatcgccgcggagggcgccttgttcttggaccggctcaccctggacgggatcgccggctggcagctaggcgagcgcgcggaccgcttcttcgatcaagtcgacctgtcttggtacgcgagcgacgatctgcgcctcagcatcggccatcgctatgagaacaggatccacgccgtcgcggccggcgcggagtacctgctgccgctcggtagcgcggtcggcgtgtcggtgttcgccgagggccgcgtcgggagcaacgattaccgcgccggcctgggcggcttgcgcgtctacttcggccaggaggacaagtctttgctgcggcgccagcgcgaggacaccctcaaggtccgcctcatcgacgccttcgcgtcgcgcccaaagggcttccgcgtcgttccggctatcggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggcctgaccggagcgacgggtgccaccggcccgcagggtccgaccggaccgcagggaccggctggcccgcagggtccgaccggagcgacgggtgccaccggcccgcagggtccgaccggatcgcagggtccgaccggggcgacgggtgccaccggcccgcagggttcgaccggatcgcaggggccgacgggtgccaccggcccgcaagggccggctggaccgcaggggccgacgggtgccaccggaccgcaggggccggccggtccggaggggccgccgggcgccaccggaatttag

SEQ ID NO: 8012 - DNA, 837 bp, Methylobacterium sp.
atgagcctcgccccgccccagaccatcgaacccttcgccagcgccgccgcgaacatcctggcggcctcggatcagcggcggcctatcgcgccgctcaccgagcagaaccagtcgttcagcctcggcgacgcctaccggaccactgccgagatccggcgcctgcgcgaggcacgaggcgagcgggtggtcggccgcaagatcggcttcaccaacaccacgatttgggacgcctacaacgtcgcggccccgatctggggctacgtctacgacacgaccctgcaccggctcgccgacctcaccggccctgcctcgctcgcgcccttcgtcgagccgcgtatcgagcctgagatcgtatttgggctggcccgggccccggagccgggtatggacgggcgggaactgctcgcctgcctggcctgggtcgccccgggcttcgaggttgtgcagtcgctcttccccggctggcgcttccgcgcgcccgacacggtcgcggcgttcggcctgcacggcgcgctcttcatcggcgagcctgtagccgtgacgcccgacagcgaggccgtgtggctcgaggcactgggatgcttcgagatccagcttcggcgcgagggtgccgtcgtcgagaccgggcgcgccgcgaacgtgctgcgcggcggtcccctggcggcgctgcggcacttggtcgaggtgttggccggcgatccggctagcccggtgctcgccgtgggcgaggtcgtgacgaccggcaccctcacggacgcctacccgatccgggtcggggagacgtgggatacccgaatcgccgggctgccgctcaccgacatttgcctcgcgttctga

SEQ ID NO: 8013 - DNA, 96 bp, Methylobacterium sp.
atggccgtgatggccctcgtcctccagcacgaggggggcttcagcgccgaccgccgcgacccgggcaactggaccggcggcaaggtcaacaattga

SEQ ID NO: 8014 - DNA, 3126 bp, Methylobacterium sp.
gtgccagccagcagaagcctcagctacatcggctccatcgtgcgtcccggtcgcttcagccgcgaccagcgcaggaagcgctcccggcgcgcggcgcagatcgccgccatccgtgcgagcgcgctgttcgatgccaagtggtatctcgcccgctatccagagatccaacgggagggtatcgatccggccgttcactacgcgctccacggcggtcccgaggggcgctggccgcatccgctcttccacggagacttctatctcgctcacagcccggaagtgcgtgaacaggcccacaacccgctgctgcactacatcgagcacggcgcgcgtgagggccgcaatcccaaccccttgttcgacacgcattggtacgcggaaacgtacatggatggcggtgcggatgccgccaatccactcgcgcatttcctcgcacaggatgacgcggcgccctcccccagattcaatgcggcttggtacgcaacccagtacctcggtggatcggcacggcctgctgatgctctgattcactatttcacgatcggtcgggagctcggccattatctgagtccgacggccgacccttactttgtctacgccaagaacaaggtcgccacgtcgggcctgttcgatccggagttctacctcagcctcagccctgacgtcgcgaaggccggcatcgatcccctcgatcactacatgctggccggcgcgcacgagtcccggcgcccacatccgctgttcgatgtcgactggtacgtcctcgagcagcagccgaagctcgatgtccggaggatcaacccggtcctgcactatctcgagcagggcgccgcatcggggcgcgatccgagcccgtggttcaacacggcctggtacgctgcccaccacccggactgtctcacgtcatacgagacgccgctgtcccatttcctgcagaacggacatctcgggctcgcgccgtcgatctacttcgacagcgcgcagtacctgcgcgagaacgaggacgtggctcgcagcggtgtgaacccgctgtcgcattacctgaccgccggcattcgggaggggcggatcgctcgcttggtcgatccgcagcggcatcaccgttccgtcgccgacgccgctctggtctgtctcaaggcgccgaccgaggtcggaccgacggtcgccctgatggtgacgcacgcgccgaacggccgcctgaagggtcatgtcgagcgctacatccgcgcctgccgcgcgcaaggcatcgacgtcgtgctgatcgcggcggccgaccgccgtagaaccgccatcccggaagcggtcatcgatctctgcacgggcgtgttcgtgcgtcagaacagaggcttcgacttcgcggcctgggcacacatcctgctggtccagggcaacctgctcaactgcgactgcctgatcctcaccaacgacagcatcctggggccgctcgacgacaaggatttcgccgcgctcgtcaagggcgtgcgcgaggacgaagccgacctcgtgggcacgaccgacaactttcactacgcctggcacctgcagagcttcttcctcgcctgcaagcggcgcgtgctcaccagctacgccttcgcccattatctgacctcgatcgtcaacctcaccagcaagaaccacgtcatctcgatgtacgagctgaccttcaccctgcgtatgcgggcagcgggattcgccacgaaggcactcttcccgatggcgcccacgccggaggccgccgcaatcgatccgccgggaaaccgaaccattttccagtgggaccggatgctgcgcctgggcttcccgttcatgaaggcctccctggtcgtcggcgagcaccgcaagatcggtggcgaggccgtgcgcaccgctttggccgaacgtggtttcgacctcgactgcctcgaacccacctatcagtacccggggccgaagatctgggccgatctcgacagcgatccggctagccaaggctacgagacactcgcctatttcggccccacggactacgccaacggcctcggcgtcgccgcgcgcagctatctgcgcgcgctctaccgcctgcagcgcccggtcaacgtgcatgccacgacccgcgacttctacgtgcatgcccgggtcgcgccggactggcaggtcgcggccttctcaggcatgcccgacatcgcaatcgtgcacgtcaacggcgacggttgggagcctctgctcgacgcgggccagaaggcactcgtggcaggggcgcgccgccgcatcggcctgctcgtctgggaaacctccgtcgtcccgctcagctggcttcccaccatcgaccggctcgacgcaatctggacacccagtacctactgtgccgagatcttccgctccgtgacggacgtcccgatccacgtgattccccacgtcgttcagaacgaggagcccgagcgcgtcgatggcgccctgaaggcgcaggtccggcgggcctacggcctcgatccgaagcgccggatcgtcctgtacgccttcgacggatcgagcttcctcgcccgcaagaacccgttctcgctgatacgcgccttccgcgcggcgaaccttcaccgcaacggctggcagctcgtcctcaagacgaaacatctgcacgtctcgcccgacaaggggcggagcctgtttgaggcggtcggcgaaggtgcgtcggacatcgtcctgatcgaccggccgatgtccgatctcaacctccaggccctgttcgaccaagccgagatctatgcctcctcacacgcctccgaggggttcggactcacgatcgcggaggcgatggagcgcggcaaggtggttgtggcgaccgattacggcggcagccgcgacttcctcgacgcgtcatgcggcttcccggtccgcgcggacgtggtaccgctcaccgagagctacggcccctatctgcgtggctcgacctggggcctcgtggacgaaggggagctgacgcgtgtgctccgggagggcgctgcagcggtggaacagggcaaggcggcggcgatcggcgcagcggctcgggcgcgcgtccgctcccgactgtcgagtgaggctgtcgcgcgcgcgatggagaccagcctcgccgagctggaaatgatctggaccggcgaacccgtccggcgctga

SEQ ID NO: 8015 - DNA, 777 bp, Methylobacterium sp.
atgcccgcgaatgcccaggcaagcaccgccccttcggaggagatcgtgcagcgcatccgcgttgacctcgcggcggcctatcgcctgatccaccgcctcggtctcgacgacagcatctacacccacatctccgcccgcctgcccggctcggaccaccgcttcctgatcaatccgtacggcctacgcttcgaggaggtgaaagccggcaacctcgtcacggtggatctcgatggacgcgtggtggacgatcccgccggtttgggcatcaacccggcgggcttcacgatccacagcgccatccacgccgcccgcgaggacgcgctctgcgtgctgcacacccataccgtggcgggcgtggccgtctcctgccaggaggagggtctgctgccgctcaaccaatggtcgatgcagttcgcgggccgcctcgcctaccacccctacgaaggcatcgccctcgacctcgacgagcgggcccggctggtggccgatctcggcgacaagtccgtgatggtgttgcagaaccacggcatgctgacctgcggccgctcggtcgcggaggcgttcaagctgatgcacaacctggagcgctcctgccgcgcccagctcgccctccaatccgccggcgcgccgctggtccgcccgtccgccgccgtagccgccaagaccgccggccagtacgcgcggctctacgacaagatcgagaccggcggcaccgatgcggagtgggacgccttcaagcggatgctggagcgcagcgacccggattaccgcgcctga

SEQ ID NO: 8016 - DNA, 1227 bp, Methylobacterium sp.
atgcgcgcccgtcccgccctcgcactgatcctggcgctcgtgggcggggccgccgcggccgagcccgcgcagatcgggccgcgcccgttccacctcgtcgacgggatgaagcccggctccttgcaggaccggctgaaggcctgcggcacggagcgcacctacgtcgcgaagcaattctcgatctcccaccggggggcgccactccagtttcccgagcacacccgcgagggtgtgctggccgccgcccggatgggcgccgggatcatcgagtgcgacgtggccttcacgcgggaccgccagctcgtctgccgtcacgcgcagtgcgatctgcacaggaccaccgacatcctggcccggccggacttggcggcgaagtgcacgacgcccttcgcgccggccgacccggcaaccggccgcaaggcctcggcgaagtgctgcaccagcgacctgacgctcagtgagttcaagacgctgaagccgaagatggatgccgccgacccggaggccacgacgctcagtgcctacatgaacgcgacgccgcgctggcgcaccgacctccacgccgacggcgccacgctgatgtcccatcgggagtacatcgcgctggtgaggtctctcggccgccggttcaccccggagctgaaggcgcccgaggtgccgatgcccttcgagggcacctacacgcaggaccgttacgcccagcagctcatcgacgagtaccgcgaggccggcatcccgcccgaggacgtcttcccgcagagcttccagctgcgcgacgtgctgtactggttggcgaaagaacccgctttcggccgtcaggccgtcttcctcgacgatcgcgacgagcgcatgccgggcttcgacccgatgcagccggagagctggaagcccggcatggcggcgctgcgggaccagggcgtgcgcattctcgcgccgccgctctggatgctggtgacgacggatgccgagaaccgcatcgtgccctcggcttacgcccgcgcggcgcgggcggccgggctcgacctgatggcctggtcgctggaacggtcggggccgctcaagggcggaggaggcccctattaccgatcggtgcgccccgcgatcgaccgcgacggcgacatgctcaccctgctcgacgtgctgcatcgggaggtcggggtgcgcggcgtgttctcggactggccggccaccacgacgttctacgcgaactgcgtcggggcggagtag

SEQ ID NO: 8017 - DNA, 1017 bp, Methylobacterium sp.
atgctggcggggctgctctacggcctcatcttcgagatcgagcttctggtctccgccatccggggcgccttcatcggtgcgcccgtcctcctgtacgagcgcggcctcctgttccaggcttggcggaccctcgtccgccgtgccgcgaccccgatcttcgttgtggcgacgctcgccacctatatcgcgatgatcgccgtcggtaatgcaggggccgggacgatcctgcaccacgcgttcggctacatgccgaacccgcgcgtcgcgatgttgatgtcggaggccggtctcgcctacgcgctcgcgatctccgctctggccgccttcgtcttccgtatacgcgatctgatcggcccgcgcgtcttcgcgaacctgctgatcggccgctatcatcggccgatcagcgaggagcgcatcttcctcttcctcgacgtcgcgggctcgacgcgctttgccgagcggcacggggacctggcggcccagcgctacctcggcgcgatcttcggcgcgctcgccttgccggtgcagcgctcgcgaggctccatcgacgattacgtcggcgacatggctctggtgagctggacgatggagcagggaacgcgggatgcggcgtgtctgcgctgcgtgttcgatttcgctgaggttatcgctgccgacgccgagcgatggctgacagagttcggccaagtcccggacttccgcgccgcgctgcattgcggctccgtcgtgacagccgagatcgggctggagcgccacaagatcgcgtatttcggcgacacgctgaacacgacgagtcgtcttgaatccgtcgcgaaggaacttggcgtctccatcctggtttcgggcgacctgctcgatcggctcggcacgctgccgggtaccatcatcgtcgaggatctgggctcgcgtaccgtgcgtggacgccatgagccactccgtcttgcagccgttcacgacggctctaggccgagctctccgatgcaggcctcctcgatgcacggcaccgaaacgagctga

SEQ ID NO: 8018 - DNA, 624 bp, Methylobacterium sp.
atgatgacgattctcatcggctacgcccgctgctccaccgacaagcaggatctgacggcgcagcgcgccgcgctggaagcgctcggggtcgctccggagcgcatctacaccgaccatggattgagcgggacgaaccgggcgcggcccggcctcgaccaagcgctcgccgccgcccgcgcgggcgacacgctggtcgtgcagaagctcgaccgcttggcccgctccgtcccggatgcccgcgccatcgccgacggcttggtccgtcggggcgtccgtctcgccctcggggcgagcgtctacgacccgcacgatcccatgggccggatgttcttcaacatcctggcgaccttcgccgagttcgaggccgacctcatccgggcccggacgcgagagggcatggcaatcgccagggccaagggcaagctccgtgggaagcagccgaagctctcagccaagcagcaacgagaggtgaggcgcatgcacgacgtcggggaccactccatcggtgatctggcggaactgttctcggtctcccgcccgacgatctatcggaccctcgccagaagtatcagaatgcgtgctggcgagagccctgccgagacggtcaccggaacgctgtcatag

SEQ ID NO: 8019 - DNA, 414 bp, Methylobacterium sp.
atgctcacgccgttccacctcgcctaccacgtcaccgacctcgaggcggcgcgccgcttctacggcggggtgctcggctgccgggaagggcgcagcacggacagctgggtggacttcgatttcttcggccaccagatctcgctccatctcggcgaacccttcgcgacggcccggaccggccaggtcggggatcaccgggtgatgatgccgcatctgggcgtggtgctgccgctcgacgcctgggaggcgctggcggcccgcatcgcggccgcggggatcgccttcgacatcccgccggtggtgcgcttcgccggcgagcccggcgagcagcgcacgatgttcttcttcgatccgagcggcaacccgatcgagatcaaggggtttcgggatctggcaggcgtcttcgcgcactga

SEQ ID NO: 8020 - DNA, 816 bp, Methylobacterium sp.
atgagcgcgggcgccgcgggatcggcgccgtcgggcgccgctctcgaccacgtggtgatcaacgtcctgcgccgcatggacgaggccgccgccgccttcgcggcgctgggcttccagctcacgccgcgcgggcaccactcgctgggctccatcaaccacctgatgatgacgccgggaccctatctcgagctggtcggcctgcccgggaccggcccgcagcgccaggacgtgatcgactcgccgttcggcctgaacggtctcgtcctgcggagccgggatgccgacgccacccacgcgcgcctcgcggccgccggcctcgccgcgggcccgcccgtttccttctcgcggccggtcacggtcgacgggatctccgccgaggcccggttccgcaccgtgcggctgcccgccgtcctgttcccggcgggccgcctctaccattgcgagcacctgacgccggatctggtctggcggccggactggttcgcccatcccaacgggttcctcggcatcgacgccctgacggtcgagagccccgacccggagagcgaggccggccgctacgccgccgcctgcggcgccccggccgaatgcgtggacgggacctggcggatccgcctcggcgacatggcggtcgcgatcgtcccgggggagggggcgcgcttccgcgatctcggcctcgtcttcgccggactcgacgcgctcgcggcgcgggccggctccctgcccggcgccgcgtggacccggctcggcccggatacgggcgcgctggcgctccccgccctcgatctgcgtctcctgtgcagggctcgatcatga

SEQ ID NO: 8021 - DNA, 144 bp, Methylobacterium sp.
atggattcgagatcgtgcgttaccggggaggagcgcggccggttcaccagcctgcgtcagctcgatgaggtgccgggactttccggcaagaccgacggtgtgtccgctgcgctcaccgtcgagggtgagcgccaggagggctga

SEQ ID NO: 8022 - DNA, 948 bp, Methylobacterium sp.
atgtacattcccaccctggacgacatgcttgcggcgcgtgcgcgtatagagccgcacatccatcgcacgcccattctgacgtcccgcatcctgaacgaactctccggcgccgagctgttcttcaagtgcgagaacctccagaaggcgggcgcgttcaaggcgcgcggcgcctcgaacgcggtgttcgggctctcggaggagcgggcccgaagaggggtcgccacgcattcgagcggcaatcacggcacctgcctgtcctatgcggccagccgcaggcgcgttccctgcaccgtggtcatgccccgcaccgcgcctcaggcgaagaaggacgccgtcaggggctacggcgcgcgggtggtcgagtgcgagccctccaccacgagccgcgaggccgtctttgccgaggtggtggccgagaccggggcggagttcgtgcatccctacaacgatcatcgggtgatcgccggtcaggcaacctgctcggccgagatgatcgagcaggtcgacgatctttccgccgtcgtcgcgcccatcggcggcggcggcatgatctccggcacctgcctgacgctgtcgaacctggcgcccggcatcgagatcttcgcggccgagccggagcaggccgacgatgcccgcaggagcttcagggcggggcacatcatcgccgatgatgcgccgagcaccgtcgcggacggcctcaaggtgccgctgaaggatctgacgtggcacttcgtccgcaaccacgtcgccgacatccagaccgcctccgagcaggagatcgtctcggcgatgcggctgatctggaagaacctgaagatcgtgatggagccgtcgagcgccgtagcgctggccacgatcctcaaacacccggacgtgttcgccggcaggcgcgtcggcgtgatcatcaccggcggaaacgtcgatctcgacaagctgccctggaattga

SEQ ID NO: 8023 - DNA, 1191 bp, Methylobacterium sp.
atgagcacgcagaatccgatcttcatcccggggccgacgaacatcccggacgtgctgcggaaggcggtcgacatgccgaccatcgatcatcgcagcccgctgttcggcgcgatcctccagccggccctggctggggtgaagaaggtgctgaaggctccgagcgccgagatcttcgtctttccctcgacgggaaccggaggttgggagacggcgatcaccaacgtcctgtcgcccggagacaaggtcctggccacccggaacggcatgttcagccatcgctggatcgacatgtgtcgacgccacggtctggatgtcaccgtggtcgcgcaggagtggggcgaggggatcccgaccgaccgtttcgcggagatcctgaccgccgacacggatcaccggatcagggtggtgctggcgacccacaacgagaccgcgaccggcgtgcggtccgacattcgcggcttgcggtgcgccctcgatgcggcgggccacccggccctcctgttcgtcgacggggtcagctccatcgggtcgatggatttcaggatggatgagtggcgcgtcgacgtggcggtgaccgggagccagaagggcttcatgctgccgcccggcctcgcgatcgtcggcttctcccagcgcgcgctggcggccgtcgagaccgccaaactgccgcggaccttcttcgacatccgcgacatggcccggggatacgccagcaacgggtttccctacacgccgccggtcgggctgctcaacggtctgaaggtcgccggcgacatgctgctggcggaggggctcgacaacgtcttcagccgccaccatcggatcgcggagggcgtccggcgggcggtgggagcctgggggctgcgcctgtgcgcggtcaggtccgacctctattcggacacggtcagcgccatccgtgtgcccgatggtttcgacgccaaccggatcgtggcccatgccctccagggttacggcgtcgccttcggaacgggcctcggcgatgtggccggcaaggtcttccgcatcgggcacctgggcagcctgaccgaagtgatggcgctgtccggactcgcgaccgccgagatggtcatggccgatctgggtcttcccgtccggctcggtgccggggtcgcggccgcgcaggaatactatcgcggcagccggtccgccgtggaagcgcaggcggcatga

SEQ ID NO: 8024 - DNA, 243 bp, Methylobacterium sp.
gtgaagctcgcctggaagcacgtcccctcgcccgagttcgagccggccaccgtgccgggccgggcaaccaccgtgcaggtgatggtcaaggatgccatgcgctactctgagacgggtgggtgggggttcggacgcttcgtcaatggcgagccggtcgacgaggcgcagcaccagacctgcttcgcctgccacgaagcgcgtgtgaaggagcgcgacttcgtcttcacgcgctatgcccgctga

SEQ ID NO: 8025 - DNA, 1680 bp, Methylobacterium sp.
atgtcgcaacgacgcctgtcgctcggatccctgtcgatccgctaccagattctgctgccgcttctcggcttcctgctgctggccgggctgatggcggcgatcaccggcctcgtgggcctgcgggtctccgccgacctctcggcgctcgccgagcgcacggtggcggcgaacgaggcgagccaggccgcccgcgaccgcttccgccgggccgacgcggtggtggcccgggtgaccgcgatgacggacctgctcgacatggggcccgtcaccgccgagttccggacggccgccgacgcgctcggggggctgctgggggagctgcgcgcctcggccctctccgagcggatgggcgccgtggcacagacggcggacacggaggcccggcagtggcgcaccgacgccgaggtgctgctcggcctgcgcgcggcccgggagatcccgacgctggagcggatggcccggcacagcgagcgcctgcgccagcgcttcgacgaggcggtcgccctggcgggcgcggatgcacgggcgcagatccgttccaccgaggcggcggcgggccggcagatctggacgatcctcggcctcgcgggtgccgtgatcctggtcggctcgggcacggcgtggtggctcgcccgcagcctgtcccggcccatcgtcgatctgacggacgcgaccacccggctcgccgagggcgataccggcgtggtgctcgcggagggccggcgcgacgagatcggcgcgatgatcgccgccgtgcgggtgttccgggacaccatcctgcgcagccgcaccctggaggccgagacggcccaggcgggcgccgcggccgagcgccgcgcgatggtgaacggcctcgccgacacgttcgagcggcgggtcggcggcatcgtcggcctcgtcggcgcctcggccgggcagctccagacgacggccgagagcatgagcgcgaacgcccaggagacggcggacaagtccggccgcatgaaccgcgccgcgggcgaggcggccgccaacgtcgacaccgtcgcggccgccgccgcgcagctcggcgcctcggtcggcgagatcggccggcaggtccagggttcggcgggcctcgcccggaccgcggccgccgaggccggccggaccgccgaggtggtccaggcgctcaacggggccgccgcccagatcggcgacatggtggcgctcatcacccagatcgcgggccagaccaacctgctggccttgaacgccacgatcgaggcggcccgcgcgggggaagccggccggggcttcgcggtggtggccgccgaggtgaaggagctcgccagccagaccgcgcgcgtcaccgagcagatcaccgcccagatcgcgcgcatccagggggcgaccggcgaggcggtcggcgccatcgacggcatcaccggccggatcggggagatcagcgcggtggcggccgcgatcgcggcggcggtggaggagcagggcgcggcgacccgggcgatcgtgcaaaacgtcgccgaggcggcgtccggcacgcggcaggtctcgggccacatcacgggggtcgcgcaggccgccgggcagaccggtctcgcggccaatcaggttctcgacgccgccgccggcctcgcgcagcaatccgcgcagctgaaggacgaggtcgccgccttcctggtgcgcgtccgcgccgcctga

SEQ ID NO: 8026 - DNA, 285 bp, Methylobacterium sp.
atgctgctcggtgtgattgcattatcgttattcgcccccggttcgctggcggccaacccgtgccggccgacgctcgcggatttcaagtcgctcaagcacggcatgagctacgacgaggcggtgacccgcctcggatgcagaggccgcaggatctcgcacatccagatcggcggaaaccggcgcgcaacctattcctggccgggtcgcggctcctacggagcgaacctcaacctgaccttccgcaacaatcggctgaccagcacgtcgcagctcggcctccgctga

SEQ ID NO: 8027 - DNA, 366 bp, Methylobacterium sp.
atgttgaaggcgttcgaagaccgcgagcgcgcggcggaatacctgttcgcgcggaccgaggaggcgcgcttcgccgcccattgcggcagcatccgcgcgctcgccatcttcgcgatggccaagctcggcgtcgatggccgtacggccgaggcctatgcgcgggtgctcatcgcggcgatgatcgagggccagcacgacgaggatctgatcgcgcgcgtccaggcggatctgcgcgccaacggcatcgaggttccgcgcagcgagctgcagggggtggtgctgcgcgccgcggcgtcgcaggagatcctctcccgcatgggaccgcccgacgccgcgtccgcgagccggccggcagacccgcgctga

SEQ ID NO: 8028 - DNA, 225 bp, Methylobacterium sp.
ttgctggcctccaaatcagcggccctggccgccaaggaggccttcacctcgcaatacgcgacgggccgcccggacagatcggtcgggctgggcctcgacgagacgggcgagcactgggcggtcaaggtcttcgcgcactcgccgagcgccgccgagaaccttccggcgaagttccagaacttcgatgtcgaggtcagcgtcgcgacggcggccgtcggctactga

SEQ ID NO: 8029 - DNA, 756 bp, Methylobacterium sp.
gtgacggcgcccgtcgaccacgccgccgtggcggcgggcgcgaccgaggcgctccgggtgcgcgtgcgccgcggagacggcgtgcaggactacgcggtgccgcggcgcgccaaccagacggtgctcgacgtggtcacggagatccagcgcgagcaggacccgacgctcgcctaccgcttcgcctgccgggtcggcatgtgcggctcctgcggcatgacggtgaacgggcgcccgcgctggacctgccgcacccgggtcgccgccgtggcgccggagggggacctgctgctggagccgctgcgcaacctgccggtggtgaaggatctggccgtcgacatggagcccttcttcgagaagtggcgccgcgcccacggcttcttcgagccgggcgagaccccgccggacgacttcgcggcggtgcccccggactcgcccgcgcggcaggaggtcgatgccggcatcgagtgcatcaattgcggcgtctgctacgcggcctgcgatgtcgtcgcctggaaccccgactatctggggcccgccgcgctgaaccgggcctggaccctcgtcaacgacgtgcgcgaccgggggcaggcggcgcggctcgcggcggtggcgggcgatgccggctgccattcctgccacagccacatgagctgcaccgagcactgcccgaaggcgctgcagcccaccttcgccatcgcggggctgaagcgcgagaccggcaaggcggcgctccgccggctctgggggcgcggatga

SEQ ID NO: 8030 - DNA, 330 bp, Methylobacterium sp.
atgagcccgctcctctacctcgcccagcgcggcaccgccgcgatcctggcgctgacggtcgcggtccatctcggcacgatcctgtacgcggtgcggggcgggctgacggcgggcgagatcctggggcgcacgcagggcaatcccgggttcctcgcgttctacgcggtcttcgtgctggcggcggcgatccacgcgccgatcggtctgcgcagcgtcctgcgcgagtggaccggctggcgcgggcgctcgctggacctcgcgatgctcgccctctcggcgctgctcgccgggctcggcctgcgggccgcgctggcggtgtatctcgcatga

SEQ ID NO: 8031 - DNA, 345 bp, Methylobacterium sp.
atgagcgcgctgtccgtccatcgccgcccgggcttcgccgccgcgctgatccaccgcctctccggcatcgcgctggcgctgttcctgccgatgcacttcatcgcgctcggcaccgcgctccggggcgccgaccggctggagagcttcctcggcctgacccataacggcttcgtgcgcgcggccgagtggggcctcgtctgcgcgctcgccgtccacatggcgctcggcctgcgcgtcctggcgatcgagtggctgagctaccgcgagcgcacggccgtcgtcgtctccggctgcctcgcgggcgccttcgcggtcggcctcctcttcctgctcagcggggcctga

SEQ ID NO: 8032 - DNA, 612 bp, Methylobacterium sp.
gtggcccaccacgtcctcgacatgccggccgccgaggccgagatccgggctcttcggatcggcgacaccgtcaccctgcggcgctggctgttcggcatccgcgacgccacgctgatccacatgttcgaccgggaccggcgcacccggctcgacctcgccgggcacgcggtgatccacaccgcgcccaacgtccaccgcgtgcccccctcccccgaggcgccggtcggctacgcgccgttctgcatcggcaccaccacctcgatgcgcatggagcgcttcaccgatgccctgatggagcgggagggcgtgcgcctgatcgtcggcaagggcggcatgggcccggcgacgctcgacgccttcgccgagcggggcggcgcctacctcgccatcgtcgggggggctgcggcgctggagaccacctggatcgagcggatcgaggacgtcgacatggacgacctccaccccgagagcctgtggcgcttcgcgatccgcgatttcgggccgctgctcgtcggcatggacgcgcacggcggctcgctcttcgccgaggtgcagcgggacgtggccgcccgccgcgacgcggtgctggccagcctggaggcggcgcgatga

SEQ ID NO: 8033 - DNA, 1725 bp, Methylobacterium sp.
atgaccctcgaagaggtccggaccgacatcctgatcctgggctcgggcggggccggcctgttcgcggcgcttcacgccaaaaagacggcgcccgacctcgcggtcacgctcgccgtgaaggggctgctcggcaagtgcggctgcacgcgcatggtccagggcggctacaacgtggccctggcgccgggcgactcggtcgagcgccacttcatggacacggtcgagggcggcaagtggctgaacgaccaggggctggcctggacgctcgtcaccgaggcgcaggtgcgcatccgcgagctggagaccgagctcggctgcttcttcgaccgcaacccggacggcagcgtccaccagaaggcgtttgccggccagaccttcgaccgcacggtgcacaagggggatctgaccggcatcgagatcatcaaccggctctccgagcaggtctggcgccgcgacgtcaatcgcctggaggaccaccgggcgctggagctgatccccgcccgcgacggctcggggctcagcggtgtcctgatgctcgacatgcgcaccggcgagccgaagctcgtccgggccaaggcggtgctgctcgccacgggcggcgggccgaccatgtacaagtaccacacgccgtcgggcgacaagtcctgcgacgggctcgccatggctctgcgcgccgggctccccttgcgcgacatggagatggtgcagttccaccccacggggctgctcgcgggcgccggcacccgcatgaccggcacggtgctggaagagggcctgcgcggggcgggcggctggctcctcgattcgacgggcgcgcgcttcatggaggcctacgacccgcggggcgagcgggcgacgcgcgacatcgtcagccgctcgatcgtccggcgcatccgggacgggttcgccacaccgagcgggggcgtccacatccggatgagccatctgggcccggacgatgtgcgccgccgcttcaagggcatggtcgagcgctgcgccgattgcggcttcgacctcgcggagggcctcgtcgaggtgatcccgaccgcccactacatgatgggcgggatccagttcgcggcggactgcaccacggcgctgccgcgcctctacgcggcgggcgaggacacgggcggcgtccacggggcgaaccggctcggcggcaacggcgtggcgaactcgaccgtgttcggcgggctcgccggccagtccatggcccgcgcggttctcggcggcggcagcctcgccgatcccgatccggcggcgatcgaggccgggctcgcccgcgccttcgggccgctcggccggccggcggacgcactgcctgcgatccgcgaggcgctctacgagacgatgtggaacgatgtcggcatcctgcgcgacgcggccggcctgacccgcgcgctcggtgccctcgacggcctcgccgaggccgtcgcccgggcgggcgcgccggacggcgaccgccgctacgcgctgacctggatggaccggctgaacctcgagaacctcgtgctggtctcgcaggcgatcgcgcgggccgcgctcgcccgcaccgacagccgcggggcgcatttccgcgaggaccatcccgagacctcggacctcgccacctccgcctacacggtggtgcggcggcaggacgaggccttcgcgatcgcgatggagccggtcgccttcacgcatgtgcggccgggcggctcgctcctcgacgcggcggcctga

SEQ ID NO: 8034 - DNA, 300 bp, Methylobacterium sp.
atgccctacttcctgctccgcctcgagccgccgcgtccgagcttcccgttcgacgcgacggaggccgagaaggccctgttctccgagcacgcggcctactggatcgaccgcgcggagcgggggcaggccgtcgcggtgggccccgtcttcgacgcggccggcacctggggcctcgccctggtggaggccgccgacgacgcggccgcccgtatgctcggggccgacgatcccgtcatccgggcgggagccggcttcgtctacaccctctcggccgtaccgaacctgattctgcggcgttga

SEQ ID NO: 8035 - DNA, 804 bp, Methylobacterium sp.
atgaagatcgcggtgatcacaccgtcccggctgaagctgtcgacgctcgccggcgagaccgattccggcctctacttcctcgaacacgcggtccggagcgcgcaggcgcagcagctcgaccggccggtcgagctgcgcttcttcgtcggcgtcgatcccggtaccgagatcccggcgcggctggccgagcagccgaacctcaccttcgtgcacagcgaccgcaaggcgcaggtggcggccctgaacgccgccctcctggcggtggacgagagctgggacctcgtcggcttcctcgaggacgacgatgcttggctgccgcactacctctcggtcgcgatccgggcgctggagcagttcgacttcgtctcctcgacgcagctggaggtggacgaggccggcgaggccgtgcggatcaacgatttcccgacgccctccggctggctgatgcgccgcagcaccttcgatcgggtcggcgagatcagcatgtggtcgaagtggcactacgacaacgagtggctcggccgcctcgccgagacgggcctgcgccgggcccacctcgtcgaggcgaccgcccccgcgaccctgcaggacgccgcgcaggtccggccctggctcgccaacgtgctgcgcttcggcgggccgaacagccatctcctgcgccacggctccgtcctgcccctggtgcggcgcctcgtccatccgggctccggcacctcccagatcggcggcggcgccgtcgccaagcaggagagcgaggccgagtatcgcggcctcgcggaacggttcgggcgaattccgtggtga

SEQ ID NO: 8036 - DNA, 1515 bp, Methylobacterium sp.
atgttgcgtcttgccgccgcctgcctcgcatccgggctcgcgctcaccgcccccctcgccgcccagacttcaggtccgaccgcgggcccgaccctgcgctacggcctgatggaggatcccgacgccctcgacccgacgctcgcccgcaccttcgcgagccgcatggtcttcgccgcgctctgcgacaagctcgtcgatatcggccccgacctgaagccggtgccgcagctcgccaccaagtgggagctctcggcggacgagaagacactgaccatgacgctccgcccgggggtgagattccacgacggcgagcccgtgaacgcggcggcggccaagttctcgatcgagcgccacctgaagctgccgggctcccagcgccgcggcgagatcgcgccgatcgactccgtcgacgtggtcgacgacctgaccttccggatcaacctgaagcagcccttcgcgccgctgatggcccagttcaccgaccgggccggcatgctggtctcgccgaaggccgccgagcggctcggcgacaagttcgcgagcgggcccgtctgcgccggcccgttcaaattcgtcgagcgggtgccgcaggaccgcatcgtggtcgagcgcttccccgattactggaacaaggaccagatccacatccagcggatcgagttccggccgatccccgacaccacggtgcggctgacgaacctgcgcgccggccagctcgacttgctcgagcgcctcgccccgaccgacgcgccgcaggtggcgcgcgatgccaagctcaagctcgcctcgacctacgagctcggcttccagtccgtcctgttcaacacggccaaggccggatccgcgatcgcggacccgcgcgttcgcgccgccttcgagctcgccatcgaccgcgcggcgatcagccaggtcgtgttcaacggcgagttcctgcccggcaaccagtgggtctcgccgaagcacccggactacgtgaaggattacccgatcccgaagcgcgacgtggccaaggccaaggcgctgctcgccgaggcgggccagcccaagccccagatcaccctgatggtctacgccaacagcgaggccccgcaggtcggccaggtgatccaggcgatgacccgcgaggcgggcttcgacgtgaagctccaggccaccgacttcaccactgccctcgatctcgccgacaagggcaactacgaggcctacctctacaactggagcggccggccggacccggacggcaacaccttcagcttcctctcctgcaaggcgcccctgaactacccgcgctactgcagcgagggcgccgacgccgctctccaggccgagcgcggctcggtcgatccggagaagcggaaggccgcctggaaggcgctcgccgacaaggtcctgaccgaccggccgggcgtctacctgatgcaccgcaagctgctctgggcctacggcccgaagctcaccggcttcgtgccctatccggacgggctcgcccgcttcaccgggctgaagctgaactga

SEQ ID NO: 8037 - DNA, 915 bp, Methylobacterium sp.
atgagcaccggcacccctctcgccgaggcgcccggaatcgccgcgcccgccggccaagccgcgctcgtgcgcgagcccggcaccctcgcggccttctggcggcgcctgcgcgcgcggccgagcgccgtgctcggcctcgccatcgtggtcctgctcgtgggcgtggcggcgttcgccgacatcgtcgccccctacgacccgaccgccaccgactggggcgcggtgcgggccgcgccgagcctcgcccacccgttcggcggcgacgaggtcggccgcgacgtgctctcgcgcatcatccacggggcgcgcgcctcgctcggggcgggcctcgtctcggtcgcgctcgccgtcgccctcgggctgccgatcgggctcctggcgggctacgcgggcggctggatcgacgccctggtcatgcggctcaccgacgccctgctggcgatccccttcctgatcctggcgatcgcgctggccgccttcctgggcccgagcctcaccaacgccatgctggctatcgggctgtcggccacctcgaccttcgtgcgcctcacccgcgcccaggtgcgggcggtggcagccgaggagttcgtggaggccgcccgctccgtcggcaacccgccctggcggatcgccctggtgcacatcctgcccaacatcgtgccggcgatcctcgtccaggcgacgctgaccatcgcggcggcgatcatcgccgaggccagcctctccttcctgggcctcggccagcagccgcccgagccttcctggggcgccatgctcaccgtcgccaagaacttcatggaccaggcgccctggatggcgatctggccgggcctgtcgatcttcctcgcggtgctggccttcaacctgctgggcgacggcctgcgcgacgccctcgacccgaggcagcggacatga

SEQ ID NO: 8038 - DNA, 690 bp, Methylobacterium sp.
atgagcgcggacatgagcacggatatcgccgaggctccgggcgcccccctcctcgacgtgcgcgacctgcgcgtggtcttcgacgcggagggcggagctgtccacgccgtcaacggcgtctcctacacgctccgcgagggcgagacgctcggcatcgtcggcgagtcgggctccggcaagagcgtgcacgtgctcgccatgctggggctgatcccgcgcccgccgggccggatcgcgggcgggcaggtgctgttcgagggcgaggacctgctcgccctgcccgagcggcgcctgcgccggatccgcggcggccggatcggcttcgtcttccaggacccgatgagctcgctcaatcccggcatgacggtggcccagcagatcgtcgagcccctgcgcatccatctgggcctctccgcccgcgcggcgcgcctccgggcgcgcgagctcctcgacctcgtgcgcatcccgaacgccgccgcccgcctcgaccagtacccgcacgagttctccggcggccagcgccagcgcgtgatgatcgcgatcggcctcgcctgccggccgaagctcctgatcgccgacgaggcgaccacggcgctcgacgtgacggtgcaggccgagatcgtcgcgctcgtccaggagctgaagtgcgagctcggcatggcgatcatctggatcacccacgatctcggc

SEQ ID NO: 8039 - DNA, 921 bp, Methylobacterium sp.
gcccataccgctgcccccgccccctatcccgtcctctcggtccgcaacctctcgaagcactatccgctgcgcgcgtggtggggcggcaaggcgtccgtcttccgcgcggtcgaggatgtcagcttcgagattcgccccggcgagaccctcgggctcgtcggcgagtcgggttccggcaagtcgaccatcggccgggccgtgaccatgctgaacccgccgacctccggcacggtcgccttcgagggcacggatctcgccgggctcggcgcccgcgagatgcgccggatgcgcgcgcgcatccagaccgtgttccaggacccctacgccgccctgaacccgcgcatgagcgcgggcgactacgtcgcggaggtcttccggctgcaccggcccgggatggggcggggggagcgccgcgcggcggtggccggcctgttcgagcgggtcgggctcgatccgcgcttcatgggccgctacccgcatcagttctccggcggccagcgccagcgcatctgcatcgcccgggcgatcgccctcaggccgagcttcatcgtggccgacgagccgatcgcggcgctcgacgtctcgatccaggcgcaggtggtcaacctgctgcaggacctgcaggaggagctcggcctctcctacctgttcatctcccacgacctgcgcatggtgcgctatctctgccaccgggtcgcggtgctctggcgcgggcgcatcgtggagctcgccgacagcgaccgactctacgaggacccgcgccacccctacacgcgccgcctgctctcggccgtccccctgcccgacccggccgccgagcgcgcccgcctcgcgggcgccgtgccggaggccttcggcgcggggcggcccggcgacctcgtggaggtcgcccccggccactgggtcgcggccgacggctga

SEQ ID NO: 8040 - DNA, 477 bp, Methylobacterium sp.
atgcgcggcgccctcctgacctggccgttgctgctcctgctcctcacggctcccgcgatcgcgcagaagggcgtccctcggacgcacgaggccgccgagatcgagcatctcgtcgatgcggccgccgaactcctcgacaggcggggccggaaggcgttcgaggagttccggaagccggacagtccgtggcgacacgacgacctgtacctgttcgccatggacctttccggcaccgttctgttcaacgccgcgcatccgcatcgcgaggggcggaaccggctcgacgagcgagacgccgacggaaagcgctttcacagggatttcgtggccgtcgtcaggacatacgggtccggctgggtcgactacatgtttcccaggcccgggagcacgataccgaccgtgaagtggagctaccttcgcggcgtgacgatcgacggaactcccgcgctcgtcggagcgggcgcctacgtcgattga

SEQ ID NO: 8041 - DNA, 933 bp, Methylobacterium sp.
atgcgcgtcgccttcatcggtcagcaggatttcggcaaggcggtgctcgaggccttccttgagcgcggcgacacggtagcgggggtgttctgcgctcccgagaagccgggcgccaagcccgacgtgctgcgcacggccgccgaggagcgcggcctgcccgtgttccagttcccgagcctgaagagcccggaggcggaagaggcgatgcgcgggctcgacgccgatatcggcgtgatggcctacgtgctgcagttcgcgccgcagagcttcgtcaccatcccgaagcacggcacgatccagtaccacccctcgctactgccgcgctatcgcgggccctcctcgatcaactggccgatcgctcgcggcgataccgagaccgggctcaccatcttccgtccgaccgacggcctcgacgaggggccggtgatcctgcagaagacctgcgcgatcgggtccgacgacacgctcggcgacgtctatttcaagcagctctttccccttggcgtctccgccatgctggaggccgccgacctcgtggtggcgggcgagcacgtcgagatcgcgcaggacgaggatgcggcgagctacgagggctggttccgctcccgtgaatccgcgatcagctgggcgagccacgcggagcacgtctacaacgtcatccgcgcctcgaacccggcgcccggcgcctggacgaccctcgacggcaagaccctgcagatcttcgacgccaagctgcatccgatccgccgcttcggcgacgtgcggggcaagctcggcgaggtggtggcgatcggtgaggactcgttccgcgtcgccgcgcagggcgggcagatcgaggtgtttcgggtgaaggcggagggcggccggaaggtctcggcgggcgagttcgcgcgcgagggcgggttgagcgtgggcacgatcctcggcggatag

SEQ ID NO: 8042 - DNA, 810 bp, Methylobacterium sp.
gtggcccttgcgacgaagaggcggacgcccgagccgccgagcctgaacgacgtctacgagggcgagcggcagctcgtcgggatcatcctcgcgcatccggaggtgtattcagcggtcgcccggatcctgcgcggcgaggactggacgcagaacctgcaccggggcgtgttcgaggtcgtgggcaagcttgccgcggccgggcagtcgatcgcgctcgattccgtgctgccccgcgtcggcgatgtcgggccggatggggcccccgcgagcgattatctggcggagttgatcgcggcagctctcgcaccccaccacgcggaggagatcgcccgcatcctggccgaggccgcgcgggtgcagcaccggccctgcatctacgacctcgatctttacgcgtgggccttcgaccagtcccagcgtctccggcgcgggcagttctcggctctcgacgcactgaacctcgccgaggagatcgaggatttgggcaatgagatctacaacaagctcgagagcgcgctccgcatcacgctgatgcatctgctgaaatgggaccaccagcccggcaggcgcacgcgcagctggaccctgtccatccgcaacgggcgactggacgccgcgaaggtcttggagaagaacccgagcctcaaagcccggcttcccttcgcgatcgatgaagcctatcgccgcgcccggatcgacgccgcgggcgagaccggcctcgacgaggatgccttcccggccgcctgcccctacgatctcgacgcgatcatgaaccggccgatcccctggccgccgagcgaggacgcctga

SEQ ID NO: 8043 - DNA, 552 bp, Methylobacterium sp.
atgctggtcctgcgctaccgtcaccgcctgcccgccgattacgacatggaccgcgtccgccgccgcgtcgccgagcgcgggcggctctgggacgcgacacccggcctcggcttcaaggccttctcgatcgcggagggcgcgggcggcaacgtctacgcggcgacctacctctggctggatccgctggccgcaggcgccttcctcaccgacgaccgcttccgggctgtcgtggacgggttcggtcgcccgggcgtggagacctggctgcccctcgcggtggcggccggctcgtccgacggcgcggccatcctggagcgcgagaccctcccggtcgccgagacccgcgacctcgccgcccttcgggccgcagaagccgagcggtccgccgccgctctggcggacggggcctgcgccaccgtcagcgcgctcgatcccggcacgtggcgcctcgttcgcctcaccctccggcgggatgccgcagcggtgggatcgccgcaggagcgcgtgctccatctcgccgcccccggctgggcccggctgtcccggcgttga

SEQ ID NO: 8044 - DNA, 1443 bp, Methylobacterium sp.
atgccgctcccgctcggcccgaagatgcagccgctcgacgagaccctgctggacgcggccggagcgaatgccggcaagctctacgtcgttgcaccggccacggccgtgctggctcccaatcttctccacatcatccgcgtcgcggcggcggagcggccggatgtcgggatcttctacggcgacgaggccgagaccgacgcgcgcggccaagtcgccgccgtgcggtgcaagccgtccttcaacccggcgctgctgcaggccgatgattatatcggcttcccgctcgtcatccgcgggtccgtgctggcgcaggttcgtccggtcttcggctggcgacaccgcagtgccgcctggtatcgcgtctgcctggaggctctcacccgcggcatcgggatcgatcgcatccccgagaccctgatcgccgttccggagagccgtccgcgggccgaggcaggcgccaggcgcgcagccctgcgcgcgtggttcgccgagaacgatctcccgctggagaccgcgccggggcgcgtgggcgacaccctgcagattcgccgggtgctgaaggatccgccgcgcgtcaccctcgtggtgccgacccggcagagccgcccagcaccggacacgttgccggacggcggcaccgaaccgcacatcatccggcttctcgatagtctgaagcgcagcagctaccctctggagcgcatccgcgtgctgatcggcgacgacgagcctgacgaggcgatctaccgggggcggagcgacgccttctcgatcgagcgggtcgtcacgacgcgcgcggccggcgaaccgttcaactacgcggccaagatgaaccagctctggcgacgggtggagaccgacgccatggtcctgatgaacgacgacgtcgtcgtccgctcctccggctggctcgaggcgctgatgacctttgcgctcgatcgcaacgtaggcggtgtcggcgcgcgcctgatcttcccgaacagcaccatccagcacgctggcatgttcggcggcatcttcggagcctgcgcacatccctggtatggccaggacgaggccgcgccgacctattccggctgggcgctgacgcagcgcgactgctcggtggtcacaggggccgttttcgccacccggcgcggcgcgatggaggccgtcaacggcttcgacgagaccttcagcctcgacttcaacgacgtcgatctctgcctgaagatgcgcatgctgggactgcgcatcgtctatacgcccttcgccgagctctggcacaacgagcgctcgtcgcggcagaacaacctcgcgccgggcgatcagatggtgcacttcgtgcgacgctgggccgacgttctggcgaacgatccggcctacagcccacaactgcgcaccgacaccgatcgggttcagccgcgctacacggctgcgcagtgggtggagacccaccgggcctga

SEQ ID NO: 8045 - DNA, 861 bp, Methylobacterium sp.
atggtcggcgcgcacgagccggaagggagcctgaccatggcgagccccactcctgcgagcggcctgcgcgagggcctgagctacgcgccgccgcaccgtccgtcggaccggctcgcgggcgagacggccgtgatcaccggcgccggcagcggcgtcggggcggagacggcccgcatcctccacgccgagggtgcccacgtcgtcctgaacggcctcaccgccggccgcctcgaagcgctcgccgccgaactcggcccccgcaccaccgtcctgcccggggacgtcaccgacctcgcctatctggagcgcctcgccgaggaggcgcaggccgtcggcgggggccgcgtcggcgtcctcgtcaacaatgccggcgccacgatccgcggctctctggcggagaccacccccgacaacttcatgtcgacggtggaactcaacctgaacggggcggtgcagctcacccgcctcctggcgccggccatgtgcgaggcgcggcagggatcgatcgtcaacatggcgtcgatcacctcgctgaaggggttgggcggtgccgtcgcctacaccgcctcgaaagcgggcatgacgggggtcacgcgggcgctggccgtggagctggccccgttcaacgtccgcgtcaacgcggtctgtcccggcgtgatcgatacgccgatgacctgggagcacgccgaggcgcagcccgatccggccgcccactacgcgatgctccgggcccgccagccgatgaaccggctcgcctccgcccgcgactgcgccctggcggtgctgttcctggcgagcccggactcggccttcatcaccggagccgcgctcccggtggatggcgggcgccacgctgcctga

SEQ ID NO: 8046 - DNA, 261 bp, Methylobacterium sp.
atgatttcctcagatcccaagacccgggagatcatcatgacgtctcgcctcatcgccgccgccctgctcgcagcggccgtcgcgtcgccggccctcgcccagggcctcgactcgcgccacagcccctacccggcctcggcctatccgggctacgtcgcacccgatgcgtcccgcgcggccggaccgggcaccgcggcatcggcctaccgctattccggccagcatgccggcggccccgccggcgcgctcgcccgcaactga

SEQ ID NO: 8047 - DNA, 1170 bp, Methylobacterium sp.
atgatcgccgagacggatcccgtgccgggcgccccctgcccctgctgcctgccgcgccgcggcttcatgcgcggcctcgcgggcctgggggcggccgcggtcgccgcgcccggccccgcccgggccgcgccctatgccggccccgtgatcgactgccacgggcactacaccaccgagccgcccgccatgctggcctggcgcaagcgccagatcgacgccctcaacgatcccgcgcagtcgcccgccccgtccgacctgaggatcggcgacgacgaggtgcgggcgagcgtcgccggccgtcagctcaagctccagtccgagcgcggcatctcgctcgccctgttctcgccgcgggccggcgggatgggccaccacatcggcaatgcccggaccagcctcgactggtcgatcgtgtcgaacgacatgatccaccgcgtggcgagcctgatgccgcagaacttcgtcggcgtctgtcagctgccgcagacgccgggcgtctcgccgaagaactgcacggcggagctggagcgctgcgtgacgcagctcggcttcgtcggctgcaacgtcaacccggacccgtccggcggctactggaccgatccgccgctctccgaccgcttctggtacccgctctgggagaagatggtcgagctcgacgtgccgggcatgatccacgtcagcgcctcggccaaccgcaacttccacgcgaccggcgcccactacatcaacggcgacaccaccgccttcatgcagttcgtcacctccgacctgttccgggacttcccgaccctgcgcctgatcatcccgcacggcggcggcgcggtgccctaccactggggccgctaccgcgggctcgcgcaggacctgaagcgcccgcccctgtcggagctgatgcgcaacgtcttcttcgacacctgcgtctaccaccagccgggcatcgacctgctgctcaaggtcgtgccgcgcgagaacgtgctgttcgcctccgagatggtcggcgcggtcaacggcatcgatccggagaccggccacgcctacgacgacacccggcgctacgtcgaggccgccgcgatctcggacgcggaccgggccgggatctacgccggcaacgccctccgggtgtatccgcgccttgcgggcaagctgaaatccgccggctcggggccgtga

SEQ ID NO: 8048 - DNA, 675 bp, Methylobacterium sp.
atgaccttctccatcgtggcgcgctgcgcgtcgaccgggatgttcggcgtcgcggtctcgtcctcctcgcccgccgtcgcggcgcggtgcgcccatgcccgcgccggggtcggtgcggtcgcgagccagaacgtgacggatccggcgctcggccgccgcgccctcgacctgatggccctcggcgccgacgccgcggagaccgtcgcggtgctgcggcggaccggcggaccgatggcctatcgccaggtcctggtcgtggacgcggccggcggctcggcgatccattcggggcccaaggcgctcgggacctggggggaagcacgtgccgcggacgtcgcctgcggtggcaatctcctcgcggacgcgcgcgtgcccgaggcgatggtcgaggccttcctcggcgcgtccggccatctcggcgaccgcctgctcgttgcgatgcgggcggcgctcaaggctggcggggaggccggcccggtgcactcggccgggctgatgctggtgcgcgaggtcgcgtggcccgtcgcagacctgcgcgtcgactggacggaggattgcccgatcgcgggcctcgccgcgctgtgggacctctaccggccgcagctcgacgcctacgtcacccgtgccctcgacccggtcgccgccccgagctacggagtcccgggcgacctatga

SEQ ID NO: 8049 - DNA, 246 bp, Methylobacterium sp.
atgcacaagctgctcttcgccggcatcgccctctcggctctggccggcctatcgaatgccgcgatggccgaagagaccacggtcgttcgccgcgactccgctcccagcgtctccgtcgagcgccgcgagggcgtggtcgagcgccgcgacatcaccacgggcagcgtcgattgcggctcgaagaccgttcacaaggaggacggcgcgggcaactcgaagaccgtccacaaggaaggctgcaactga

SEQ ID NO: 8050 - DNA, 1125 bp, Methylobacterium sp.
atgcgccgtgcgatcatccatatcggaatgccgcggacgggctccacctccttccaggaggtgctggccggactgaggccggatcttgccgaggccggcctgctctatccggaactcgcgccgccgggctcgcacccggacctgaacgtcaatcatcaacctctgggcgaagtcctcgacgggcgccggcctcgcggcgagcgggcggtcgtgctcggtcggctcgacgaggccctgcgccggaccggggccgacacgctgatcctctcctacgaggatttctcggtgcagcgccgccgcttcggcgtgcccgagaccctgcgcggcatcctggcccggcacggcttcgccctggaggtgctgatggtggtcaagccgcccttcgacttcctgaactcggcctacgcccaccgcgcccagctgatccgcgagaccggcagttttcgcgactatctcgcgcatcactggcgctcgggacggatcgactaccgggcgctggtcgcgccctgggccgaggcggcggacgggcgggtgacggcagtgccgctcgccgaccgccgctcggcggtgccgctggtcggccgcatcgtcgccgcgctcggcctcggcgaccggctcggcaccctgatgggtacggccgccgcgacctaccggacgaaccgctcctccggccccctcgcggtcgcggcctcgcgtcgcctgcgggcgctgcgggtgcatcgacaggtcgtgggccacccccgccgcatcggccacgccctcgatcaggccgcctgggcccgcgggctcgatcccgaaccgttccgcggggacgcgcccgagtaccgcgcgcgcatcgacgcgcacaccttcgagacccgcgagcgcttcgcgcagctcgcctgggggcagccctgggacgccgtcgtggcgcccggccacgaggggccgccgaacgagctggcgcaccgggcgatcccggctgagaccgaggcgcaggtcgccgcgctggtgcgcgagaccatgcgccggttcgacgtccgcgcgccggcgccgctgctcgcgcggccggccgcgtggatcgaggacggcgcgatgggcctcgcccgcctcgccgggatcgagagccgctggcgggtgtgctga

SEQ ID NO: 8051 - DNA, 609 bp, Methylobacterium sp.
atgatacggaatgcgcacccggacacgatcgtgtccgaggcggccctgcaggcggccatcgatgcttccggaggcatgggggcatgggagtggaacgtcgccgaggatcgtgcccgtgccgaccccgtcgtcgcgctgctgttcaacctcagcccagctcaatcccgcggcggcgtcccgttcgaggtcatcgcacgggccatccaccccgaggatcgtgagcagatcagctccgtcatctggggctgcgtccaggaggggggctcctatctggccgagtaccgggtcgtctcggcaggcgggcgtgtgcgctggatcctctcgcgcggccgcttcttcctcgacgaacagggacgcccggccgaggggcgcggtgtcgtcgtcgacatcaccgatgcggacctgagcaccgctgcatttgccgcccgtgcgccgaacgagacccctgacacgatgggcgaggccgcggaccttggcatcaagctgcacggcctcgccaaggagttgcgctccccgcggctgcgagccctcacgcagcaggttttgatggagttcggacggcagttggcgcagcgcgaatcggcggagcagcggaagggcctgcactga

SEQ ID NO: 8052 - DNA, 390 bp, Methylobacterium sp.
atggatcattccgaacgggggacgaagcggatctgcccgacgacaggacgcaaattctacgacctcaaccgcgatcccgtgatctcgccctataccggtgaggtcgtgccgacctcggtcgcaacgacctatacccgcagcgcgccgccggccttctcgcgcaaacccgtcgtcgatgaagaggagcgcgagacggatggtcctgagctcgtctcgctcgacgaggtcgaggcagaggaaactgacgcggccggcgacgacaccggaaacgatgacgacctgacgatcgaggacgataccgagggcaacgctgacgatacgctgatcgaggacgaggacgacgacagcgcaacggatctcgttgacgtcgaggacgacgacgaggattag

SEQ ID NO: 8053 - DNA, 1527 bp, Methylobacterium sp.
gtgcagggctcgatcatgacggccgtgacgaatctcggtgccctggtcgatcggagcggcgatcccgagcgcccgctgatcatcggggtccggtccggcgccgagcccgacgtgatgagccgcgcccggctcgacgcgcgggccgacgccttcgcgcgcgggctcctgcgcggcgggatccggcgcggcgagcggatcgcgatcctctcggccaaccggccggacgcgctcgccgcgctgctcggcgccatgcgcgccggggtggtgccggtgccggtgaaccacaagttcccgccggccacggtcgcgcaggtgctcgccgattgcggcgcgcggctcgtcctctgcgacggcccgcgccgggcgctgctcgacgggccggcgccggatctgcccgtagccgacttcgatgccgacggcgccgagggcttcgcggcctggctcgatcccggccccttcgcgccggtcgagccggcgccggacgaggcggccctgttcctctacacctcgggctccaccggccggccgaaaggcgtgcggctctcgcacgcgagccatctctgggtggtgcgcacccggatggcggaaagcgacctcagcgcggaccgggtgctcgtcgcggcgccgctctaccacatgaacgcgctggccctggcgctcctcgtctgcgcggccggcgccaccatggtcctgctgccgcagttcgaggcccgggcctacatcgaggcgatcagccgccatcgctgcacgtggctgaccgccgtgcccccgatgatcgccatgatgctgcgcgagcgggaggcgctgcgggcggccgatctcggaagcgtgcgcgcggtgcggatgggctcggcgcccgtcaacgaggccctcgcccaccagatccgcgcgctgctgccgaacgcccgcatcctcaacgcctacggcacgacggagggcggcccggtcgtgttcgccggccaccccgcgggcttgccgaccccggtcaattcggtcggctatccccatcccgcggtttcggtgcgcctcgtcggtccggaggcgcccgaggcgggcgtcctgcagatgcgcagtcccgcgatcatgctcggctaccacaacaggccggagctgcgcacccccatcacgccggacggctactacgacaccggcgacgtcttccgccgcgacgcggacggcttccactacgtcctcgggcgcaccgacgacatgttcgtgtcggggggcgagaacatcttccccggcgaggtcgagctggtgctcgagagccatcccgacgtgctccaggccagcgtggtcccggtcgaggacgcgatcaaggggacgaagcccgtcgccttcgtggtgcgccggcccggcggcaccgtcgacgaggcgggggtgaaggcgcacgcgctcgcccacgcgcccccctaccagcacccgcgccgcgtctggttcctcgacgcgctgccgctcgcctcgaccaacaagatcgaccgcaacgccctccgggcgcgcgccgaggcgatggtgggttccgcctga

SEQ ID NO: 8054 - DNA, 420 bp, Methylobacterium sp.
atgtccgacacacccctgaccaaggaacaggtggaagcgctgctgctccgcggccccttccaccagtggctcggcctctccgtcgtctcggtcggcgagggcgagatcgagctgaaggccgcatggcgccccgaatgggtcgtcaatgccgagcgcggctacacccacggcggcatcctggcgacgctcgtcgatctcacggccgactgggcgctcgtctcgaagaccgggcgcggcgtgccgaccgtggacctgcgcgtcgactatcaccgggccgcgatgcagggcgacctgacctgccgcggcacggtggtgaagttcggcggccagatctcggtcgccgaggcgcggatcctcgacgccgagggccggctgctcgcgagcgggcgcggcgtctacatgaccgcgccggccagatga

SEQ ID NO: 8055 - DNA, 1017 bp, Methylobacterium sp.
atggcgcgtacgatgaaggcgctcgtgctcgggcagcacggcgatatcgacgacctgaaggtcgtcggcgaccatccccgtcccgaggccgggcccggcgaggtcgtcatccgggtcggcgcctcgtcgttcaactaccacgacgtcttcaccgtgaagggcatgcccggcatcaaggtgccgatgccggtggtgatcggcctcgacatggccgggcagatcgtcgagctcggcgcggacgtcaccggatggcgggaaggcgaccgggtgctcgtcaacccgctcaacaaggccaggggcctgatgggcgagatgctcgacggcggcatggccgagtattgccgcgtctccgccgaccagctcatcgcgatgccgccggacgtgagctacgcggacgccgccgcgctgccggtcgcctacggcaccgcccaccggatgctgatcacccacaggacggtgaaggccggcgaccgcgtgctgatcctgggcgccagcggcggcgtcggcacgggctgcgtgatgctcgccaagcagctcggcgccgaggtgatcgcctgcgccggcagcgccgagaagggggagcgcctgaaggcgctcggcgccgaccacgtggtgaactaccgcgagaccgacttctcgaaatgggcgatccagcactacggcaagccccagcgccggacctacgagggcggcgtcgacgtggtgatcaacttcaccggcggcgacacctgggtcccgtccctcaaatgcctcaagcgcggcggcacgctgctcgtctgcggcgccacggccggtcacgatccgaaggaagacctgcgctacatctggagcttcgagctcaaggtgatcggctcgaacagcttctaccacgacgacctgtcggccctgatggacatgatccaggccggcacgctcaagcccaccatcgacaaggtgctgcccctcgaacaggcggccgagggcctgcgcctgatccgcgaccgcgaggtcatgggcaagatcgtggtcaccccctga

SEQ ID NO: 8056 - DNA, 990 bp, Methylobacterium sp.
ttgagacggacccgtcgtgccgcggcgcttctcgccgccttcctcgccgcgctcaccctgcccgcggcggtccgcgcggagaccgtgcggatcggatactggagttccggcgtcagcctcggcttcggcgccgtgctggagacgggcaagtacatggagaaggagggactgaccgtcgagtacgtgaagttcccagacgtcaacgcgcccaccaaggcgatggcggccggcgcgatcgacttcgcgatcggcgcgagcgcgggcaccgccttcagcgtgatcgccgacgggctccccctcagcatcgtgctggccagccaggtcgccgatctcgacttcgtcgtgcccgaggattcggccgttcggacgatggccgacctcaggggcaagaagatcggcacctcgcccgccggcagcgccaccgccgtgatcaccgcggcgatcctggagacgaattacggcatcaaggccggcgagtaccagggcgtgcccggcaacgacccgcgcctcgcgcagttcctggcgcagaaggacatcgacgcggcggcgctccgcacggtcacgatcgcgctcctgcccgacatgaagctgcgcaagctcggcagcttccgcgaggagtggcgcaagatcacgaagtcggacgccccgcccgtcctcggcgtcggcctgatgcgcaacgcctggatgacggagaacccggacggacccgccaaggtggtcgcggccatgcgcaaggcctacgaattcggccgcaccgacaaggacgcggtcgcccgggcgctgcgcgaggccgccaacctgaacgagacggacgcccgggcctacgcggcgctctgggacagcatctacaccgtgcgcatggagccggccgacgtcgcctccatccgccaggccttcgaggtctacaagagcgtgggcgccgtgaagggcgagttgccggcctcggccctcgtcacggcgccctacgaagcgtcgaaggcggtccgctga

SEQ ID NO: 8057 - DNA, 810 bp, Methylobacterium sp.
gtgcgcacgccccccgacctgctccgggcgccgccgcgcaccgtcctctggcgcggcccggccgccgcgatcctgcgccgggcggccctgctggccctggcgctcgtcgcctggcaggtcggcgcgcagcacgcgccgagcttcgtgctgccgagcccggcccgagtctggtccgcctggagcagcctcgtcgtccagccgagcttctcgacggatctcgggatcacgctcgggcgcatcggggcgggcttcgccctcgcgacgctcgtcggcctgccgctggggctcctgctcggcgcgagccgggcgctcggcagcttcttcgagccggcgctgaccgtgatcaacaccgtctcctcgacgatctgggcgatcttcgcgctgatctggttcggcctgtccaactggacgacgatcttcgtcgtgttcatgacggcgatgcccctgatcctgaccaatgtctggcaggggacccggacggtcagcgccgagcacctcgaactcgcccgcaccttccgcatgccgcgccgcaaggtgctgaccaagatctacctgccgacgatcctgccggccttcttctccggcgcgcggctcgccttcgggttcggcgcccgggtcagcctcgtggccgaatccctcggcgcgagcagcggcatcggctaccggctccggcaggccgcggacctcgtgcagaccgatcaggtcttcgcctggacgctgacgctcgtcgtcctgatgctcgggctcgaatccctgatcctgaagccgctcgaacggcacctcttcgcctggaagaagagtgttgcctga

SEQ ID NO: 8058 - DNA, 858 bp, Methylobacterium sp.
ttggcacgcggagcgctcggccggtcgctgctcgtcgcgggcgcgctcgcggttcccttcctccccccggcggcgcgcgccggaatcgcgatctcggccgccaagatcaccggcggggagctctgggtgctgggctcgaccgacgagaccgacgccgagatcagcctcgaccagcagttcaccggacgcacggacgggcgcgggaatttcgagttccggctgatctaccatccggcgagctgcatcgtgaccctgcgggtgcgccagcaggagcagcgcgccgtggtcggcgagtgcggccagcagggcccgcccggcccggcgcccgccgccagcaccgtcgcgggcccgcccggaccgtcgggtccggccggtccgcagggcgcgcccggcccccaggggcctgccgggccggcgggtgagcgcggccccatgggcgagcgcgggctcgcgggcgagcgcgggccggccggcgcgaccggcgaggcgggccgtgccggcccgatcggccccgcgggtccacccgggacgcggggcgagccgggcccgatcggcgcggagggcccgtccggacctccgggggccgccgggcctgcgggccccgccggacctccgggaccgcccgggccccacggggagcgtggcgaaccgggccacaggggcgaaccgggccccgcaggcccaccgggtccggccggccggccgggcccgcgcggacccgccggtccgcccggcccgcgcggagcggccgccgcggcgcagccccgtcccgcaccggtccgcacgccgcgtcccgccgagcccgagccgatcccgatccagccgcccgcgggctccgcgacgggcgtgccctactga

SEQ ID NO: 8059 - DNA, 279 bp, Methylobacterium sp.
atgccgctcgagagatacacgcacggcgcgccgcaccacgacgcggccaccgagggcgcgatccgcttcccgatgacgaacgggcagcgggtgatcgcctgcgagatcgatgcggacgtgctgcggcagcaattcggcgacgacggggacgacccgctcgacgtgttcctgcggcacagggcggcgatcgaggccgccgcgagccgggcctacgaccgcggcagcttcccgaacgacctgatggagctgaccgcgaacgacttcgcgccgggcgcctga

SEQ ID NO: 8060 - DNA, 882 bp, Methylobacterium sp.
atgcagtccgacgagaagctcaagtatagcgccccggccgccgcctgcgccgccgacctcctgctcgccctcgcgcgggcggacggcccgatgacgctggcggcgctgatcgagcggacgacctattcgcgctcgctgctctaccgcaccctcaagaccctcggcacccgcggcttcgtcgtcgaggaggctgcgcccgggatttcggggagcctgcactaccgtctcggctcggccgcggcggagatcggcggcgcctaccagagcaacgtcccgttcgaggagagcatccgctccgccttgcgcgccctggcgcagcggaccggcgagagcgcgagcgtggcgacgatcgagggcgaggacgtgctctacgtgatgcgcgaggaggggcgctactccgtgctcgcggtctcgcgggtcggcaagcggctgcccgcccacgccaccgccatgggcaaggccctgctcgcccggttcgacgacggggagatccgcgccctctacgggcggggcgaactccggcgcttcaccgggaacacgatcaccgattccggcgccctcctgcgcaacctcgccgaggtccgcctgcgcggctacgcggtcgagcattccgaactggtccagggccgctgctgcattgccttcacgctccaggccggccccggtccgggcgacctcctggggatcagcctctccaccacggaggcgcggttcgaggtcgagcatgacgcgctgatcctggaggttctctccacgcgcgacgcgctgctggcggacctgagccggcgccgggtgccgggagaccggaaggtcgcgcgcgacctcaccgcctccctcggcgccatctcgcgccggtcggtgccggcggcggccggcacctga

SEQ ID NO: 8061 - DNA, 279 bp, Methylobacterium sp.
atggccgatcttctcaagttccccgccaactcacgcccgcggcacgtgcgccgagcctatcaggtgcatcggttcgtcaagagcggcggcgtgctaacgtcctgcatcatcacggcccgcgacgacagtgacgccaagcggcaggcggtaggcttgaccgcggggaaccgtactgaactctgggccagtaaccgcctcgttgccgtattcggcgcgttcgagaacccgattgcgagcgcgatccggttgcatgcggaacgaccgacgaccgaacagtga

SEQ ID NO: 8062 - DNA, 762 bp, Methylobacterium sp.
atgagcgagactgcccagcccgagatcctgcggacctccgagcctgcggacggcgtgcgcctcctcaccatcgaccgcacggcccggcgcaacgccctcgaccgggcgacctacgcggtcctgcgggaggcgatcgcgcaagccggcaccgacactgccgtgcgcgcggtcgtgatcaccggcgcgggcggctgcttcaccgccggcaacgacctcgcggattttcgcgataccaccttgcgggagggtgacagccccggcctcgccctcctgaaggtgctcgccgcctgcccgaaaccggtcgtggcggcggtggagggccacgcggtcggcatcggcacgacactgctcctgcactgcgacctcgcctatgcgggagcgggcgcgcgcttccgcctgcccttcaccagcctcggcctcagccccgagggcgggtcgagctacctgctgcccctcgtcgcgggcacgaagcgcgccgccgagctgctgatgctgggcgaggccttcggggccgagacggctgaggcagccggtctcgtcaacgccgtggtgccggcgggccgggcgctcgacgcggccctggagcgggcccgggcgctggcggcgctcccaccggtctcgatcgccgcgaccaagcgcgccctgcgggcgggccatgccgagatcgtggcgcgcacgctggcgagcgaagccgagaccttccacgcgctccgccgcggcccagccgcccaggccgccttcgcggccttcctcgcacgatga

SEQ ID NO: 8063 - DNA, 768 bp, Methylobacterium sp.
gtgaacgccgtcgagctcgagcgggtcagcaagtggttcggccggcgcgacggcccgccgctgcacgtgctggacgcggtcgacatcgcgatcccgcagcacgccatcgtggcgctgctgggcgcctccggctgcggcaagagcaccctcctcaacatgatcgccggcctcgtcgagccggatgcgggcgcggtgcgcctcgacggcatcccggcccgcgccttccgcgactggcgggcgatgacctacatgttccaggaggatcggctcctgccctggcgcaccgccgcgcagaacgtcgccttcgggctcgaggccggcagcatgggccgggcggagcgggcgcgccgcgtcgaggagacgctcgccctcgtcggcctcgccgccttccgggacgccttcccgcacgaattgtcgggcggcatgcgcagccgggtcgcgctcgcccgcagcctcgtcaccgagccgaggatcctgctcctcgacgagcccttctcgaagctcgatcccgacatccgcgcgcagatgcacgccgagctcctgcgcatcgcgcgggagcgggcgatgacgctggtcttcgtcacgcacgacgtcgaggaggcggtcgtcctcgccgaccacgtggtcgtgctgcacccgcggccgggccgcatcggcgagatccgcgcgatcgcgctgccctatccccgcgatcccctgtccgaggcggtctccgaggaggtgcgccgcctgcggatcagcctgtccgccgcgagggcccgatgctag

SEQ ID NO: 8064 - DNA, 219 bp, Methylobacterium sp.
atgggcgacgacacggacatgcggagccggagccagcccgcggggacgccggcgagaggcgcggcgcacgaggccaccgagggggctgcgatcacgccgcgcgaccctgcgaccggcgcggtgcgcccgaccgatgggccgatggagcgggccgggacggaggccgaggcccgcgcgcgcggcgaggagggccccttcgagggccggcgcagcggctga

SEQ ID NO: 8065 - DNA, 435 bp, Methylobacterium sp.
atgcacgggagatcgtggttcggcgccctgatcctgctctccgcgggcgcgcaggcgcaggacggcggcaaggccgtcatcgaccagctcggggcgctgccgagaccggcccagcagggcgacctcgacaccttcgcgctggcctcggcccatcgcgagcgcgccgagacgatgcagcagcgcacggacggcctgtggcaatcctggctggtctcggtctgcgagggctgcggcgaggcgcggcggccgttcagcgaccgggagggcgccgagtacctgcgcaagctccgggcggcccagccggagcaggcgccgagccgcccgcgcctcacctactacgtcccgccgggcgaccgggtgccgcgcaccgacaacatctcggccgacctctcgaacgagaacatcgaccagatccggcgcgacccgaaccgctga

SEQ ID NO: 8066 - DNA, 198 bp, Methylobacterium sp.
gtgcgcgacacgatgctgctcccgtccttcgtccgctcgggcgcgtgggccttcggtgcgagcgtgcgcgaggacgagggcctgccgttcggctttcagcccatccccgcgcgcgaggcgactgcggcgttcggctactacctgttccatcatccctgcgagaccctggcgccgagatacgcccggcgctgggcctga

SEQ ID NO: 8067 - DNA, 360 bp, Methylobacterium sp.
atgcgctccgctctccgcatcgcggccgtcaccctcgccctcgcttcgcccgcgctcgcggccggcccgaacggcggccagaccacggtcttcgacggccatcccatcgagttcgtcgcctcggacagcgccgtcacgttctacctgagcgacgaggacgggaagccggtcgacaccgccggcctctcggccaaggccttcgtccaggccgggggcaggacggacacactcgttctgaagccggccgccccgaacaggctcgtcgccgacctgaaggccccgctggcggccggcgcgaaggtcgtgctctccgcgaaactgcacggccacgccatccaggcccgcttcgagaagcgctga

SEQ ID NO: 8068 - DNA, 432 bp, Methylobacterium sp.
atgatccgcgtcacgcgcctgcatcacacggcgatcgccgcccacgacctcgacgcgatgcgacgcttctataccgaggtgatcggcctcgacgcgcatccgaccaagaccaactggctgcgggccgggaacggcttcgtcgtgcacctgatgccgtcgcccgacgcgcccgcctcgggccggatcgagcagcacttcgcgctggaggtcgagagcctgcgcgagaccgcggcggcgctgctgcgccagggcgtgacgccgtacatggcaagcctcgaatacgagacccacgccgtgaccgatgccggcgacccgctcgatttcgggatcggcacgctcttcgtggccgatccggagggcaacacgatcgagttcgtcgagccggatacgggcatcttcgccgaagtcccgctcgaagcgcaggatacgtag

SEQ ID NO: 8069 - DNA, 1134 bp, Methylobacterium sp.
atgacaccggagcatctgtgcgaacgggacgttgaggccgtcgtcgcgacgacgcccgagagcgtgtttctgctctcgggccatctcacgtggctgggcgagcggatgcgcggctggatgggcggccccgcgggcgacgccgccttccaggccggatacgccgtcctcacccgggacggccgcgtcgggctggcggcgcgtgcggtcacccggatggcggccgaggcggcggcgccggacagcctcgtgctgtacggccgggcctgcccggccgccgacgccgacgccgcgctgtccctgctgctggccgagatgggcctcgccggccgcaccatcggtgtggaatgggacggggccggccgcggcctcgcccgaagcctggagccggtggcgacccgggacgcctcgctctggctgcgcagcctgcgcgcggtgaagaccgaagcggcgctccggacgatgcgggaggccgcgaccgccaccgaggcggcgatggaagccgtcttcgccgcctggaccgccgacgccgatccgcgggcgctgcggaccgtgttccgcgtcgccctggcggagcgggactgcgacttcgaccacctggtcttcggagcgcccggcggcggcgtgtgcgacgccgcgaggccgccggaacccgtcacggccctcttcttcgatgccggtgcccgctgtggccgctactactcggataccggcacgacgctgacgcgggccggcttcacggccgccgaccgcgagcgtcacgccggcgcgctcgccgcgctggcggcggccgagcgcgccctgcagccgggccggcccgcttcctcggcctgggcggcgatgcaggacgaggcgcggcggatcccgggcctcgtcgcgcaggggcacggcctcggcctcggcatccgcgaatggccgctgctcgggccgccgagcgacgccgtgctgagcgacggcctcggcacctacccggtcgatgccgtgctcgcccccggcatggtggtgaacctcgaagccggcgggcacttcgccgacggcacctccgtgcaggtcgagaagagcttcgtcgtcggcgccgacgccgccgtcccgctggccgcgcagccgcgcgacgccccgatccgcctcccggcctga

SEQ ID NO: 8070 - DNA, 1875 bp, Methylobacterium sp.
atgacccgacagaagaccatccggctgacgaccgcccaggcgatcctgcgctacttcgcggcccagcaaacccggcgcgacggacgcgaacggccgctcatcggcggcgtgttcggcatcttcggccacggcaacgccagcggcttcggccacgccctcgcgaccggcgcgggcgggctgacctaccaccagggcaagagcgagcaggcgatggtccatgcggcgatcggctatgcccgcgcccacaacctcgcctcgaccctggcggtgacggcctcgatcgggccggccgccaccaacctcgtcaccggcgccggcaccgccacgctcaaccgcgtgcccgtgctgctcctgccgggcgacgtcttcgccagccgccgtcagggcccgatcctgcaggggctggagatggcgggcagctacgacatgaccgtcaacgacaccctgcgcccggtcagccgcttcttcgaccggatcacgcggcccgagcagatcatccattccctgccgcacgccaccgccgcgctgctcgaccacggccaggccggcgccgtgaccgtggccgtctgccaggacgtcgagggcgaggcgttcgacttccccctggcgctgttcgagcggcgcgtccacgacctcgagcggctcgcgccctccgagaccgccctggcggccgccgccgaacgggtgcgggccgcgcgcaagcccctcatcatcgcgggcggcggcgtccgctattccgaggcggaggcgagcctcgccgccctgtccgatgcctgcggcatcccggtggtcgagagcttcgcgggccgcggcgccggccgggaggcgcgcctcaacgcgggcggcgtcggcttcatcggaacgccggccgccaacgaactcgcgaccgaggccgacctcgtgctcgccgtcggcacccgcctgtcggacacgctcaccggctcgcacacgctgttccagaaccccgatgtgaacttcgtgacgctgaacctcgccgagcgcgacctgcgcaagatgggcgcgctggcgctgcgggccgatgcaagggccgggctcgacgggctcgcggcggccctggagggccataccgccccggccgaatggcgcgaccgcgccgaccgggcgatcctgcgccacgtcgcgcgggtcggcgagatcgtcgggaccgagaatccccgcatgaccggctacgaggcggtcgccgagatcaaggacgccgcccgccgcgaagaccgcgtggtgttctcctcctcgacggcgatcgggcaggcccacaccatctgggacagccgcagcgatgccccggtcgacatggaatacggcttcagctgcatgggctacgagatcccggccgccctcggcgcggcgatggccggcacggtgaagggccgcatcctcgcgctcatcggcgacggcaccttcctgatgggcaacaccaccgagatcgtcacggcgatccaggagggcctcgccttcacgatcgtggtggtggtcaaccggggctggcagtgcatccgcggccaccagctcggctcctacggcgaggagttcggcacgcagttccgccgccgcgagggggacgcccgcaacctgaccggcgagacgctcgcgatcgactacgtcgccaacgcccgctcgctgggcgccgacggcctcgacgtgcacagccgcgccgaattgcgggacgccctggagcaggcacgccgctccgaccggcccttcctgatcgcggcgcatgtcgaggacgcaccgctgccgatcgagaacggcgcgtggtgggagttcggcattccgcgggcggatgcgcccgagggcctgcgcgagacccgcgccgccttcgaggcggccgccgcgaagcaccgctggttcgtctga

SEQ ID NO: 8071 - DNA, 1101 bp, Methylobacterium sp.
atgaacgctcgcgcccagcttcctgccatcgccgaccaccgcccgccgcagatcgtccccgcggtcggcatcttcggcacgcccgacaagttcgaacacgcccagcgcgtcgccaaggtgttctcggagtcggccctcgtcccgagccacttccagggcaagctcgcgaactgcctgatcgctctgaacatcgccgaccgcatgggcgaggacccgctgacggtgatgcagaacctcgcgatcgtgtcggggaagccgtgctggcagacccagtacatgatcgcccgagcgaacaagtctggggtgttcgagagccgcatcacctggtcctcggacggcaggggcgaggccctggccgtcaccgcctcggcgaagctcgcggacagcggcgaggtcgtctcggtcgccgtctcgatggcgatggcgaaggccgacggctggctcaagaacgcgaagtaccagtcgatgccggagcacatgctgcgctggcgctcggccgccatgctgatccgcctctacgcgcccgaggtgatgctgggcatccaagccgtcgaggaggtcgaggacacctcggccggtgcggctcgggacgtgaccccgccgcgcggcgcaccggcggcgatccccgcgagcccggctcagcgtccgagcgggccgccgcggatcgcccagacgccgccggcgaagcccgaaccggcatcggcccctgagcagtacgccgccgacgaggaggccgaggcctgtgtcgcgcagttcgagcaggacgcgcagcacgcccggtccctccaagacctggaggagtgcgccggcatcgtcacgccgatggaggaggccgaccgcctttcgcgcgcgcaacgcgaccggatcgagaccgcgatggaggcggctcgccagcggatcgccgcgccgacggataacgggcaggcggaagaggtcgaggagcccgaggccgagatcgacccggcgaacccggactaccagcgcggcatcgccgatcgaaaggccggtcagaagaagtgcgtcatctcggcgatccgcgagaacccggagcgcatggccgcctggaaagccggctacgactcgcttgagggcgaggtctga

SEQ ID NO: 8072 - DNA, 354 bp, Methylobacterium sp.
atgatcgatgatcgcgatgccgtcccgctggacgatgttctggcctcgctgccggccgagcggcaggcccggatccgcgcgcgcggcgccgaactgatcgccgaggaactggccctgcgcgacctgcggcaggccgagcgcatgacacaggcgcaagttgccgaacggcttggcgggcggcaggtctacgtttcccgcctggagcggcgtgccgacatgaaactctcgacgctccgcgcctatgtcgaggcgctcggcggcgagcttcagttgatggtcaccttccccgaaggccgcaccgtgcgtctggccgacctcgcagacgagcctccggtcaagcgcacatccgcctga

SEQ ID NO: 8073 - DNA, 333 bp, Methylobacterium sp.
atgctctcaagaaccgcacttcccgtccttgcggcgctcggctccacactcggcgcctgcaccgacgagccctctgaagccgccctgcggcaggccgtcgagcggaaactgacgccgtccttcgacagggaggtggaacaggcgaggaagcttggcgtgcagtcgcccgcgaggccctcgatcaccgccttcacgaagctcggatgcaagccggcggaggccgccccgggctacgcctgcaccttcgacggcgccatagacgggcagaaccagggcccggggacccgccgcttcttcagggcggcggacggcacattgacgatggccgagtga

SEQ ID NO: 8074 - DNA, 825 bp, Methylobacterium sp.
gtgagcgttccccggcagacccgcgacagcgtcctcttcgtcacgctggattcctgccgctacgacaccttcgcggctgcccgcgcccccgccctgaaggcggtcggcccgctgcacaaggcgcaggcgccgagctactacacctacggctcgcacgcggcgatgttcgtgggcttcacccccggcctcgcgcatctccggcagccggtgctgaacccgaaattcggcaagctgttcaagctcgtcggcggcggccacccgggcaagggcacggagggctacgcgctccgcggccgcaacatcgtcgagggttttgcccgcgaggggttccggaccttcggcaccggctcggtcggctggttcgatcccgccacccccacgggccgccacctcaccgagcccttcggcgccttcttctatcccggcgacacctggagcctcgaccggcagctcgcgtggctggagccccggctgcgccatcccggcaacgtcttctgcttcctcaatgtcggcgagacccacgtgccctactggcacgcgggcgccccctgggaccgggccgacaacccctgcgagcccttccagagcgccgaccgggcggaggattgccgcgcccgccagcgcgcctgcctcgaattcgtggacgggcgcctcgcccccctgctggaggcgttttcggacgcgacgatcctgctctgcggcgaccacggcgattgctggggcgaggacggcctctgggagcacggcatcagccacccggcgaccctgaccgtgccgctgctcgcccgggtgcgcggtatggtagtggacgaaaaagccgcctga

SEQ ID NO: 8075 - DNA, 885 bp, Methylobacterium sp.
atgaagaagatcctgcttgcctccacggtccttgccggcctgaccgctgccgcttcggccgccgaccttccgcgtcgcgccgctccgccgccggtgttcacccctgttccggtcttcacctggacgggcttctacgccggtttcaacgccggttatggcttcggcaccagcgacagcaaccgcggcaccctggtggccgtgcccggctcgtacggcctgaccacggccgccggccccaacctgatcgccttccagggcgagcgctcggccgacggcttcgttggcggtggccagatcggctacaactggcagctgacccccggctcgggcgtggtcatcggtatcgaggccgacgcgcagtacgtggacttcggccgtgatcgcaaccgcttcgccatcgccccggtcggcgccgtgcaggctccgggcgcgctgatcttcaacccgaacagcctgaccggtctcgactacttcggcaccgtgcgcggccgcctcggctacgccttcgaccgcaccctcgtgtacgccaccggcggcttcgcctacggctcgggcggcggtcgcgacttcggtctgcccaacgcctcgcgcgatgagttccagaccggctacgcggtcggcggcggcatcgagtacgccctccccaccgactcgttcctgaacttcttccgcgcctcggccgtgacgctgaaggtcgaaggcctctacgtgaacctcgaccagggcaaccgcaacaacggcctgttcggcgtcaacgccgccggcctgccggtcggcctgtccagcccgggcgtgcagctcgtctccggcgtcaccaacaaccgccgcgacaccgagttcgccgtcgtccgcgccggcgtcaactacaagttcggctcgtactaa

SEQ ID NO: 8076 - DNA, 768 bp, Methylobacterium sp.
atgtcgaaccgccttccatcgacgcgaacgacccaggcgctgagcccggccgaggtgagccgagccgaggccaggatcgaggtgtttcatgggcgtctggcggcgcatcccgcccatccgacgcgctactgcgtgccgcgggagaaggcggtcacgacagccgagcgtcgagcgctctccgccgtcggcgagcggctggtggctgagctggcgccctggtcgaatcggggtcacatcgatgcggtcgtgacgcgcctgctcttcggattcgagcagggcagaccccgcggcgaggacgaggacgaggtcctggtcggtgagtacatcgccgcgctgaagggcctgcccctcgccgccatcgtggccgctgccgaccgtgtccgtagcggggagaccctgatccggcggaacagccgattccggccccagccgccggagttcgccgacgaggtgcgagagggcctgatcccggttcggacgaagctggtgcacatccgccgcatcctcgacgccgaggtctacgacccgccgaccgaggagcagcgcaaggctgtgaaggcagccgcggcagcgtacctgaagggccgcggcttccctggtgaggagggccgtccggtgccatcgccgggcgagcttgccgcggcccgtgacgcgagcctgcgcgagcagggcgcggccgcggtgcgagcgtgcgattccgaggcgatggcgcggctcaacgcccggctgaccgcccgcggcgtgccagagaacgtgagggtgccgtga

SEQ ID NO: 8077 - DNA, 903 bp, Methylobacterium sp.
atgttcacggcgctcaccgccgccgcgactgccgccgaccttccgcgccgcgctccgccgccggtcttcacgccggttccggtcttcacctggacgggcttctacgccggtttcaacgccggttacggcttcgacgccagcgaccgtcgcgccaacaacggcttcacgcaggtcaccgcggccggcgtgccggtcggcgccaacccggtcgtgcagctgccgaacggcgccttcaccaccgcgggcgtgctcggcccggtcggctcgagcctggcctacaacagcggcaacaacgaaggcttcaccggcggtggccagatcggctacaactggcagctcaccccgggcgcgggcgtcgtgatcggcttcgaggccgacgcgcagtacctcgacttcggtggccgtcgcagccgcttcaccaccaacgccctggcgatcaaccccgccttcgtgccggtcgacagcgtcctcagcacgctcgacttcttcggcaccgtccgcggccgcgtcggttacgccttcgaccgcgtcctgttctacggcaccggcggtttcgcctacgccacgggtgaccgcggcgcccgcgtcgccttcacgaacttcaacaaccgcaacgacgatttcctcaccggctggaccgccggcggtggtgtcgagtacgcgctcccgaccgactcgttcctgaacttcttccgctcctcggcggtgacgctcaaggtcgaaggtctgtacgtccagttcgaccgcaacaaccgcaacacggtcggcctgccgctcgtcggcggcttccagaccgccaacggcctgctgccggtcttcgcgaacaacggcgtcctgcgtcgcgacgacaactccttcgccgtcgtccgcgccggtctgaactacaagttcggctcctactaa

SEQ ID NO: 8078 - DNA, 843 bp, Methylobacterium sp.
ttggacggcctcttgatcggcggcgtctacggcgtcatctcggtcggcctgtcgctggtcttcggcgtcctcggcatcgtgaacttcgcgcaggccgagttcatgatgatcggcatgtacgcggcttggttcgcgtggaactggttgggtctcgacccgctgctcggctcgatcttctccttcgccgtcggttttctgctcggcgtgctggtgcaggcggccctcgtccgcccggtgatgcgcgcgccgcccgtggctcagatctttctcaccgtcggcgtgctcgcggtcttggagaacggcgccctcatgctgttcggctcgaccttccggtcggttcggacgccctaccagactcgggccgtcgagatcgggccgctgttcctgtccgtaccctacctcctcgcgttcggcgcggccgtgctcgtgtcgggcggcctctggtttgtcctcacgcggacgtggctcggccgggcgatccgcgcgacggcccaggacgagatggcggccgtggccttcggcatcgatgccaagcgcatgtacgcggtggcgttcggcatcggcaccgggctgaccgctttcgggggaggcgtcatattgccctacacctccgcgagcccagtggtcgggacccagttcgtcgtcctgatgttcacggtggtcgtgctcggcggcctcggcagcgtgatgggtgcccttgtgggcggactgctcatcggcctgatccagtcgctctctacgcttgtgctcccgatccagatgcagaaccttgccatcttcgtcgtcttcatcggcctgctcgccttcatgcccgaagggctcttgggggagcgccgtctatga

SEQ ID NO: 8079 - DNA, 1578 bp, Methylobacterium sp.
atgcaggagacgatgcaagcgggcgccctcgggcgcgccgcagaggatattcgcgtcgcgctgatgaccgcggctgcggtcatccccgaggtcgagcggaagcggggcccggccccgatggagccccacctcgtcgagcggcggtccaaggggaaggcgagagagggtggcggtgtcacgctgtacatccgcgacggcaagcgggagatttcgacccgcctcggtcccgaccgccgaggggacgcgaacaccctcctcgacctgtacaagctgcagaagggggccaaggcccgggggatcatagcgccgaggatggtgccggtggtcgcggccctcgcccacctgctggaggccgaccggcccgtcgaggttccgcaggccgacggcaagcgcaggccggtcaagggcgcccgccacatctacctcatgcggagcacccgcttggccaccctgaccaagttcttcggcgacctcgccttcaaggacgtcacgacggcgaagtgcaaggcgtacatcgagtggcgggtgaccctgccggacgcccgctacaagccgggggaccccgacgcaccgctggcgaaagaggccagcgcccgcgaagacctctacgagctcaagaaggccatcgacctgtacgccgacgagcatacgttggcctggcacccccaggtctacctgcccaaggcgggccccggccgcacgcgctggctccgcccaaccgagatcgaccgcatctactgggcaatccgcggccggatatgggaccctgcgaccaacggctggaaaacggagaccgtggcggacgaggacggtaacgtcgtcacccgccgcgtgctgcgtggagccgagaccatccaggcacggcgggtgctccgccggttcgtcttcgtcggcctgaccaccggcacgcggaacacggcgatgcgcgagctgcggtggcacatcacggacgagggcggctgcttcgacctcgacgccgggctgatccaccggcggggcttcggggtcgatcccaccaagggcaagccacggtacagctcacgcatctcggaccgcacggtcgcgaccctgaggcggtggcgcgaggccgacctggcggccggtatcgatcaggtcatccacaagctggacggcacctcctatgccagcagcccggactgcatctggcgctcgaccatggacgatgccggactcggcgacgacgtggttccccacacgctccggcacacggccgcgaccatgctgcgcgtcgccagcgtcgacgtgcgcaagggggccgacctcctcggcatggcggtccagacgatggtccgcgtctacggccagtggaccctggaggggcaggaggaggccgccgagatcctggcggatacccgaggcctgcggaagtccatgccgctcctcgccctcgttccgatgccgccgcagccggtagttatgacgacgccggccaacgacgacgctgcgcgggccaaggcgacggaccggcgccgcgtggacatcgcggcggcacggagcggccagtccggagccccgatgcccccgcgctcgccagcgcacctcgccagcgtcgcctga

SEQ ID NO: 8080 - DNA, 855 bp, Methylobacterium sp.
gtgacctacctgttccagatcctcaacggcatcggcctggggatgctctacttcctgctcgccgtgggactgagcatcatcttcgggctgctgcagttcgtgaacttcgcccacggcgccttctacatgctgggggcctatctcgcctacacgatggtcgagcgcggggtgagcttctggctcgccctgccgctggccttcctcgccgtcggcgcgctcgccgccctcaccgaggcggtgctgctgcgccggatctacgcccaggcgcacaccttccacatcctcgccaccgtcggactggcgctcgcggtgcaggagatcgtgatcatcgtctgggggccgatcggggggaacctccccccgcccgacagcctctcgggcgtcgtgattctcggcgacttcatctacccggaataccgcctcttcgtgatcgcgctgaccgcgctgctggccggcgggctgtggtggctcttggagggcacgcggctcggcgccatcgtgcgcgccggctcggaagcgcccgagaccatggcgctcctcggctacgacacccggcgcatcaacaccgccgtgttcgggctcggtgcggggctcgcgggccttgccggagcgctcgccgcgccgatccgcggagtcgacccgttcatgagcgtcgaggcgctcagcgtcgccttcgtggtcgtggtggtcggcggcatgggcagctacgcgggcgcgctcgccgcgggcctcgcggtcggcatcgcccagagcctgatggcgacgctctggcccgaaggggcccggctgatgatctatctcggcatggcggcggtcatcgtgacgatgccgcgcgggctgttcggacgcgcctga

SEQ ID NO: 8081 - DNA, 1206 bp, Methylobacterium sp.
atgctcgaccgccgctcctttctgaccacgtcgtcgctcgccctcgcgtccctcgccgcgccgcctcttctgcggagcgcgcgcgccgcgagtgccgacctcgtcgtcggggcaccgctgccgatgtcgggtgccttcgcggcgaacgggaagttcgccgcgctcggcgcggccttcgccgccgaggaggccggcacggtgctcggacgcaaggtggcggcgcgcgacctcgacaccgagggcaagcccgcgaccgcggcccggcgggtccaggaggcgatggccgagggcacccgtctgttcgccggcgggatcctctcctccgaggcgctcgtgatgggcaaggaggtgacgaacggcggcggcgtgttcttcaccacggccggcgccgacgagatcaccggcaaggagtgcaaccgcggcaccttccgctggagcgtacccacccacggggcgatcgcccagaccgtgcgcccactcatcgagcagatgccgaaggccaggcgctggtacacgatcacgccgcaatacgtcttcggcgaagggctgctcggtgccgccaaggcgctcttccaggagaagggcgtcgagcatgtgggcaacagctaccactcgctcgccgagaaggagttcagcggctacctgacgaacgccatcgcggccaagcccgacgtgctgctgatcctgagcttcggcgcgcaatcctccgacaccctgcgccaggcggtgagcttcggcctcaagaagcgcatgaccatcgtgctggcctgggcctcgggcctggagcagttcgaggccctgggccccgacctgtgcgagggcgtctatttcggggcgcagtactggcacggcgtggacacgccgctgaacaaggcgctggtcgcgaaggtgcgcgagacgcgcaagttcagcccgaactactccttcgcgggctcctacctgctcacgaagctcctgctcgacggcgccgccaaggccggctccacggacgggcccgccgtggccaaggcgctggagggcctgacctacgcggggctcaccggcgaggaggagatccgcgccgccgaccatcaggtcatcaagaactactacctgctcaaggggaaacccaaggcgcagatggccgacaaggacgatttcgtcgacatcgtcagctccggcaagtcgttcctctcgcccgaggccgccggctgcaagatggcctga

SEQ ID NO: 8082 - DNA, 1194 bp, Methylobacterium sp.
atggaggtgtgcttgcgttacggcgcacccctgcccgtacggtggaaccgtacggtcgccctgctcgcggcgaccctcccggccagcgtcctgatcggctgcgatgcgcctccccccgccgcggtgcccgcgccgcgggtgacggcggccgcgcccctcgtcgcgcccctacaggacagcatcctgctcaccgggcagatgtcggcgaccgcgagcgtcgatctcgtcgcgcgtgtcccgggcttcctgcgcgaggtcggcttcgcggacggtgccgacgtccgacaggggcagctgctcttccggatcgaggacgaatcctacgccgcgcaggccgccctcgctcaggccaacctcgatcagcaggaggccgccctcaagagcgccgaggccgagttcgcgcgccaggagacgctgcgcaagcagctcgtcgccacgcagacgacctacgacagcgccctcgccgcgcgcgacacggggcgcgcggcggtcgcggccgcgcaggcgaacctgaaggtggcgcagatcaacctggcctatacgcgggtcgaggcgcccttcgcgggccggatgggccgccgcctcgtcgatccgggcaacctcgtcgggtccgggacgccgaccaggctcggcaccctggtgcaggtcgacgcgctctacgccagcgcctcgatcaacgagcgcgacctgcgccgcctgcaggcggccatgcgggagcgcggcctgacccgggaaaccctgcacggggtcccggtccaggccggcctctccgacgagccggacctgccccatcggggacgcctggacttcgtcgattccggcctcgacgcgacgaccggcacgctcctcatccgcgcgatcctcgacgatcccggccgtcggctcgccccgggcctgttcgtgcgcctgcgcatcccgctcggccccccgaagcctgcgctctgggtgccgcccgcggcgatcggcgtcgatcaggcgggcccgagcctcctcgtcgtggatgcggcgggcgtggtgaacctgcggcgcgtcgccctcggcccggagcgcgacggccttcaggtggtcacgtccgggctccagccggcggaccgggtggtgaccgagggcgtgcagcacgccgtgccggggcggacggtggtcgcggtggccggcacgatcggcgcgccgaccgcgtcggcccgggccgagtga

SEQ ID NO: 8083 - DNA, 717 bp, Methylobacterium sp.
atgcaggaaaaggcgctccgggccttcgccgagagccaggcctacgaactcgtcgacctgatcgttgacgccggcgtgtcgggtgcgacccggccggctgagcgcgaggggttcggacaggtcgtggcgctggcggaggcgaaggccttcagcgtcctgctcgtctacaagttcgaccggctcgcccgtgagatccggtacgcggtcaccaccgtggcggacctcgccgagcagcatgacatcggcatccgcagcgtgacggagccgatcgacacctcgacgcctatggggcgcaccgtgttcgcgatcctcgccggtatggccgagagcgagcggttcacgatccgcgaccggaccgcgggcggcaagctcgccaaggcgggcaaaggcgggttcgccggagggcgggccccctacgggtacgagaccaacaaggaaggcggcctccgcatcgtcccggcgcaggccgcgatcgtccgccggatctaccgcgagcgtgggccgtcccgccgaccgcgccggacactccaggcgatcgcggaaggcctgaacgccgacggcatcccgtcgcccagcgggaagcgctggcggcacgacacggtcggctacctgctcgacaacccgaagtaccgcggggccgtcgagtacctgttcacctggaccggcgccgagcagcacgtgctcgccgagggtcagcatcaggcgatcctcgcatga

SEQ ID NO: 8084 - DNA, 648 bp, Methylobacterium sp.
atgaccgatttcaccgattacctcgtccgctcgcgcgacgtgctgcaggcggcgatcgactgccccgacctgctcgccgcggccgccagcgccgccgagcggatcgccgcggcgctcgcggccggcggcaagctcctcgtcttcggcaacggcggcagcgcgggcgatgcccagcacatcgcgggggagttcgtctcgcgcttcaactacgaccgcgcgccgctggccgccctggccctcaccacggacacctccgtgctcacggcgatcggcaacgattacggctacgagcgggtgttcgagcggcaggtcctcgccctcggccacgcgggcgacgtctgcctcgcgctctcgacctcgggcacctcgcccaacgtcctgcgggcgatgcacgcggcgcaggacatgggcctcgccacgatcggcctgacggggcgcagcggcggcctgatggcgcccttcgccgacgtgctgctgcgggtgccctccgacgcgacgccgctgatccagcaggtccacatggcgctcgcccacgcgatctgcggccgggtcgaggccagcctgtgcccgaatctggccgagcgcttcgcgcagcaggacggcgcccgggacggcatccgggatgccgcgcggacccgggcggcctga

SEQ ID NO: 8085 - DNA, 1002 bp, Methylobacterium sp.
atgttctggatcacgaaaacgccgctccgggtcagcctgttcgggggcgggacggactatccggagtactacatgcgccatcccggcgcggtggtcgggctttcgatcgacaagtacatctacatcgccgcgctcaggctgaccacgctgcagaaatacaattaccgcctgagctactcgcagctcgaacattgtgaccgtgtcgaggatatcgcccacccggtggtgcgcgagatcatccgcgccttcgatctctcggagcggctcgacatcagcatcatctccgatctgcccgccacgggcagcgggttgggctcgtcctcggccttcaccgtcgggttcctgcgcgcggtctacgcgatccgcggccagcgccccacgaagatcgagctcgcccggcaggcgatcgaggtcgagcgcgagctgctggcggagaatgtcggggttcaggatcagcttcacgccgcgttcggcggcctgaaccgcttcgacttcgaggggccgacgatccgcatccgcccggtccagatgtcgtcgtccgcggtcgagcgcctgaaccggacgatggtcctggtccatacgggcatcacccggcgggcgaccgcagccgtcgccgcgcagatcgaagcgaccacggccgggcgcatcgatcgggagctgaaggatctctacggtctggtggaggtctgcgtggatctgctggagggcgagggccgcgactggctgccggagctcggacggatgctgtcggaatcgtggtccatcaagcgctccctgtcgcgggacgtctcgaacgacgcgctcgacgcggtctttcgggcgatcctggatgcgggggcctacggcgccaagctctgcggggcgggcggcggcgggttcttcctggcgctgatggagccggaccaggtccagcgcctcggcgagcgcatcggatcctcctccgtcgtgccgatccgtctggacgtggaggggtccgccctgatccactgccagaccggttag

SEQ ID NO: 8086 - DNA, 804 bp, Methylobacterium sp.
atgcagaagcagctccgccgccgcggacggcccaagggctcaggtgcgcaacaatcgtccggcatccaggctctcgaccgtgccctcgacgttctcgaggcccttgcggctcatgacggcatgacactcacgcagcttgccgaccacctcgatcaatcggcagcgacgatgcatcgggtgctggcgaccctggagggacgacgctacgtcgagatcgatccgaagcggcaggaatggctcatcggaccggagactttccggctcggctcatcgttcatgcggagttccggcatctttgagagaagccggcccatcatgcgcgacctcatgctgcagaccggcgagacgtcaaatcttggcgtcgaacaagacggcgaaattctcttcatcagccaagtcgaaacccacgaaaccatacgcgcattctttcctcccggcacgaaatcgccgctgcacgcatccggaatcggcaaggccatgctgagctccttcgacgaccagaggatcgaggaattcatcaggaaggccgaattcaggacctacaccgagaagacgatcggaagcgccgagcagcttcgcggtgcgatcgcggaaagccggcggctcggatactcactcgacgacgaagagcggaccatcggcatgcgctgcgtcgcggcttgcatcctcaacgtctacggggaggcggtcgccggcatatcggtctcaggaccgacatcgaggatgcaggacgccaaggtccatgagatcggaaagctcgtgtcttcggccgctcgcgaactttcgaagcgagtgggcgcctga

SEQ ID NO: 8087 - DNA, 1452 bp, Methylobacterium sp.
atgcggacgctgtcgcgcgtcgccctcatcgggatcatcggcggtggcgctgccgcctgctcgtcggacacgatgcgtctcggcgatcccttcaccaatccgttcgcgtcgaatcacgcgagcgagcccgccgcgaccggcagcctgccggacaacgacctcgcgccggcccccgccatccgcacgggccggatccagtcggaggcgctgggcgcgccgtccgcgccgatcacgccccgcgccctgccggcgccggccccggtcgcgatgaagcccgccccgaccgcgcccgccactcgcgtcgcctctacgggcgcggccggctggtcggcctccggcggcaccacgatcacagtctcgcagaacgacagcctgaaccagatgtcgacccgcttcggcgtgccggcctcggccatcctctcggccaatggcctgaccagcgccagccagatcacccccgggcgccagatcgtcatcccggtctacaatgcgtccggcatgaatccggcagcgacccccgccatgagcgcccgcgccgtgccggccgccccggccgagcgcctgaaggccgccgaggtgaagcgccaggacgagcagaagcgcatcgccgagaccaagcgcgaggccgtcgcccgcgaggccgccgccaaggcagaggcggcgaaagaagccgccaaggaggcttcgaagaagcttgccgaggccaaggccgccaaggaagccgcccagaaggccgcggcgctcgaggccgagaagaagaagcacgtccgccccggccagaccgccaagtccgagacgaagaacgagtcgaagcccgacccgaaggccgaggccgcccgcaaggcagaggccgaggccaagctcgccaaggccgaggccgccaaggaggcgtcgaagaagctcgccgaggccaaggccgccaaggatgcggcgaaggccgccgccgacaaggcgtccgccgagaagctggcggccgagaaggctgccgccgccgagaagaaggtcgccgccaagcccgccgagaaggcggaaccggcgagcaccggctcggtcgcccaggcgccggccgccccggcggtgccggaccagaacttccgctggccggccaagggccgggtgatctctggctacggcacctcgggcaacgagggcatcaacatcgcggtcccggagggcaccgccgtgaaggccgccgaggacggcacggtcgcctatgccggctcggacgtgaagggctacggcaagctggttctggtgcgccaccagaacggctacgtctcggcctacgcccataacggcgagatcgacgtgaagccgggcgagaaggtgaagcgcggccagaccatcgccaagtcgggcgcctcgggcaacgtcacctccccccagctccacttcgagatccgcaagggcggcgcgccgatcgacccgatgacgcacctcgccagcaactga

SEQ ID NO: 8088 - DNA, 1776 bp, Methylobacterium sp.
atgcacgccccgtcgggcgcgccctgccaggacgggagccgtccggcccccaagttctgcttccagctccgccccctggactacgcccgcctcgtgcacccgcgtgcgccgggggccgtactgttcggggcgcacctgccgtccacgaagccccgcaatgccgacggctcgcccaaggtggcgtggcaggaccggcgctggagccccggcgccctcgcgaaccgcgcggtcgacctcgcgcggttcaagttcatgtcgttcgccacctacccctaccaccggccgggtgagcccaagccggctaaggtcgaggcgaacgtcgtcagcatcggcgcctcctggatcgacctcgatttctacaaggcgacggactggaaggagacgccgcccgagaccgtcctggaggccgtccgcaacatctgcgccgagcgcggctggccggcaccgtcctatgccacgcactccgggcgcggcctgcttgtcgtgtggctctaccctgtccaacccgcccagatcgtcatggcccggcacaaggcaatccagcagacgctccacgaggcgttccgggacatgggctcggacccgtcggccaggacgatgacgaagcagttcaggatgccggcgacgtataacgagaattcgggcctgccggtctccatcatctggccggctctcgtgcgcgagatcgagcggacggacttcgacgagctctgccgcacggtcctgccgttcaagcgcctgacgaaggcggagcgcgaggccaaggaggacgccgcgaaggccaagcgcaccgctgcccgcctcgccgcacgcgcgccccgggaagggcactacggagcccgcctcaccgggacgtcctactgggccacgatccgcgccgacctggagcggctcctcgactaccggcatggtaagcagggcgtcgtcgacggcgtgtcccgcaacgagtacggcgccggtcgcaacgcctggctcacgtccctcgtctacgccgcggcctgggacatgaccccggaggagctcgaagcctacgtcatcaagtgtgccgaccgcctcggctacgaacatgccgaggccaaggacaagtgctgcagcatcgtcctgcgggccaagcaggccgccaggggcatgcgcaagacgtacaaggggcgcccggtcgacccccgttacaagctgtccccggcccgattcatagagacgctctccatcaccccgcgggagatgcgccgggccgacctgcgcatcctcgtggacgaggcgcgccgggcagagaacgccgtcgcccgcgtcgtggccagccgccgggccaagggagtgaaggcccgcagcagccaacaggacctccgccgccaggtcggcacgcaggccaccgagatggtcgccgagggcatgaccgtgaaggccatcgccgagctctacggggcgtcgccgcggtgggtagacaacgccctccgggacgcccgggccatcgccggcatcggcaccgtccggaaggagaagccgacggcaacggtcgaatgggaggcctacacggagcagcccgtcgtgaacgtcgcggacgtcgccgacacgctcgatgccgtccccccggtcacgcacgaagtgttacggggtattaggaaggccgttggtagtggtgttgtcgctggcctcggcgtggcctatcctgcgaacgtcacgacgaagggcagcactcttctcagaccgacgcccgctgcgcgccaaccggcccggcgggcgttgtcgtgtccggacttcgtcgcggtgggagcctga

SEQ ID NO: 8089 - DNA, 1155 bp, Methylobacterium sp.
atgcagatcgacctcgcgaccctgtggtacctgaccatcgggacgctcctcgtctcggcggcgctgacgctgtgggagcggcaggcccatccccggcgcgcgcgcgagctcgggatctgggcgggcgcctgcgcggtcttcgcgctcggctgcgtggtcgcgatgaaccgcggcctgttccccggcgcggtcggcgcggcgctgaccaacctcctgatggtactgggctacctcatggtcctgcagggggcggcgagcctcgacggtcccgtgcgggtccgcggctcggcggcagcgctcgccgccctcgccctgctctgggctctcgcgggcacgcatttcgaggccgcgctctggaaccacgtctccgcgctgccgatcgcgctggcctgcgggctcaccgcctggaccctcctgcgcggacgcacggtgcggggcctgcgctcgcggccggtcgcggtcgcggtctcgggcgggcacgccctgttctacctcctgcgcgcgctggcggcgcccgtcctcgtcgagcgctacgggccgggcctgctgccggtcttcgccaagatcacgatgtacgaggcggtgctctactcggtggccatgccgatggcgtttctggcgctggtgcgcgaggaggcgcaggcccagctcctggcggcctcccggacggatttcctcaccggcctcgccaaccggcagggcttcttcgaggagggcgcgcggatgctcgcggagcgggcggccggtcggccggtcgcgctcctcgccttcgacctcgaccacttcaagagcatcaacgaccgccacgggcacgccgccggcgacgcggtgctcgccctgttcgcccgcgtcgcccgggacgcggcagggccggaggcgctggtggtgcgcctgggtggcgaggaattcgccgccctcctgccggggcagggcgcccgcgcggcccggcaggtcggcgaggacatcgcgcggctcttcgccgaggctgccgcgcaccgcgacggccccggcatccgggcgaccgtcagcgtcggcctggcggaggcggggccggagcgcggcgatctctcggggctgctctcggcggccgaccgcgcgctctaccgggcgaaggcggcaggccggaaccgcctcgaggtggcggcggccgcctga

SEQ ID NO: 8090 - DNA, 348 bp, Methylobacterium sp.
atgcgcgcgccgcccccgctcgattcggagcgggtccggaacaccacggaggccgacatccggcgccacgcgctggaggacggcgaggatccggatgccggcaccgagggctacatcgtcgtcccgcggccgcaggatctgcgccgtatcctcgccatgacacaggacgccttcgcggccttcctgcgcgtgccggtcgggaccgtgcgcaactgggagcaggggcggacccttcccgatccggccgcgcgcacgcttctggcgctcgtggccgccgatccggcccacgcgctcggcatcctcgggggtgacgggggcgagccggtcctggatctgcggcgggcctga

SEQ ID NO: 8091 - DNA, 414 bp, Methylobacterium sp.
atgtccaaagggcttctccagacagcggacctgcacttcaggagctacctcgacacggtcatgccgctccacgagagcctcgtcgaggagatgtgcgcccaggcgcatccgcccttggagttggccacggtccttgaagacatcggccaacggtacgtcggactggccgccaagctcaacgaggcgctgatccggacggggcgcctcgcggacgagccggacgccgacgacgcgacggacgcccagttggacgagttcgtgcggggcctcatcgcgaacgccggtgtcgtgaccttccatgacgggacgagcgtcaaggtcagcgaggctttgagcacctcccccgtcgttttcggggcgatccgcgcggcggtcctcctgtcccgatccgcgagcgacgcaacggccgcgtag

SEQ ID NO: 8092 - DNA, 372 bp, Methylobacterium sp.
atgatggcggtccgcgccgaggcccgtgagctggtggaagccatcgccggcccgctgcgcatgggcgagaacgtgaaggccgcgctctcgcgcgtggcgcgcgtcaccgggctcggcgatcggcgcgtacgcggcatctggcacaacgaggcacggtccatccgtgccgacgagatggattgcctccgagaggccgcgcgggacgcccgcgagatggagttggcgcgtgatgagtaccggaccttcgcctcacggctcaccgcctgcgacgcggccctgggccttccgtcagcggaccaagctcgcccgctggatcatgctcggctcgggctggctcgcgctgaagatcgcaccctggctcaaggagagtga

SEQ ID NO: 8093 - DNA, 765 bp, Methylobacterium sp.
ttggccaagctctggatcctgtccgacctccacctcgagaccctgccctatccggaaaacttccggccggaaccaccccccttcgacgtgctggtcgcggccggcgacatccaggagggcgatcccggccgcgccttcgcggtcctgcgccgcctcgccggcacgaagccggtggtgttcgtgatgggcaaccacgagcactggaacggcctcgtcgacgaggacctcgccctcgcgcaggttctggccgcgcaggccggcatcaccctgctcgacggaagccgggccgctcacgccggctgccagttcgtcggcaccaccctgtggagcgactaccgcctggcggggcacctcgatcccgacaccccgaccggcgagccgatcgacatcgcccacgacgagcatggcggcagccacctcatcacggtgggcgacgccgcggccctgcaccaccgggcccgggccgcgctggcggcccggatcgcggagagcgacggcgccctgcccctggtcgtgctcacccatcacgctccgcatccggactgcatcgccccggctcagcgcggcacctggaacgccggcaactccgcctccgacctctctgccctgaccgataccgtccgcgcggcgctctgggtgcacgggcacgtccatcacagcctcgacctgacccggccgggcggcacgcgcatcctctgcaacccggccggcaccggattcgccaaccccgccttcgatgagaccctggtcgtcgcgctgggctga

SEQ ID NO: 8094 - DNA, 279 bp, Methylobacterium sp.
atgatcgaaagctttctgcacaaggggttgaaggaactgtttgaaactgaagcgactgcgaagatcgcgaagcagtttcacggacggatcgttcgtcgcctggatgctctcgacaacgcgagtacccccggggatatgaacgttcccggtttcaacttccatccgctccagggcttcgacccgacgcggtattcggtccatgtgaatgggccgtggtgcatcacgttcgagttcaagggcgagaacgcctgtcgcgtggactttgagcagtaccactga

SEQ ID NO: 8095 - DNA, 1032 bp, Methylobacterium sp.
atgagcacacgccgcgatttcctgcacctgtccgcagcggccacggcggccggagtcctggcgggtccagcctccgcgcaggcgccctcgaccgatccgggacgtcccattccgcccgctggcggcgacgccctgcgcctcgtcaccttcacgtccggagcagacggctctccgcggctcggcgtcgtgcgcccggacgggcgcgtcgttgacctgacgggcgccgcgctcccgggcttcgatccccgcaggatggtctcgctgatcgcggctggaccggaggcgctggccgccgtgcggcgcgcggcgtccgccggagagggcctacagctcgacacggtgcggcttctggcgcccattccagagccgacccgcaacatctacgccgtaggctggaactacctcgagcacttcgaggagggtcaggcgatccgcggaacgcagacggagtaccctgcccatccagtgttcttcaccaagggcgtcaacacgatcaacggtccttacgacccgatcccctacgacgcgacggtgtcgacggcgatcgactgggaggttgaactcgccgtcatcatcggcaagcagggacgcaacatccgggaagccgacgccatgaaccacgtcttcggctacagcgtgatcaacgacaccaccgcccgcgacatgcagatcaagcttcacggtgggcagtggttcaagggcaagagcctggacaagcacggtccgatcggcccctggatcgtgcctgcgggcgatctcgatccctccgacctgcgtctcacgacccgggtcaacggcattatcaagcaggatgcaacgaccaagcagatgtacttcaagcttccccgcatcatcgccgagctgtcgcgcggcctgaccctgatgccgggagacatcatcgccacggggacgcccccaggcgtcggcaacgcccgcaagccgcccgagtacctgaagcccggtgacgtgatggagacggaggtcgcgggtatcggtacgctgcgcaacgtgatccaggccgtcccggcttaa

SEQ ID NO: 8096 - DNA, 567 bp, Methylobacterium sp.
atgagtgatatcgacctctatctcggagacaagcggcaggccttggcggcacgggatctgcgcatccggcgcggcgaggcctcgcccgtgccgctgtccgcccgcgcgacggtggagggccgcagcggcgtgcgtcgcatcgcgatccgccgacacgccgtcgtcaccgacagcctgccggatttcgcgggccacgatctcggacccgggtcgccggagctgcagctcggcgtcctcggatcctgcctcgcccacacggtgctgatccaggcggccctgcgcgatgtgccggtcaccgccctggaagtcgaggtcagcgccaccttcgacccgcgcgccggcacggagggattcgagcacatccccgttcacccgcaggacctcgcttacgcggtgcgcctcgactcgccggccgacccggtgagcgtccgcgcacttcacgcggcggtcgagcgtgcctgcccgatcctcaacctgctccgcctgccccaggccgtgagcgggcacatcctgcattcggtgccgccccccggcccggacgccatcgagacggagattcccgcgtga

SEQ ID NO: 8097 - DNA, 1764 bp, Methylobacterium sp.
atgaccgtcgatcaagtgctcgccttcggcctgatcgccgtgaccgtcgcggccttcgtctgggatcgcctgccctacgacgtcgtggccctgacggcgctggccgtgggcatcgcgatcggcctcgtgccggccgacaaggccttctcgggcttctccgacgacatcgtggtcatcgtgggcgcggccctcgtgctctcggcggccatcgcccgctcgggcgcggtcgagacgctgatgcgcccgctgatgccgcacctgacgagcgccggacggcaggtgccgatcctcgtggccggagtcctgctgctgtccatggtgacgaagaacgtgggcgcgctggcgatcttcatgccgatcgccctgcagctcgcccgccgcagcggcacgccgccctccgcgatgctgatgccgatggccttcgcctcgctcatcggcggcatcgtcaccctggtcggcacctcgccgaacgtgatcgtctcgaaggtccgcaccgacctgaccggccagcccttcggcatgttcgactacacgcccgtcgggctctgcgtggcggcggccggcttcgccttcctgtgcctgggctggcgcctgctgccgcggcgcgacgggggcacgcgctcgatggaggcggccttcaccctggagcgctacaccacggaggcgcgcctgcccgccggccacccggcggccggcggcacggtggccgcgctggaggcgcagggcgacggcgagatccgcatcgcaaccatcctgcgcgagcgcttccggcgctatccggcgagcccggacttctccctgaaggacgaggatgtgcttctgctcaacggcgagcccgacgcgctggagcgcttcgtggcgcgaaccgggcttaccctcgcgggcgcggcgcccgcggccgaggccgtggtgatggagggcgtggtgaccgcggagtccgacctcgtcgggcgcaccgccgcccagctcgacctcgagcgcgcctcgggcctcggcatcctcgcggtcagccgacgcggccggcgcatcgagcagaggctctcgtccgtccgcttccgggccggcgacgtggtggtggtgcgcgggcgtgccgccgcgctggcccccgccctgggcacgctgaaggtgctgccgctggccgcccgcgagatcgcgctgggccgcaacgaccggagctggctgccggccgcgatcctgctcgccgcgatgggcctcgtcgcgctccatgtcgtgccggtggcggtggccttcttcggtgccgtcgtggccgtgctgctcctgcgcagcatgaccccgcacgaggcctatcaggcggtcgagtggccggtgctggttctactcggcgccctcattccgatctccgagacggtcagcagcaccggcggcgcggacctgatcgccgctcacctgaccgctctggtgcagggtctctcgcccgtggcggcgctcgccgcgatcctggtcctggccatggcggtgacgccgttcctcaacaacgccgcgaccgtcctgatcatgggaccgatcgccgccaagctcgcgacgaagctcggcctgaacccggacccgttcctgatggcggtcgcgctcggcgccgcctgcgacttcctcacgccgatcggccaccagtgcaacaccctggtgctgggccccggcggctaccgcttcggcgactacgcccgcctcgggctgccgctgtcgctcatcgtgatcatggtgggcgtgccgctgatcgcgatcgtgtggccgcttcatcaggcctga

SEQ ID NO: 8098 - DNA, 456 bp, Methylobacterium sp.
atgtcgaacctgtccgccgagaccctccgcgtcgccgatgtgatggcccgcgacgtcgagttcatcgagcctcatgcgagcgcgcaggccgcggccgtcctcatgggcgagatcgaggtcggcgcgctccccgtgggctcggcggaccagatcgtcggcatcgtcacggaccgcgacctgctctaccgggtcgtggcccgcgggcgcgatccgacggccgttccggtgcaggaggtcgcctcgcgccccgtcctgtcctgcgcgccggacgacgcgctccgcgcggccatggacgtcatggtggcgaactacgtgcggcggctgccggtcctcgacgggagccgcagggtcgtcggatggctgacgctggccgacatcgcccgccacctcctcgtcaacgacgacgccctgcaggtctcgcttctggcgctcaccgagggaacggaggccggctga

SEQ ID NO: 8099 - DNA, 1017 bp, Methylobacterium sp.
atgaacgaggtcgggccggtgactcggaagcgtccaccctcgtcggtcgaggtcgcgcgtctggccggcgtctcgcaatcggcggtgtcacggacgttcacgcccggcagcgtcgcctcgccgtcaacgcgggccaaggtcctcgccgcggccgagagccttggctatcggccgaaccttctctcgcgctcgctgatgaccggtcgttcggacatcgtcgccgtagcagtgggcgcgctgtccaacccgtttcacgccatgaccctggagagcttcacggccggcctgcagcgaaccggccgccaggtcatgctggtgcaggtcgaggacgagtgggcgctgggctctgcggtcgagctgctcgcgggctatcaggtcgacgcgatcctgagctcgctgccggttaccgagccggaggtcgtgcaggcgctctcgcgcttcggggtgccggtcgtcaccctgaactccccggcgactacggactgggtgcggaccgtcgtgaccgatgatgcctgggcgggcgccgagatggcgcgcctgctccacgagcggggtgcccgacgcttcggctacgtcgcgggccggtccggaacgatgggccaggagcgtcgcgaggccggcttccgggaggggctgcgggaactcgggatcgacagctacgcccgcgctcagggcgaccacaagcacggcggcggctacgaggcggttcgagcgctctacgcttcgggcaccgggcccgacggcctgttctgcttcaacgacctgaccgcgatgggcgccatcgacgggcttcggcatgagttcgggctacgctgtcccgaggatgtgctcgtcgccggctacgacaacatcgcggctgcggcttggccgtcgtaccgcttgaccacggtcgatatcgggctcgcggcggtcaccgagtccgcgttggcgctgatcgcgtcgcaagccggcgaagccacggaggcgctggccagacctcatttggtcgagcgcgccagtaccctgagccagcgttag

SEQ ID NO: 8100 - DNA, 1059 bp, Methylobacterium sp.
atgggttcgattgcgcaacgaatcttcccgatggccactctcgccattgctgcggtcgtgcagcccgcttcggcgcaacagacaatcaagatcggcgcggtccttcctctgagcgggtcgaacgcgcagtttggcatcaacatacgaaacggcctcgaactcgcgcttgccgacgtgaatgctgccggcgggatcaagtcactcgggggtgcgaaggtcgagatagtctacgccgacgttccaagcccgaacgcagccgctgcggcgacccagcgcttgatcagtcatgacaaagtggtggggatcgtcggctcgttcgtgagttcgattactctcgccgtatcggaagtcactgagcgagcgggcattcccatgctcacccattccttcgccgaccagatcacggaacgcggctataagtacatcttccaggtatcacccaaggcaagccgcttcggtcaggatcagctcggctacgccgtcgccgtcgggaagagggccggcaccgacgtgaagaagatcgctatcctgtacgaggacacagcctacggcaccgctcaggccaagggtttgcgcgacgccgcgcagaagactgggatcgacgtcgtggtcgacgagggttacccgctcggggttaccgacgtggcgccactgatcaacaaggtccgcgcctccggggctcaggtcgtcttcccggtctcctacttcaacgacgccgtgctgatcctcgtgaagatgcgccagcagagggtcgatctgcccgccatcggcggagcggccggctacatcatccccgagttcgagaaggcactaggcgagagcgtcgagggcgtgttttcgatcgcgccggcgaactacgacgccgctcccgaaatcgaggcccgctaccgcgggaagttcggcaacttcccgccccacgagtcgctgatgtacccggcggggttcgagcacctcgtgcgcgcgatcgaggtcgctaagagcacctcgcaaaactcccgagcaccgggagccctccctctgcacacgacggcgcagcgggagttttgtgagaggctctaa

SEQ ID NO: 8101 - DNA, 1050 bp, Methylobacterium sp.
atgcgcgatgacggtgagccctatgagatcggccggctcaaaggagaatgcgtcctcgccttctggcgcaccgtcgatggacagcggaagcggcaacgttaccgccttggcaccgatgatgaagccgaagcccggcgacgtgctccggcggtatacgcccgcgccatccgcccccaaggccggaaggtaaaggacctctgggacgcctacctgctcgacaagaagggcaggccggtcgcggccgtcatgccgttcgagtggaaggcgctcgaggcgcgcttcggcgaaatggatgccgaggccatcgagatcgcggactgccgggcctacatcgcggaccggcgggcgatgggccggaaggacggcacgatcatcaccgagctcgggcggctgcgcatggtcctgaagtgggccgtgaagcacaagctcgtcgcacacgcgcccgacatcgagcggccggcagcggtgaagcggaaagagcggcacctgaccgcccacgaggtccgccgactcgccgcggcctgcaaggcgccgcacctcgaactgttcgtccacctcgcctatgcgacagcgggcagggcaggggccatcctcggcctgacgtgggagcgctgcgacttcgcccgggagaagatcgacctcgaagaccccgagatcctggtgccgcacaaggggagggcgatcgtgccgatgacgcgcacgctgaagacgcgcctgctcgcggcgaaggccggtgcccgctcaccattcgtgatcgagtggaacgcgcagcgcgtcgggtcggtgaagaaggggctcgcagcggcggccgagaccgcggggctgcagcacacccacccgcacctgctccggcacagcgcggcggtgcgcatggccgagaccggtatcgatatggaggagatccgcagctacctcggccacgagaacgttgcgaccacgcgccggatctacgcgcggttctcgccgaatcatctgcgcggcgcggccgccagcctggaactggacgagggcttggaggaggtcgcacctctggcgacccgtgtcaggtag

SEQ ID NO: 8102 - DNA, 855 bp, Methylobacterium sp.
atgctggaactgacgcagctcctggcgaacgcgctgggccaccaccttgccgagacctacacgcgcatgttcggcagccgggagccgcgctacgccgaggtgatcgacgaatcggctcggctgacgatcgagcgcctcgtcggcagcgacgcgctctatcacgacgcggaccatacggcgctcgtcgcgctggtgatgcaggacatcctgcgcgggcgcttcgtcagccgctcggtcggtcccgaggactggctccacgcgatcctggccgcgctctaccacgatatcggctacgtgcgcggcatctgcgcaggcgacagcctcgggcgctacgtggtggacgcggacggcaccaccgtcggcctgccgcgcggcgcgtccgacgcagcgctcgcgccctggcacgtcgagcgctcgaagatcgccgtgcgcgagcgcttcggcggccacgacctcgtggatgccgagcgcgtggtgcgggcgatcgagctgacgcgcttccccgtcccgaacgacgccgaccacgcggagaccgcgaccgaggcgggcctgctgcgcgccgccgacctgatcgggcagctcggagacccgctctacccgcgcaagctcaacgccctgttccgggaattcgccgaggtcggcctcgacagggaactcggctacgccgacccggccgacctcgcgacgggttatccggccttcttctggtccaaggtcgagccggtgatcggcgagggcatccgcgccctcgatgccaccgtcgagggacggcgctgggtggcgaacctctacgcccacgtcttcgccatggagcacgaccggcgccggatggggcccgacctcggtcggccgtga

SEQ ID NO: 8103 - DNA, 1032 bp, Methylobacterium sp.
gtgttcaccgagccttcctccgccggcctcgcgccgggatcctctccggcgcatctccccggcacctgcctgatcgttcagccgatccacgccgccggactggcgcgcctgcgcgcggccggcctcgcgccaaggtttgccggcagcgtcgcggccacggccctggcgcgggaggccgccgactgcgtcgcggtcgtgacccgcaatgccggcttccccgccgaggcggtggcggccgcgccccgcctccgggtgatcggcgtccacggcacggggaccgacccggtggccgtcgccgaggccacgcgcgcggggatcgcggtggtcaacaccccgggcgccaacgcgcgctcggtggccgagcacgcgatcggactgatcttcgcgctcgccaaggcgatcccgcaggccgaccgcgcggtgcgggcggaggaccacgatttccgcgaccgcgcgcgcctcgtcgagctcgccggcctgacgctcggcctcgtcggcttcggcgccatcgggcaggcgacgggccgcctggcggcggcgctcggcatgcgggtcctggcctacggtccgacgcggccggacgcggacttcgccgccgtcggggcggagcgcgtcacggcgctgcccgagcttctcgcccgggccgacatggtctccctgcacctgccgctgacgccggaaacccgcgggctgatcggacgggatgcgctggccgggatgcggcggggcgcattcttgatcaacacggcccggggcgccctggtcgacgaggacgcgctcgcggcggcgctcgcggccggtaccctcgccggcgcggcgctcgacgtggtctcgggcgatgcgctggcgccggaccatcccctgtatacggagcagcgggcgatcctcaccccgcacatcgccgcctccacggaggccgccctgatccgcgccgccgagcgggtggccgatcaggtcgtcgacgtgctcgcgggccgccgcccgtcgaacctcgtcaacccggatgcctgggcgcggcggcgccgcgcatga

SEQ ID NO: 8104 - DNA, 816 bp, Methylobacterium sp.
atgacgcgcaccttgaaccgcagacgcctcctcgccctctgcacgatcctcgggggcagcctgctggccgcgtcgtccggcacccgggcgcgggcggccgagctcgagctgatccagcccggcaagctcctcgtggccaccgagggcacctacgctcccttcagcatgcgcgcgccgagcggcgaactcgacggattggagatccgggtggccaaggagatcgcccgccgcctcggcctcgcctacacgccggtggtgatcaagttcgattcgctgctgatcgggctgatggccgaccagtacgacatgacgagcgccacgatggacatcacgccggcccggcagaagcaggtcgccttcgcggacggctggctcgaatcgggggcgcggatcatcacccgcaaggggaccggcatccaggcgccggcggacctgaaggggcgcaacgtcggcgccgtcgcggcctcgaccttcggcaagctcgccgaggagcagggcgcgaacctcaagagctacaaggccgtcgcggaggcgatgcaggacctcgtcggcggcaacctcgacgccgtgatcaacgacgcggtggccggcacctacgcgatccgcgaccgcaagctgccgctggtcatgatcgagaccccgctcagcaccgtgcagaagggcatggccatcaagaagggcaagccgaacctgcacgccgccgtcaacaaggcgctggccgagatggtcgcggacggcacctatgccaagctcgtcacgccgctggtcggctacgacccgttcccgaaggagccgatccgcacgccggccatgtga

SEQ ID NO: 8105 - DNA, 681 bp, Methylobacterium sp.
atgaagaccctcgacgcatcgtcctacacgacccgcctcggcgcgcggcgcgagcagagcctcggccagatggcctacgaccggttgctcgacatgctgatgcggcgcgatctcccggccgggacggtgctgcacgagcggcggctcgccgagatgctcgacatctcgcgcacgccgacccgcgaggcgatgtcgcgactggagaccgaggggctgatcgagcggcagcccggcgggatgctcgtggtcaaggagttctccctgcgcgagctgatcgagatcctgcacgtgcgccggctcctggagcgggagagcgtgacgctggcgaccggccgcatccccggcgcggtgctggaggatctccgggcccggatcgaggacctgatggccgccggggatcccgacgcaccgggcaaccgggagctcgaccggcgcttccatgaactgatcgccgacagcagccacaacgcgctcctcgccaagacgatcaaggacctgcgccggaagacgcagatgttcaacctgagccggatgccggagcggttcgaggcggtccatcgcgagcatctcgccgtcctcgcggccctgcgggccggcgacgcgagcggggccgccgacgcgatcgcggcccatctggagaacttcaagcagggcatcatccgccgcctgagcgagctgtag

SEQ ID NO: 8106 - DNA, 1326 bp, Methylobacterium sp.
gtgcctggctggatcgagaataccctctggtggcacgtctatcccctcggcttcgtcggcgccccccgctcggcgccggaacaggccgagccggtgccccggctgcggcacctcgaagcctggctcgactacgccgccgagatgggggcgaccggcctcgctctcggcccgatcttcgccgcctcgacccacggctacgacacgatcgatcatgtccgcatcgatccgcggctcggtgacgacgccgatttcgacgcgctggtggcggcggcccgcgcccgcggcctgcgcctgctgctcgacggcgtgttcaaccatgtcgggcgcgacttcccggccttcgccgaggtgctgcgcctgggcccggatgcgccccgggcccactggttccgcctctcctggccgcgcgggcccggcgcggagccggattacgcctgtttcgaagggcaccggcagctcgtcgccctgaaccacgacgagccggaggtcgcgacctatgtcgagggggtgatgacgcactggctggcgcggggcgccgacggctggcggctcgacgccgcctacgcggtgccgcccgccttctgggcacgggtcctgccgcgggtgcgcgcggcccatccggaagcctatctggtcggcgaggtgatccacggcgactacgcgaggttcgtgaccgagagcggcctcgacgccgtcacccagtacgagctttggaaggcgatctggagcgcgctgaacgaccgcaacctctacgaactggcccacgcgctggagcgccacaacagcgtcctcgaccgtttcgtgccccttaccttcgtgggcaaccacgacgtgagccggatcgccagccgcctccagaacccgcatcacctcggcgcggcgctcgctgttctgttcacctgcggcggcacgccggcgatctacgcgggcgacgagcagggatttgtcggcatcaaggaggagcgcgcgggcggcgacgacgcgatccggccggaattccccgccacgcccgccagcctcccggcggagggctggccgctctatcgcctgcatcgggagctggccgggctgaggcgcgcccatccctggctgcaccgggcgcgcatccggatcgaccatctggccaaccggcagatggtggcccgctcgcacgcggagagtcatacgctcctgctggcgctcaacctcgacgacgcgccggccgctctgccggccccgggcgggcgggccgttgaagcgggtacggggcaggtcatcgatcccggcgcagccggtgcccgcgtcctcgttccgtcccatgcctgggccgtgctctcctgcgcctga

SEQ ID NO: 8107 - DNA, 429 bp, Methylobacterium sp.
atgagcgcgctcgtcacccccatccacaccggcacgctcggcggccagcccctgcgcttcttcagggcgccgctacccggaccgcatctggtctggcacgcgcccgaggatctgtatcgctgcctcggactgccgcgggatctgcggcgccatttccagcggcgcctccaagcctcggagtgggcgaacgatgtgcggaccgtcgcaacggcggccggtatcgtcatgatcgctccgcactggatcgcccagggcatgatcggctccatgatcgaggtcggccgcgcaccggcctccgtcgagatggcgtacgccaagcaggccgtggatgcctggaacgctctgacgggcgacctgccgcccggagcgaacatcgacctgatgatcgcggccttccgcaatacgaacggcgtgggaggcatggcatga

SEQ ID NO: 8108 - DNA, 468 bp, Methylobacterium sp.
atgaacatcgtcgaactcgtccgcctgttcgcggagccgctcgatgttggggtggtcctcaccgacatcgatctcgatcgccccggaccgacggtgctgtacgcgaatcccgccttcctgcggatgagcggctacgagtccgacgaggtcgtcgggcgctccccgcgcctgttgcagggcccgggcaccagccgcgaggcgacgcggcagatccagcgggcgctgcgcctcgacgggcgcttcatgggctgcctccagaactaccgcaaggacggcgaggcctatctctgcgagatcgacgtgcgcaccgtgcggcggcgggatgggacgccggaggccttcatcgccttcgagcgcgaggtggtacgccgacgcggacgccccgcacggggcggcaacgggcgctaccggccgatccacgcggccgcgctcccgctcgtggagaacctcgcgccgctcttcgactga

SEQ ID NO: 8109 - DNA, 774 bp, Methylobacterium sp.
atgatcctcgacgaggacgcggaagcgccaccgccgcggcggatcaagctctccgatcagatcgccgaggatctgtgtcggcgcatcgcccgcgaccggatggagccgggacagcgcctgccgaacgagcgcgcgctgatgcagcattacggctgcgcgaaggggacgatccgggaagcgctgaaatccctggaggtgcagggattggtgacgatgcagcccggcccgaacggcggcgccgagatccggccggtctcgatcgatgccgccgccctgcagctgcggcgcttcctgcatttccggcagctcgacttcgcccaggtctacgccgtacggcgcagcctcgaagtcgcgctcggcctcagcatcgtcggccggatcgacgatgacatcctgcagcagctggcgcgcaacatcgatgcctgccaggcggcggccgatgccggcgatctcgcccgcgggcgcgtcctggagctgaagttccacgacatcctgtgcgatgcgagcgacaacgcgctcctcgccttcatgtgccggttcctgaacagccttctgcgcgacctcgtcgaatttcgcagcggcagcgcgacggagcacgaagcgttcggcgcgcacaacatcgacagccatcgccggctcgtctccgccttccgggcggaggatgccgaggcggtcgaggcggtgatgcacgagcacatgtgctgcgccgagcatttcatgcgtcggctcgacgccgccttcaaccgcgatctcctgagcggcgaacgcgcctag

SEQ ID NO: 8110 - DNA, 228 bp, Methylobacterium sp.
gtgtcggccaagggcaagaaggacaagcgtcaggcctacctcgtcgccgtggcgcagcggcgcgaggcggcgcggatctacgccgtggtcgcggcctccgaggcggcggcgctcgccgcgctcgccgaccacgcggcggagaacgtccggctgcaggtggtgggcggcctctcgcgcgacatggtgcgccggctcaagctcaagccgggggagctgcgcctcgtgtga

SEQ ID NO: 8111 - DNA, 162 bp, Methylobacterium sp.
atgcagcagaccgagtacggccggaccgcggccaacgcccccgcccaccgcgtgggcgaggacgtcaacgacgtggatcagacctcgagcgtcacgctgctcggtctggccgtggccggagcggtcgtcatgctgctgctggtgcgcctcgtggtcggctga

SEQ ID NO: 8112 - DNA, 375 bp, Methylobacterium sp.
atgggcgaggcggtctgggcttggcagcgcgcgcggcgcctcgtcggacagccaccttggcgagccgcggcaagcctcgccgaggcgggcgagcgtgagagcgccgagacgctgatgctgcaggacatcccgatctgggagggtgccctcaaggccctcgacgccgagaccgcccgggccgttcgctacggcctgcccgtccctctgccgctggcggtgccggccccggtggcggcagccctcgccgcgcatcgtgcttccgtgctggagcgcgcgctccgccgccgcggtcgaagcgacggcgggggcggcgggccggacctcgtgccccccgatccgggagccggccccgcgatacccgggcgcggcatctga

SEQ ID NO: 8113 - DNA, 717 bp, Methylobacterium sp.
atgcgctgggagaccctcaatgcctacgtcgatggggaactcgatccgcaggaccggcgcgcagtcgcggagacgctggcccgcgatccggtcctggccgcgcgggtcgcgaccctgacccggctgaagcagggagtgaaacaggaggtgaaggctgcggccgtgccgccccggcgcgcgccgatcgcccgcgcctccctcggatgggcgtgcgccgcggccctggtcgtcctcgtcggcgccggctggctcgccctgtcgtctcgcccgccggccgaccccgcgcgcgcggccttcacggcatggggtgcggcgggctcacccgcgaacgacgtgcggcccgcgggcggcccgaatggcttccccctcgatctgggggcggcaggcttccgcttggtctacctgtccccggacgacggttcggccggtcggctcgcaggttacgaggggcgtcacggttgccggctcgccatctggagcggaccgtcgcgcgggcaggccggtctggagatcgcgcaaggggacagcggcccgcgtgtggcgcgctgggatagcgaggggcggcgatacgtcctcctgaccgagacggtaccggccgaacggttcgccctgctggccgaggcggccgcgctgctcacgacgccggacaggacggaccgcctgcggcttgccctggaccgggccaccggactctcggcgcgcccctgcaccggctga

SEQ ID NO: 8114 - DNA, 489 bp, Methylobacterium sp.
atgcggtccatcggtcagcacctcgtcgatgcgtggccgcgcctgttccgctacgcgctagccctgacgcgtgagcccgacgccgcacgtgacctgatgcagcagagtgctctcaaggcgctttccacgcgtacgactcccagtgagcctcacgcggcccgcgcctacctgttccagatcgtgcgccacgcctggatcgaccggatccgccggacccgcctccaccacgaggatgagctcctcgattggcccgacgaggggttcgacgaccgcctgatcgaggcgatcgccgtgcgccaagccttcgccgctctcgatatgccctgccgggctgtcgtgacttgcgtggacgtcgaaggcttgagctaccgggagaccgccgaacggctcggcattcccgtcggcacggtcatgagccgtctgcacagggcgaggcggatcatgctgcaccggatcgccgggccgtccgatgggagcgaggggccgtga

SEQ ID NO: 8115 - DNA, 531 bp, Methylobacterium sp.
gtgtcggagcagggcgggacaggtcgggatcacccgtcacccgagcgggaggcgatcgaccgccgccatcgcgcggtcgcgccgggccgccggcaggtcgccgaggtggtcggccagaaggtgctccacggctttctgcagaaccgccaccagaccctgatgccgctgagcgtcaatctggcgcgtctcgccgaggcggagcgcgcagccctcgcgcgctttgccgcggtggccgcccaggccggtcgtgcggaatccgcgcccgaccgggtgcggacctggctctcgggggcgggcgcggatgcgggcctgctcgcggcgttcgatgcctccctccggtcgccgccaccgctcgatgcggttctcgccgcgttgcgtgagcccgagaccgctctgatcgccttcatcctgtgcctggtcgccgcgcgtgaggccggcccggcgggatgggccttcgccgaatatgtcgccctgcatcgcgccctgccgaccacggccgtgcgcgccgccgagcgccgataccgaacctga

SEQ ID NO: 8116 - DNA, 201 bp, Methylobacterium sp.
atggcggcggaagccctgcctgacctgtctctacaggtcgagccgaacccgaaggatccatcgcgctatcgctgggtcatccgcgatcaggatcacatcctgcggcaatgcctctactccttgcccaatgagcaagcggcgcacagtcgaggggaagccgctttcgaggagatgaccgccctgcggcgcgacgctcagtaa

SEQ ID NO: 8117 - DNA, 1425 bp, Methylobacterium sp.
gccagttcctccccgcgcggcttcacggcgctgggcgacggcaagatcctgttcagcgcgattaccgcggcgaacggcaccgagctgtgggtgacggacggcactgccgccggtacccgactcgtcacagacatcaacacggtacccgacagctccaatccaggcggcttcaccctggtcaagcctccccctgctcccccctccggcggaggcggaggcgagccaccgctcgtcagcccgaacaccgggaccggcggcagcagcacgagcctgaccaccacgagcgatcccgccgctgccgccggcgccgcgaaccaggccgtgcagagcctgcccgccggcctcgacaaggccgcggtcggtcaggccgtctccagcttcctcgccggcctgcctgcgggcaccagcgtcaacgtctccaccttcaccccaacgcccggcgccgccaaaatcagcctgaccggccccaccgacggcagccagaccctcgtcatcctcgacgcctccgccctgccgccgggtacccccatcacgctcaacaatgtcggcttcgtcgtgctctccggccccgcctcgctcatcggcggcgacggcgcgcaggtcgtctacggcgatgatgccgcccaatcgatggtgctgggcgccgacgacgacaccctgcggggtggcggcggcaacgacgtcgttggctcgaagggcggcaacgacctgctctacggcgatgccggcaacgacacggtcttcggcggcgcgggcaacgacacgctgtttggcggcacggagcaggatctggtctacggcaaccaggacgccgacctgatctacggcaaccagggccaggacacgctctacggtggccagggcgacgatcgggcctatggcggccagggtgatgaccggatctggggcaatgccggggccgaccgcctgttcggtaatgccggagccgacctcgtctacggcaacctgggcgcggacgtcgtctacggcaaccagggggcggacacgctgtttggcgggcaggaggccgacacgctgttcggcgggcaggacgcggacgtggtctacggcaatctcggagcggacatcgtctacggaaacctgggcaacgacgtgctctacggtgggcaaggcaacgacatcctgtacggcgggcagggtgacgacgtgctcgtaggtgggctcggcgacgacatcctggtgggtggcctgggcgcggatcgctacgtgttcggtgcgaactcgggccgcgacctgatccggggcttcgagcaggcctcgggcgaccgcatcagccagggcggccagacctacacgctgagcacgagccagggcgggaacgcgctgctgctgctctcgggcggcggcaccgtggaactggccggcatcagggccgagcaggtcaacacaggattcttcgcctga

SEQ ID NO: 8118 - DNA, 1071 bp, Methylobacterium sp.
gtggtcgctcaggccgtctcgaccttcctcgccggcctgcctccgggcaccagcatcaatgtctcgacattcacccccacacccggcgcaacaagcatcagcctgaccggccctaccgacggcacccagaccctcgttgtcctcgacgcctccgccctgccgccgggcacgcccatcaccctcaacaacgtcggcttcgtcgtgctcgcaggccccgcctccttggtcggcggcgacggcgcgcaggtcgtctacggcgatgatgccgcccaatcgatggtgctgggcgccgacgacgacaccctgcgcggcgggggcggcaacgacgtggtcggctcgaaggccggcaacgacctgctctacggcgacgcgggcaacgacaccgtcttcggcggcatcggcgccgacacgctgtggggcggcacggatcaggatctggtctacggcaaccaggacgccgacctgatctacggcaaccagggccaggacagcctctacggcggccagggcgaggaccgggcctatggcgggcagggcgacgaccgcatctggggcaatgccggggccgaccgcctgttcggcaatgccggggccgacctcgtctacggcaaccagggcgcggacgtggtctacggcaaccagggggcggacacgctgttcgggggacaggaggccgacacgctgttcggcgggcaggacgcggacgtggtctacggcaatctcggagcggacatcgtctacggcaacctgggcaacgacgtgctctatggcgggcagggcaacgacatcctgtacggcggccagggcgacgacatcctggtgggtggtctcggcgacgacatcctcgtcggcggcctgggcgcggaccgctacgtgttcggcgcccagagcggtcgcgacctgatccggggattcgaccaagcggcgggcgaccgcatcagcctgggtgggcagggctacacggtctccacggcccagaacgacgatgcgctcctggtgctcgcgggcggaggcagcgtggaactggccggcatcagggctacgcaggtgagcgcccgcttcttcgcctga

SEQ ID NO: 8119 - DNA, 1104 bp, Methylobacterium sp.
gtgcagagcctgcccgccggcctcgacaaggccgcgatcggtcaggccgtctcgaccttcctcgccggcctgcctccgggcaccagcgtcaacgtctccaccttcacccccacaccgggcgccgggcccatcagcctcaccggacccacggacggcacccaaagcctcgtcgtcctcgacgcctccgccctgccgccgggcacgcccatcaccctcaacaacgtcggcttcgtcgtgctcgcaggccccgcctcgctcatcggcggcgacggcgcgcaggtcgtctacggcgatgatgtcgcccaatcgatggtgctgggcgccgacgacgacaccctgcgcggcgggggcggcaacgacgtggtcggctcgaaggccggcaacgacctgctctacggcgacgcgggcaacgacaccgtcttcggcggcatcggcgccgacacgctgtggggcggcacggatcaggatctcgtctacggcaaccaggacgccgacctgatctacggcaaccagggccaggacacgctctacggtggccagggcgacgatcgggcctatggcggccagggtgatgaccggatctggggcaatgccggggccgaccgcctgttcggtaatgccggagccgacctcgtctacggcaacctgggcgcggacgtcgtctacggcaaccagggggcggacacgctgtttggcgggcaggaggccgacacgctgttcggcgggcaggacgcggacgtggtctacggcaatctcggagcggacatcgtctacggaaacctgggcaacgacgtgctctacggtgggcaaggcaacgacatcctgtacggcgggcagggcgacgacatcctggtgggtggtctcggcgacgacatcctggtgggtggcctgggcgcggaccgctacgtgttcggtgcgcagggcgggcgcgacctgatccggggcttcgaccagggggcgggcgaccggcttgtgctgggcgggcagggctacacgctgagcacgagccagaacggcgatgcgctgctgctgctcgcgggcggaggcagcgtggaactggccggaatcaggactgcgcaggtgagcgccggcttcttcgcctga

SEQ ID NO: 8120 - DNA, 291 bp, Methylobacterium sp.
atgaaaaagcttcctcgtatcaagacagctgaaccggtcattcacggcgtcctgaagctcgtcttcctcgacggctatgagggcgtgatcgacctccggccgctcttggcccggggtaagatcttcacgtggctccagaaccccgagcacttcgcggccgtccgcgtcgaggagtacggccactcgatcggctgggtcgatggaagcggctacgaaatcgatctgggagcggattctctgcgccgcgactgtgagcgccaagcagagattcacaagctgatggcggtctga

SEQ ID NO: 8121 - DNA, 252 bp, Methylobacterium sp.
atggcggtcgtcgcgaacgtcagcggggtgcggatcatgttctatgcgaacgagcatccgcccccgcattttcacgcgaaatacgcggagtaccatgccgtcatcgacatccagtccttgacggtcgccgaaggctttctccctgtcgcgaagcggcgagccgtcctgggttgggcctcgacgcgacagaagcagctgaataccgctttcgtccgggcaacgtcgcacgagaaggtggatccgattccatga

SEQ ID NO: 8122 - DNA, 885 bp, Methylobacterium sp.
atggagcggatcggcgcgcgggggagcggcgggagcctcgcgctcgggctcaccgcacgccgcgcgcccgggctcgtcctgccggcgctccgcggctgggtcggcggctgcctcgccgcggaggccgcgcagcgacggctgttcccctggctcgccgttgccttcggggccggcatcctgctgttcttcgggctggcggacggcacccccgtcctcgccgcgccgctcggcgcggccgccctctgcctcgggctgacgccctggctcggcacccgcccggtgatcctggcgctcgcgctggccctgaccgccgccttcctcggcttcgcggccgcgtcctggcgcgtctcgcgggtcgcgggcccgatcctcgcccgcaccacgatcgggccgctcaccggcctcgtcgagtccctggaggagcgggaggagggcgcccggctcgtggtccgggtcgcccgcttcggtgcgctcagcccggaggagacgccgcggcgggtgcgcgtgtcgttcaagcgggcgccgcccgtgaaacccggcgacgcgatcgaggcgagcgcgcgcctgctgccgcccccggaggccgcccggcccggcggctacgacttcgcccgggacgcgtggttccgcggcatcggcgcggtgggctcgctgacgggcaagatcacggtgcgcgcgcccgccgagccgccgggcctgtcctcgcgcctcgcagccctggtggacgccgcgcgcaacgccctgacccggcgcatcgccgaggcgacgggaggtcaggccggcgcggtcgccgcggcgctggtcaccggcaagcgcgggctgatcgcgcccgccaccagcgagaccctgcgggcggcggggatataccacgtcgtccagggatga

SEQ ID NO: 8123 - DNA, 423 bp, Methylobacterium sp.
atgcgggtccattacctcgctcgcagcggagcgacgcgggatgcgctcggcatctaccgggtggagctcgcacctcgctcgcccggtgccggcctccaccggcatgctcgcctcactgaaaccttcgaggtccatgccggccggctcaccgtgcggatcgagggtcataccctggagctcggccccggcgacttcgtgctgatcccgcccggccagccgcacgccttcgccaaccgcggcgacgaccccgtcagcttcaccctgagcttcaccccggcgctcggtcgcgagggcttcttcgagggactggccgagctcgcggccgcgaatcggctcggggacgaggcggcgatggacgccctgatggcggactacgatcaggaaccgctggaggggttctccggctggagcaggatcgactga

SEQ ID NO: 8124 - DNA, 600 bp, Methylobacterium sp.
atgacgaacatctcaagcctcgcgagcctctcgaacatcacgcgctccgagggcgatccgaaggtcctccggtccggcccgagttcgcgcggcgtaccggacagcctcgccaaggggctcggctggttcagcctcgccctcggtctcaccgaactcttcgccccccaccgcatcacgcgggccctcgggatggagggcaaggaggccctggtgcgcgtctacggagcccgcgagatcggcagcggcatcctctcgctctccgtcgacaagaatctcgggctctggagccgggtcgccggcgacggcctcgacatcgcgaccgtgatgacggcgcttcggccggacaacccgaagcgggacaatgtcgtgatcgccctggcgctcctgctcggcatcacggcggtcgacctgatcgatgcccaagccagcacggcgcggcacagccgcggggtgggtcggaagagatcctaccgggatcgcagcggttttccgcgcggcgtccaggcctcccgcggcgccgcccgggacttcaagacgccacccgacctgcgccacgctccgcccctcgccgcggtctcgcagcgtccgtccgtcgcctga

SEQ ID NO: 8125 - DNA, 1068 bp, Methylobacterium sp.
atgcctgtgggcagcggcccggacggcgcctcgacgggcgggcccgtcgagccggggccgaccttcagcgtcatcatcaacaactacaattacaggactttcctgaccgaagccgtggagagcgttctcaggcagacgtacaaggactacgagctcatcatcgtggacgacggatcgaccgacggatcggtcgcatatgtcgagagcctcgcgaccgacctcaccctcgtgcggaccgatcgccgaggccaggcccgggcctgcctggaggcgttccggcacgcgcggggccggtacatctacttcctcgacgccgacgacatcgccttcgaaggtctcctcggcgcggcagccgcggccatcgccgacgagccggccaagctgcagttccgcctcgtccccgtcgatgcggacggcaggcccttcgccgatcccacacccgccatcacggcggaccacgacgccgcgagccagcgcgccgagatctacaggaccggcatgccgctcgccccgccgacctcgggaaacatcttccacaggcgcgtcctggaggccgtcggcgacattgcgtacgagacggccatcgacgggatcacgcttctggcggcgccctttctcggcgcggtcgtcagcatccccgacagtttggggagctaccgtgtgcacgggatggggcattcggcgcacgccaatcccctcgatgccggacgaatcgcgcgggaccgcgagcgtttccgaggacgcatcgcgcatctcaacaggatcctgcggacgctcggactgtccgcgagcccggtccgggaggccgagagcttcttctacttctgggactgcgtcaccctggaggctgccgtgaccggacgggcgatcgggccgcgggcggtcctcgccttcgtggcgcggctgctggccgagcacggtctcacgcgcttcactctccggaagctcgcttggctgatcatcgcggtggcggcaccgggcccggtcaaacgccgctacgtccgggcgcggctgaacccgtggccccggcgccgggtagggcatccgcccgcgatcgagagccgttag

SEQ ID NO: 8126 - DNA, 864 bp, Methylobacterium sp.
atgagacccgcgatccgccgccggcccttcctgcccctgttcgtgacgccggcggtcttggtcgccgtcgcgatcgtggccgccatggcggcgatcctgcgctacagcctgcacgcctacgtgccgggctccctcgacgtcggcgggctcacgctggagaacttctccgatctcggccgcccgatcgtgctgcgcgctctgcgcgacacggtgctgatctgcttcgagacggcgctgatcaccctggtcgtcggctaccccgtcgcctacgcgctggttcgcacccgctcgctcttcctgaagtccgtcatcctggtcaccgcggtgaccccgctcttcctcggcgaggtggtgcgcacctacgcctggacggtggtgctcggcaattccggcttcgtcaacgcgacgttacgccagctcgggctgatcgagcggccgatccagctcatgttcaccgagctcggggtgatcatcgcgcttgtccacgtgacactgcccgtgatggtcatcatgctggccgccgccctcgcccatatcgaccgcgactacgagcgcgccgcccagagcctcggcgccgggccggtacgcgccttcctcaccgtgacgctgccgctctcgatgcccggcgtggcggcgggcttcaccaccgccttcgcctggaccttcagcgccttcgcgacgcctcaggtgatcggcggcggcaaggtcggggtcgtctcgacgctggtctaccagctcggcttgtcctcgttcaatttcccggtcgcggcctccttgagcctcgccggtctcgtcctagcgctcggtacgatgtggctcgtgcgccgcgccgcccgcccgctcgaagcgctcggaggccactga

SEQ ID NO: 8127 - DNA, 282 bp, Methylobacterium sp.
atgatgcgggcggtattcgtggtcggcgcggtggcactcggcttggcggggtgcaactcagcgcagccgggacgcggcgagctcttcatgagcggcgcggaggtcgacgcgaaggacgacgccctctgccgaagctacggcgccaagcccgggacggatgtctacgtgcagtgccggatgaacgcagggaatcggcggcaggccttcaaggcggccattctcaacgacacgacctgcaccagcaaccgcatcggcagcaccgtcgtcacgaactgccactga

SEQ ID NO: 8128 - DNA, 777 bp, Methylobacterium sp.
gtgagcccgcaccgcgcccgctactggatcctggcgatcctctcgccgctcggcctcctggcgctctgggccttcgtgacggcgcgggggctggtgacgcccgtcctcctgcctccgccgctcgcggtcctggcgagcctgaaggacatggtggcgcagggttactcgggcgtcgatctcgcgacccacgttctcgcgagcctgcgccgggtcggcctcgccttcgcgggcggcgccgtgctcgggaccggaatcggcctgttgcgcgggcgcgtggccgagatcgacgcgctcttcctcgtcccctcggaactcctccggccgatcccgccgctcgggctgatcccgctcttcatcctctggttcggcatcggcgaggcctcgaaggtcctgctgatcttcctctccgtcttcctgatcgcgatggtgaacgcgcaggccggcgcacgcgcctgcaccctcgacaccctgcgggccgcccggtgcatgggtgcgagccgctggcagagcttccgccacgtggtgctgccctcggctctgccgcagatcatgacgggcctgcgcgtcgcgatgggcaccgctctgaccatcctggtggcggccgagctgctgggcggcgaccgcggcctcggcttcgtcatcctcgacgcgtcgagcttcttccgcaccacctacgtcttcgccggcatcgtcctcgtcgggctgatcggcctcgtctccgatcgcgcgatcgcagccctcggacgccgcatcgtccactgggagggccggcgctga

SEQ ID NO: 8129 - DNA, 798 bp, Methylobacterium sp.
atggcgttcgttgaggtcagcttcgctggccgggtgttccggcttgaaaaccgcgacgacatggatctcgtggcgcgacagatcgcgcgcggtgcctacgagccgcccctgccgatgttgatgatggcgacgctggtccgttcggaggggatcttcgtcgacgtcggagccaacaccggcgtctacacggtgatggccggtgagatcgcagccaaccggtccatcgttgccttcgagcccctgggacccgtcgtcgagatcctgaagcggaacatcgaggccaacggtctgggggatcgcgtgcgcttgatcgaggtcgcactcagcgatacgaccggaacggcgaagcttcacctgcccgatcccgggcacggcctcgtcgagacgagcgcctcgctggagagcgattttcagccggctcattcggcctgcgaggtgccggtgaaacggctggacgatatcgggatcgccgacccggtcgcggtgatcaaggtcgatatcgagggacacgagcacgcctttctgcgcggcgcccgcgacacgatcatgagagatcgaccgatcatcttcgcggaggtggtcggcccggcccggcgtggcgccatcggcgccttcctgcacagcgtcgactacatggatttccgtctgcgcccggatatggcaattcacgacggagaggtgatgttcgatgatgctgcctggaaccatgcacttgttccgagggagcgcctgtcgcgattcaaggatgcttgcgactcctgcaatctggcgatgcttcgtcggtttcagcttacctga

SEQ ID NO: 8130 - DNA, 1416 bp, Methylobacterium sp.
atgaccgcacacgtccctctctcctcgcgtcaccccgctcaggactccctcgccgccgtcgtcgccggcctgcgggaccgcttcggcgcgcgcctctcgacggcggaagccctgcgggcgcagcatgcgagcacgctcacctgggcgccgagccagccgccggacgccgtggtcttcccgcacacgaccgaggaggtgcaggcggtcgtgcggctctgcgcggagcaccgtgtaccggtgattccgttcggcacaggctcctcgctggaggggcacgtcaacgcgccctacggcgggatcagcgtcgacctgtcgcgcatggaccggatcctcgcggtccatgcggaggatctcgactgcgtggtcgaggcggggctgacccgcaaggcgctgaacctgagccttcgcgaccagggcctgttcttcccgatcgatccgggggccgacgcctccttcggcggcatggcctcgacgcgggcgtccggtaccaacgcggtccgctacggcacgatgcgcgacgcggtgctcggcctcaccgccgtcctgccgagcggggagatcgtccgcaccggcagccgcgcccggaagtcggcggcgggctacgacctcacccgcctcctcgtcggcgccgagggcacgctcggcatcatcaccgagctgaccctgcgcctcagcggcatcccggaggcgatggccgcggggcactgctccttcccgagcgtgaaggcggcctgcgacgccaccatcctgacgatccagtccggcctgccggtcgcccgcatcgagctgctcgacgccgtgcaggtgcgggccagcaacgcctactcgaagctgagcctccccgagacgccgctgctgctggtcgagttccacggcaccgaggcctcggtgcgcgagcaggccgagcgcttcggcgagatcgcggccggggagggcggcggcgcgttccgttgggcgaccgaggccgaggcgcgcagccgcctctggcaggcgcgccacgacgcctactgggcggcgctcgcgttgcgccccggcgcgcgggcggtggcgaccgatgtctgcgtgccgatctcgcacctcgccgcgtgcgtcgccgagacccagcgcgacatcgccgagagcggactcctcgccccgatcgtcggccatgtcggcgacggaaatttccacgcccagcttctggtcgacccggaggacggcgacgaggtcgcccgcgccacagggttcatcgatcggctcgtcgaccgcgcgctcggcctggacggcacctgcaccggcgagcacggcgtcggccagaagaagatgcgtttccttgaggccgagcatggcgccgatgcgctctccgcgatgcgcgccctgaagcgtgctctcgacccgctcggcatcatgaatcccgggaagatgctgggcgcctga

SEQ ID NO: 8131 - DNA, 783 bp, Methylobacterium sp.
atgggccgccacgagaccttcgacatcaccactgccctgtcgaccacccttactcatctcggcggcattgatcagctcgggaagaaggatccgatctttgccgcgctggacgcctgccgggcgcctgaagccgagagggaggcgtttcacgccgtgcactctgtcggcacgactggtcccggctacacgctcgaacgcgagatagccctggacagtgcggtggaggcggctttcaacgccgtgttagccacgacgccgaccacgcaggacggccgcctcgccctgatcgcgttcatcgcgcgccgcatcgagtggagtgcgtgtccagacggatctccgcaggagggcgaggacactgttttcgctcaggcttaccatgcgctcgcccaagcaatccgggccgaacaggccgagccgatcggattgcccgacctgtctgcgctctcaatcaagcagcttcggaacctctatgatcggtacgtgcagatctccgatatctggaatgacgcgctgaacgccccgtggacgaaccatgccgaaggagccggctttcgggcatcgaacgcagctggcgacgtgatcgaggccgagcagacacgcgtttgcgccctctatgccggtgtggtggctgagatctcgcggcgcacgccttcggggaaggggttcgagccagactggcaactcgagacgctgatccgtcacgagctgatgtgcaacggcgacctgcgcgaggcgccagagctacgcgccaaaattattcggcagtggggagctgcggcatga

SEQ ID NO: 8132 - DNA, 504 bp, Methylobacterium sp.
atgtcgcgctggccagcatccacggccgatctcttcgatgcggaccttgccgcctggaccgaggcgcaggccagcgccctgcgcgaaggacgggtggacgccatcgacgcggcacacctgtcgcagatggtcgaggccctggtcgcggagcgcgcggccgagttgcaggcgcggctcggcgtgatcctgaccggcctcctgcgctgggccgagcaggtcgatctgcgggggcattcctgggcggccaccatcgacatccagcgattccaggtggacgacatcctccgggaaaacccgagcctgcgccggtcggtggcggaactgatcgccgcggcctatcccgaggcgaaggcgcgggccgtgctggagagcgctctcttcgaggaatcgttctcggaatcctgccccttcaccgacgacgaggttctgaccgtgggcttcctgcccgacccttacggcgacgacgcgatccgcggccccggctggtggaagcgctccccatga

SEQ ID NO: 8133 - DNA, 372 bp, Methylobacterium sp.
atgcccacgatccgtcccctctggcgcgcgctgctcacggtcttcctgaccgtgatgctcgtcggcgtctcggtggcgaacgccgggcacgggcatgccggccatgcgccgatcggcccggccgcctcggcacaccacgatggcgtgccggagcaggtcggcgacctgtcgaaccatgcggagcggaccggcgacgacggggccgcgggcccctgcggctgctgctgccatcaggcctcgatcgtgcgctgggattccccggccgttccggtctcgtggcggctcgcacggacgctcgtcggcatccgcgcgatcgcgttcgacagcgtggcgcccgagacccttcccgagcctcccagaaccttcgcctga

SEQ ID NO: 8134 - DNA, 273 bp, Methylobacterium sp.
atggcgatcaccttcgacccggccaagcgcgacagggccctggccgagcggggtctggatttccaggccgccgaggccgtgttcgccggctcggtctacgagttcgaggacacccgcgccgattacggcgagacccgcatgatcacggtcgggcttctggccggacgcatggtgatcgtcggctggaccccgcgtggcgcggatcgccacgtcttcacgatgaggaaggccaatgaccgcgaacaggcccgctacagcgatcttctccgctga

SEQ ID NO: 8135 - DNA, 138 bp, Methylobacterium sp.
atgggcaggcggtggatcgtggcggcggcgctcgcggctcttgtcgcggtggcgggctggcggctgcgcgatttcctcgcgcaggatgcctgtctcgacgcgggcggggcgtggaggggcggtatctgccagcactga

SEQ ID NO: 8136 - DNA, 375 bp, Methylobacterium sp.
gtgaggttcgtgatcgacatgaacctgtcgacggattgggcagcctacctgcaggggctcggccacgacgcggtgcactggtcgagcatcggcccgcaggataccgccgatgaggacatcgccgcctgggctcgtgcggaggaccgcacgatcctgaccaacgacctcgatttcgggacgctgctcgtgagcacgggcgccgcgaagccgagtgtcgtgcagcttcggacggacatcaccttgtccgcccatgtcggcccgctcgtcgcgcaggccatcgaccgtatggaagccggactcgtcgccggcgccctcgtcaccatcgagaccggccgcttgcggatccgctctctcgcacccgattcggaagactaa

SEQ ID NO: 8137 - DNA, 246 bp, Methylobacterium sp.
atgacgcgaagcttcaaggacttcccgaggatcacggtcgatcccgcggtgatgggcggcaagccctgcatccgcgggatgcgcgtgaccgtcggcatgatcctgggcaatctcggcagtgggatcagcgtcgaggagttgcttgcgggctatccgtacctcgaacgcgaggacgtcctggaagccatgcggtacgccgcggccctggcacgggtgcgcgaactcgagatcgagcccgccgcgtga

SEQ ID NO: 8138 - DNA, 282 bp, Methylobacterium sp.
gtgcccgacttcccggccagcctgctctgggtcgaccagcttcgctggtgcctcgcggtcatggacgccgacgatcccgacctcgggttcgctgccagtctgctgagccatgccgtcgacaagggcggcctgaccgagaagcagggcaagtacgcctcccgcatcgtccagcgcgtccaggcgctgtggctggccgaggccctggcctgccagcgccggccgtccgcgccggtcccgccgccgcccgccctctcggaaatggccacgaagggggaggcctga

SEQ ID NO: 8139 - DNA, 120 bp, Methylobacterium sp.
atgccgcgggtcgcctcctgcatcagcagcaggtcgggctgctcctgctcgatcagcgcgacgaggtcggccaccgcggcgccggtgcggcgcaggaggttccagctcacgatcttgtag

SEQ ID NO: 8140 - DNA, 156 bp, Methylobacterium sp.
ttggccacggtgaaatcgccgagatccagcacctgcgagacccggtggaacatcgcgccggacggcagcggcaccaccagcggcggccgggtccagggcttcggcgcccacatggcgagcccgtggatgcggtcgggcagctgtgcccaggcgtag

SEQ ID NO: 8141 - DNA, 84 bp, Methylobacterium sp.
atgagcaagttcttcgaggagcgggtggtatcggttcaccactggaccgacacgctgttctcgttccgcacgacgcgcgatccg

SEQ ID NO: 8142 - DNA, 126 bp, Methylobacterium sp.
gtggtccgccctgaggtaaggctttcgggccaggacgaggacggacggatgggaacgaagcggcacaagccggaggatgtggtcgccaagctgcggcaggcggacgtgttgatcgcgcagggctag

SEQ ID NO: 8143 - DNA, 333 bp, Methylobacterium sp.
gtgagcgtctgggatcgcgacgacctctgcgagatcgagcccggcgacgaccggctcgacgtgccgccggtcacaatgatcgaccggctgatccgctggcatgagaagcgtgccggcgccgacgggcgcctcgctctgagcctggaggcggaagggctgacgatcgcggccgacaccaaccgacagcgctccctcgcccatcgccagacagcgacctgcctcaaggtgctgcgccagcgctgctgcgagagcgagggcgccccgcagcaggccttccgcggtcacctcaagccgaagccccggccccgcgccgaggtccgcgcaccgccctga

SEQ ID NO: 8144 - DNA, 549 bp, Methylobacterium sp.
atgcggtggtacctgaaggcgatgcgtggctacgccgtgtttcgcgggcgctcgccccgcgccgagtttatcgaagtctggggtgcccttttcctgctcatcctcatcgcacaagggttggatagggagatcttcggtggagacggccagaggcacacgctgctgactcacctcgtcatcctcgcccacgtcgtaccggtgttggccgtgaccgcccgacgcttgcacgacatgaactggtcaggctggttcaccttgctgaacctcgtacccttcctcggcttcggtatgctgttgctggcttgcccgcgcggcacacccggaccgaaccgctatggcgcggatccaatcggagcggcaactggtaccgagccgccgcagcgcgcgactgagcaggcagtgccgcccgcaccccaggcacggtcagctgcacacgacctccttgtggagcttgagcggcttgccgggttgcgggcaagtggtgccttatcagacgccgagtttgaggtgctgaaggcgaaaaccctggcgcaggcgggtcgcgcatga

SEQ ID NO: 8145 - DNA, 1482 bp, Methylobacterium sp.
atgaggctccccgccgagcgggccacgcgccccgtcgatctcgcccgcgaccccgtcgtcccgctggtcctgcggctggccggcccggcgatcctcggcatctcggcgcacgcgctgcagatgctggccaacggctggttcgtggccgatctcggtgcggccgcgatcgcgacgatcggcatcgcctacccggtcacgctcctcgtggccgcgctcggctacggggccgggatcgcggcggcctccgtgctctcgcgggccctcgggcggggcgaccggcggctcgcggacgcggccgcgtcgctcggcttctggctcgccctgccgccggggctggcgctgacgggcctgatcctgctccatccaccgttctggctcgggctgctcggggccgatgcggacctcgccgcggcggccgcgccctacacggcgctggccagcctgggcacctgcctgatgctggcgatcgtcgtcggcggcttcgtggtgcgggcgcaggggctcgcgcgcctgagcggcgttgtgctggtcggcagcttcggcctcaacgtcgcgctcgacgggctgctgatccgcgtgctcgggctcggcaccgcgggggcgggctgggccgcaatcctggcacagggcgcgggggcgctggcctatctgtggcatttccggagggcgcggggggcggcgcggatccgcttccggccgccctggcggctcttcggcctatccgggcgcccggccggcccgctcctgcgggagatgctgtggctcgccgcgcccgcgacgctctccagcctgctggcggccgccgcgatggccctcttcgtccaggccggggcggcctacggcgccgccgcggtggcggggctcgggctggcgctccgcatcgtgctggtcgccgccctgccgctgctcgggctgatggcgggcgcccaggcggtgatcggcttcgcgcacggggcggcggaccggcccggccagcgcgcccgccgcgaccgcgcgctcggcttcgtggccgccgccgccctggcctacggcttctccgccgccgcgctgatggccctgttctcggagccgctcgcgggcctcttcgccgaggacccggcggcgcgggcggagggcgcgcgcgccacggcggccttcgcgctggccctcgcgccggtcggcttgcagctcaccgccgcgaccctgttccaggcggtcggcgcgccgcgccgagccgccgcggtctcgctcgcggcgcaggggctcgccctgatcccgccgctcctgatcctgccgcgcctctacggctacgacggcgtgctcgccagccggatcgtggccgagttcgccgcggacgcgctcggggcggccctcctcctcgcctggctgcgcggcgaggggcgccgcgccggtccggaggcaggcgccgacgcacgatccgtcgagggccgcgaggcaatggaggtgtccgcgccgcaccagcccgcacacgagggcgcgtga

SEQ ID NO: 8146 - DNA, 834 bp, Methylobacterium sp.
atggaggtgcgcgagaccctgctgttcttcttccggctgttcgaccgggaggtgatcgcgctcctcctcaccctgccgcgggtctacgccttcatggcggcctcggggctgctcgtctccaccgccgtgccgcgggtcgcccgggtggccgtggtgctggcgctgtcgatcctgccggccggcatcaacctcgcgcacgtggacgccttcgaccggcaggtgacgacctacgcggtctacctcgccaaggaggtcgcgatcggcttcctgctcggctacctcgtcggctggatcttctgggcggtgcaggcggcgggcgcgctcatcgacaaccagcgcggctcctcgatggcctcctcgatcgacccgctccagggccaggagacctcgacgctcggcatcgccttcagccaggtcttcctcacctacgtctacgtggccggcgcggtgctgccggtgatcggcctgctctaccgctccttcgcgatctggccggcgacgcgcgcgctgccgatcatctccgagcgcttccccgccctgatgctcggcgtgttcgaccacgcggtgcgctacgtgctgatcctggccgggccgatcgtcgccatcatgttcctggccgagttcgcgctcgccatggtcagccgcttcgcgccgcagatccaggtcttcgtcctggcgatgccgatcaagagcgcgctcgcgatgttcgtgctgatcttctatttctcgaccctgctgccgcacgccgcgagccagaccgtgctggtccagggctacctcgacgcgctctacacgctgctgcgcttcggtgccgccccgggagcggcgccgtga

SEQ ID NO: 8147 - DNA, 291 bp, Methylobacterium sp.
atgacccccgccgacgccgtccaccagatcaccgaggcgatgatgctggtcatgctgctctcgatgccgccgatcgtggtggcgtcggtcgtcggcatcgcggtgagcctgctccaggcgctcacccaggtgcaggagcagaccctgtccttcgcgatcaagctcgttgccgtggcggtgacgatcgccgcgatggcggggttcctcggcaacgagatgttcacctacacgctgaagctgttcgacaacttcccgaaatacacccacgtggcgaaggagccgcggcgatga

SEQ ID NO: 8148 - DNA, 642 bp, Methylobacterium sp.
gtggtcgatccgctcaacctcatcttcgtgctcggggccgccgccttcgtgccgttcctggccgtggtggcgacctcgttcatcaagctctcggtggtgttcctgctggtgcgcaacgcgctgggcgtgcagcagattccgccgaacatggcgctcaacgcgctcgccatcatcctcaccggctacatcatgacgccggtcatcgtgcagacctacgacatcctctcggccgggcagttcacctacacgagcgtcgaggggctgaaggccgcctacgaggcgggacgcgagccgctggcgggcttcctcaaccggcacgcggccgagcgcgagaagctgttcttcctcgaggccgcccgctcgctctggccgccggacctcgccgaccggctgggtgcggacagcatcgcggtggtgctgccggccttcacggtgagccagctgcgcgaggccttcgagatcggcttcctgctctacctgcccttcatcgccatcgacctcatcgtctcgaacatcctgctcgccatgggcatgatgatggtgagcccgctcaccatctcgctgcccttcaagctgttcctgttcgtgatggtggacggctggtcccggctgatcctcggcctcgtgaagacctatgtctga

SEQ ID NO: 8149 - DNA, 1386 bp, Methylobacterium sp.
gtgaaccgccccctccccccgcccgacggcgcggcggtcgcgcgcgagcgcgccgagcggatccgggcacgcctcggccgcgtcctgcccgaggtcgccacccgcgcggccgccttcgacccctacgcggtcaccggccgggtccggaaggtcgtcggcaccatcatccatgccagcgtgccggacgtgcaggtcggggagatcgtcgagctgatcacccggcagacggggctgcgcctcttcgccgagtgcgtcggcttcctcgacgaggaggcgctgctcgcgccgatcggcgagacgcagggtgtctcgccccgcaccgaggtgcgccgcaccggccgcgtccaggcggtggcggtggggccgggcctgctcggccgggtcgtcgacggcatgggcgccttcatcgacggcaaggacctgcccttcgagccggagacgcactaccccgtctaccaggacccgccggacccgatgcggcggcgcgtcatcgacaccccgctctcgctcggcgtgcgggcgctcgacggcatcctcacctgcggggagggccagcgcatgggcatcttcgcggcggcgggcggcggcaagtcgaccctgctgtcgatgctggtgaagggcgcggacgtcgacgtcaccgtgctggcgctgatcggcgagcgcgggcgcgaggtgcgcgagttcatcgagcacgatctcggccccgaggggatggcccgcgcgatcatcgtctgcgccacctcggaccgcagctcgatggagcgcgccaaggccgccttcgtggcgaccgccatcgccgagtattttcgcgatcagggccggcgcgtgctcttcctgatggattcggtgacgcgcttcgcccgcgcccagcgcgagatcgggctggcggccggcgagccgccgacccggcgcggctttcccccctccgtcttcgccaacctgccgaagctgatggagcgggtcggcatgaacgatcggggctcgatcaccgcgctctacaccgtgctcgtcgagggcgacgacatgaacgagcccgtggccgacgagacccgctcgatcctcgatgggcacatcgtgctctcgcgcaagctcgccgcggccaaccactacccggcgatcgatatcctggcctcgaagagccgcgtcatgggcgccgtcaccacgccggagcaccgggcgatggcgggccggctcaacgcgtggctcgcggcctacgcagatgtcgagctgctggtgaaagtcggcgagtacaagcgcggcaatgatcccgattccgacctcgccatcgccaagtacaagccgatcaacgccttcctgcagcagcgtacggacgagttcgacagcttcgagacaaccttgcagaagctgagggcgctgacccgatga

SEQ ID NO: 8150 - DNA, 825 bp, Methylobacterium sp.
atgcccgttcgacggacccatcaccgcccgagcctgatcggcctcgccctcggcctcgggttgctgctcgccggatgccaagcggagctctactcgaacctgagcgagatcgaggccaaccagatgctggccgtgctgatgtcgaacggcatcccggcccagaaggtcggcaaaggcaaggacgggttcacggtgagcgtggacgagcgcgacatgctacgctcgatcgcgctgctcagcgaccgcggcttcccgaagagcacccgcgagtcgatcggcaaggtgttccagaagtcgggcatcatgtcctcgcccttcgaggagcgcgtgcgctacatctacgcgctcggcgaggaggtggcgcagacgctcagccaggtcgacggcgtcgtcaccgcccgcgtccacatcgtcctgccggacacgccccagctcggccaggcggtgaagccctcctcggccgcggtcttcatcaaataccagcccggcgtcgatctcgatttcttcgtcccccagatccgccgcctcgtcagcagttcgatcgagggcctcgactacgccgccgtcacggtcgtgctctcggaggccgcgccgaccagagccgccatcacggtgccgcagagcgcgaccgtcgaggtgctgccgggtctcagcgtgcgcgacaccgacaccgcccgcttctggcagatcttctacggcgggctcgggctgatcggcctgctcctggcgggcctcggcgcgggcgccgtggtctggctgcgcaagcgcgccgggccgcgccgcgggtcggaggccctgccggtgccgctggtcgagccgtcgtga

SEQ ID NO: 8151 - DNA, 2127 bp, Methylobacterium sp.
atgatgaaatttctcaacgcgctctcgaagcgcaacgaccttctgctcgcatttctgctgatctgcatcgtcttcatgatgatcctgccgttgccgacggcgatcatcgacgtgctgatcgcgctgaacctctgcctcgcggcgatcctgctgatggcggccgtttacctgactgatgtcgtccagctctcttcttttccgtcgatcctcctcctcaccactctgttccgactggcattggcgatatcgacaacgcgcctgatcctgatccaggcggatgctggccacatcgtcgagaccttcggtcgcttcgtggtcggcggcaacctcgtcgtcggcctagtggtcttcctgatcctgacgatcgtgaatttcatggtcatcacgaagggctcggagcgcgtggccgaggtctcggcgcgattctcgctcgattcgatgcccggcaagcaaatgtcgatcgattccgacatgcgcgccggcatgatcgagctcgacgaggccaagcgccgccgcaacaagctcgagaaggagagccagctctacggcgccatggacggcgcgatgaagttcgtcaaaggcgacgctatcgcgggcctgatcatcattgccgtcaacatgatcggcggcatcgccatcggcacgatgcagcgaggcatgccgctgggcgaggcgctcgaccgctactccctgctcaccatcggcgacggcctcgtctcgcagatcccggcgctgttcgtgtcgatcaccgcgggcttcatcgtcacgcgcgtggcctccgaggacaatgccgacctcggcagcgacatttccagtcagctggtcgccgagccgaaggcgctgatgatcaccgcggtgatcctcacggtcttcgccttcgtgccgggttttcccaccacggtgttcctgattcttgcggctctgaccggcggtggcggctggctgatcgtgcggaggcgcggccgcggcgcggcggagacccgctctcttgagatgcctgcgctcgcgcctgcgctcgcgccccccggcaaggcgccctcgctgcccggcggcgaggccgacagcgcgcccgtcgaggcggtgagcttcgcgctcaccgtaccgctcatcgtcgacattgcggcctcggtgcgcaacgcgatccggccggataagctcgaccgcgaggtcgcgcgggtgcgccgcgccctctacttcgacctgggcgtgcccttccccggcatccacctgcggctcaacgagaacctgaaggagggcgagtaccgcatccttgtcaacgagatccccgtcgcggtcggcgcggcccggcccggctacgtcatcgtgcgcgagaccgaggcgaacctgcggatgttcgacatccccttcgagcgcggcgaggacttcctaccccacacgccgagctactgggtctccaccaagcacctgcccgtgctggagcgcgccggcatacaggtgatgacgctctcgaccatgctcaccttccaccttgcccacgtgctgaaagggcatgcggcggagttcatcggggtgcaggagaccatgtacctcatgaaccagatgcagaagaacttcgccgagctggtgcgcgaggtgacccggctcctgcccacgatcaccatcacggatgtgctgcagcgccttgtcggcgaggagatctcgatccgcgacatgcgcacggtgctggaggcgctggtcacctggggccagcgcgagaaggacccgatcgtgctggccgagcacgtccgctcggcgctctcacgctacatcacccataaattctcgggtgggcagggcatcattcccgcctatctgatctcgaaggagatcgaggataccgtccgcggcgccatccgccagaccagcggagcctcgtacctggcactctcgcccgacgtgcaccgtcagctcatcggcgcgatgcgtgccgctgtcggcgcgccggcacagagcgcggtaccaccggtgatcctcgtgccgatggatatccgccgcttcatgcgcaagatcgtggagcgcgacttcccaaacctcgcggtgctgtcctaccaagagctcaccgcaagcgcgaacgtccagccgctcgagcgggtgaagctcacggcacaactcaacaatgcggcctga

SEQ ID NO: 8152 - DNA, 264 bp, Methylobacterium sp.
atgcacgacaaccgcgccctgagccgcttcgagctgaccgagcaggggctgaccgcctacgcggattaccgccgcggtccgcaggggctcgtcatcgcccacgtctacgcccccccgcccctgcgcggcaccggcgcggccgaccggctgatgcgcgcggtggccgagcaggcacgggcggaaggggtgcggatcgtgccgctctgcggctatgccggggcctggctgcgccgcagccccgctcaccgggacctgatcgcctga

SEQ ID NO: 8153 - DNA, 960 bp, Methylobacterium sp.
gtgaagaccgttttctcgaccgggcacgtacacccgcgcgatcgatttgatttctggcacgacgttgctcggaaggatgtcgccgaccacacctccacgccgaagtgccggaacacgttccaggccgaactccgggccggctcggtcggctccatcgggcttgtcctgttccagaactcggacatgtcggtcacccacgcacgctgtcatatcgacctcacgaacaccgatgagctgttcgtctgccgacagttcggtgggcgcctcgccctcgatcaggacgggcgccaagtcgtgctggagccaggtcacatcacgttgctcgacccccggttgccgtatcagggacggttctcggaagattctcaggtgctcgttctgaagatcccgcggcagcacttggaagctcgcctcgggcagacgcgggaattgacggcgcgcgcgatcgagccgtccacgaccgagaacagtttgctgtcgcagagtctcgcgatgctgccagctcacacgcaggatcttggctcgaccgccgggattcttctcgagacgcacctgctcgatctgatcacgctctcggtcggcctggcgatgggaggggagaaagcccgcacgacgtcggcccgctcacttgtccgggtccggctccgggcggccgtcgaagcgcgcatggcggaccgaaatctcgatgccgccacggtcgcacgcgcagccggggtcagcgtgcgatacgccaatgaggtgctggccgaagacagcacatcgatcgtgcagctcatccaggcgaagcgtctcgctcgctgccgtcaggcgctcgaagacccatcgcagatggggcggagcgtgagcgagatcgcctatgggtggggatttgccgacatgacccatttcggccggcggttcaaagccgcctacggcgtgttgcccagcgagcatcgtcgtcgcgcgaggcacgacagctga

SEQ ID NO: 8154 - DNA, 954 bp, Methylobacterium sp.
atggcatcgacatcgcagacggccaccgcgccgcgcccgccctgccccatcaccggggagcccgcgcggcggctggtgcagtgggtcggctcgcgcttcctcacggatctctggcgctacgccggcggtgtcgatgtcggacacctgctgcggcccgccgggcgcttcggcctctgggaatcgcccaccggcctgatcttcttcgatcccatggtgcccggggacgaggccttctaccgcgcgttctacgcccgcatcggcgcccacgagaagctcgcggggccgcgcacgcagcggctggaattcgtcgccgcggcgcgccacgtgccggacggcgcccgcgtgctcgacgtgggctgcgggcatggcggcttccgcgcctacgtgccgggcgcgcgctacaccgggctcgatccgaacttcgccgcggaggatccgacgggcgcgatcctggccgagagcgtccaggcgcatgccgcgcgcgtcggtccggtctacgacgtggcctgcgccttccaggtgatcgagcacgtcgccgacccgctgggcttcgcgcgcgcgctggcggcctgcctgcggccgggcggcacgctcctgatcggcacgccgctctggccctcgcccaacaccacgatcccgaacttcatcatgaacgcgccgccccaccacctgacatggtggacgcccggggcgctggaggccctcgcccgccggctcggctgcgcgccggtcggggtcgagccgatcggcatggaccggcacgatgcgctgatccactggatggccaggacgacgcccgtccgctgccgcgggccctacttccgcccgcactggagctggtacggcgcgcaggcgctcagctacggcgcggccctcgtcctcgaccggctcctgcccctgcccgcccggacccggccgaacaccctgctgctcgcggcgcgcaagcccggctga

SEQ ID NO: 8155 - DNA, 873 bp, Methylobacterium sp.
atgacgacgcgcgccctgaaatccgccgcgctacccgaggccgagcgcttcgccgcgatccgccgtggcccgggcccgatcgctcgcgcggtcgacaccaccctcggccgcggcctgatccaggccgccgcggtggccgtgttcttcaccgcctgggagatcgcggtcgatgccggctggctcaccgagttcctggtcggtgcaccgtccggcatctggcgcgtcttccgcgcgagcctcatggacggcagcctcgcggtcgacacttggtacacgctgatcgaggccatcctcggcttcgtcatcggcaccctcctcggctcgctggcggggctcgggctctggtactcggtcctcgtcgcgcgagtggtcgagcccttcatcgtggcgatcaactcggtgcccaagatcgcgctcgcgccgatcgtgatcctgtggttcggcaccggcttcgtctcgaaggtggccctcgcggtctcgctcaccgcgctggtcgccttgatcgccgcctatcaggccgcgcgtgacgccgacccggacctgcaggctctgatggcctcgatgggcgccacgaagaaccggatcttccgctcggtcatcgtgccgtccacgctgccggcgatcatcgggatgttccggatcaatgtcggcttcgcgctggtcggcgcggtggtgggcgagttcatctcgtctcagcgcggcctcgggcacctgatctacaccgcctcgtccctctacgacctcaatacggtctgggtcgggctgttcgtgctgatgttcgtaggcttcgttctctaccacgtcatcgacctcgtcgagcgccgcatcctgccctggcgccaggtctcgaccgggggcggcatccaggtatga

SEQ ID NO: 8156 - DNA, 846 bp, Methylobacterium sp.
atggaccccatgccgacacccgacagccccgccgatccgaaggccgctcccgtgcagctcgcgctgcgcggcatccgcaagagcttcccggccaagtccggcccggtcccggtcctcgacggcctgagcttcgacatccacgagcgcgacttcgtcagcatcatcggcccgtcgggctgcggcaagaccacggtgttcaacgtcatcgcggggctgctcgaaccggatgtcggcacgatgctgttccgcgggcggcccgtgccgggcctgcgcggccgggtcggctacatgatgcagaaggatctgctgtttccctggcgcacggtgctccagaacgtaacgctcggcctggagatgaagggcacggacccgcgcgaggccgccgacaccgcccgtcgctacctcgcccagttcggtctcggcggcttcgaaaacgcctatccgaagaccctctcgggcggcatgcgccagcgcgcggcactgatccggacgctcatcctggatccggacatcctgctcctcgacgagccgttttcggcgctcgactaccagacccgcctctaccttgagggcgtgctgctcgacgcggtggagctcttcggcaagaccgtggtgctcgtcacgcacgacatcgacgaggcggtagccctgtcgaagcgcgtcgtggtgctcggcgggcggccctcgcgcgtgaagaacgtgcacacgatcgcgctcggcgaccgctcgccgatcggcgcgcgcagcgacccgcggttctcggaccacttccataccctctgcggcgaactggacatccagacccgcgcgggatccgcctccaccgcccgcgccgaggccgcctga

SEQ ID NO: 8157 - DNA, 963 bp, Methylobacterium sp.
atgaagccgctgcgctccaccctgctcgccgccctgctcgcctgcacgagcccgctccctgcgctcgccgccgacctgaaggccacggtctcgcaggccttccagtcgatgctctacctgccgctctacgtcgccatggacgagggcctgttcgagaaggccggcatcgacgtcacgaaggagacggcgggcgcgccgagcgtcgcgctctccgccgtgatctcgaagagcgcgcaattctcgatccacgggccggaatggaccgcggtggcggcctcgaagggcgcgcccgtcaacgtggtggccaatgtcgtcaacggagccgcggtctggatcgcgaccgcaccggacttcccctggaccgacgtgaagagcctgaagggccagaccatcgtcaccggcctgatgccgaccaccagcacctcgctcttcctgaagctcctgaaggagaacgggatgagcaaggacgacgtgacgctcacgcaggtcgcgctcggcaccgagccgggaccgttcctggccggccaagccagggtggcggtgatgtacgagcccggcctcgaccaggtcgtcgccaagggcatgaaggtggtgctgggcttccccgagaagtacggcccctacgccttctcggcggtgagcgcccgcaaggacgtcgaccctgccgtggcgcaggccttcgtcaacggcatgcaggcggcgatccggctgatgcacgccgagcccgcaaaagccgtggcggttgccaagaagcagttcccgaccctcgaccccgccgttgtcgaggcggcggtgaagcgcatgatgaccgagaaggtctatccggacagcgtggacatcacgaaggaggcgatggcgctcggcctggacacgcagatcgcactcggcaacctcgcggcccagcccgattacgccaccttcgtgcggcgcgacttcataacgaaggcgacggccggcaattga

SEQ ID NO: 8158 - DNA, 153 bp, Methylobacterium sp.
ttggatgcgcagcacgcgctcagcatcggcaacaccaagttccacgagctggtcaaggaagggaagctgaagctggtgaagatcggctcggctagctacgtgccagacgagagcctccgtgcctacgtcgcatcgctgatggaggccgcctga

SEQ ID NO: 8159 - DNA, 1422 bp, Methylobacterium sp.
atgcggccgggtctgcgtgtacctgcctcgtcgcgagaggcggagcccttcatcggcattcccggcggcactctgcccagcggcactctggagggtgatctcgtcgcctcgctgatgcaccggcacgagatcgccgccgagcgcctgatcggatggctgcgtgtggcgatcggagcttgcgtcttcgtgacggtcatcgtcacgggcgcggcgctgcgtcaccagaccggggtgcccttcgacgtgttcgagcgcaatgcttggatcgcctcgctcggcttcgtcgccatcggcgccatcagtatcgtcctcgccgtgccgcagcgctggtgccacgtcttcgcctacctgtttatggcactcgacgtcgggctcgtgctcgccatcgcctgtctggcggtcggggagcgcgcgctccccggcaacgccctgccgtccgcgcccatcgtctgggcggtgcccctcgttctggcggtcggcgccctgcgctacgacgtcaaggtgcagctctcggccatcgcgcttctggcgctcgggctcgtcggcatcgcggtgggattggaacatcggctggtcatggatgcggctggccggaacgcaccgatctggccgcagctgttctcgatgcctgtcaacgtcatgcgcttcaccctgctcttgctggccggtgccgcgacggcgctcggcatcgttcgctcgcgtcggcttctcgcgtccgcggtgaaggatgccgtagggcgggccagcctctcgcgctttcttcctgccgagatcgctccgcgtctcgctgccggcgacctcgacctccgccgcgggcgccgacagcgggccgtcatcgttttcgtcgacatccgcgactcgacgggtatggccgagggcatggatccggagcggctctctcaattcttcaccgcgttccgcacccgcatcctgacctgcgtgcgcagacacagcggcgtggtcgacaagttcatcggagacggtgcgctgatcctgttcggcgtgccggacgagggcagcgacgatgccgcacgcgctctcctcttcgcacgcgatctggccggaagggtcgagacctggaacaccacgcacgagctgccgcatcccgtgaggatcgggatcggcatccatgtgggcgaggtgttctgcggcatcatcggggatgaggagcgcctggagttcacggtgctgggcgatgccgtgaacgtcgcctcccggctcgaacaggcgaccaagcgctacggtgaggtcgttctggcctcgggcgctgtggtggagggctcgttcgagcgccacgcatggctcgagatcggccgggagccgctcgcgggacgcaaggaggcgatcacgatcttcgcgcccgcgcgcgctccgacacggcagatggccagcttcggggatctgagtgccgagccgggctaa

SEQ ID NO: 8160 - DNA, 915 bp, Methylobacterium sp.
atggagaccgcccccgacgacccccgccggcccgagaaccggctcgcctatcgcgccgcggtcgaccggccccggctcaccctgcccggggggcggcgcgtcgcgatgtggccggtggtgaacgtcgagcactggctgatcgacaatcccatgccgcgccagatcctcgtgccgccgacggcggcaggcctgttgccggacctgccgaactgggcatggcacgagtacgggatgcgagtcggcttctggcgcctccttggggccttcgccgcccgcggcctgcgcccgaccctgtcgatcaacggctcggtctgcaccgcctacccgcgggttgcggccgcggcgcgggacgccggctgggagttcatggctcacggcttccatcaggtccccgcacaccgggtcgccgacgagacggagatgatcgcccgctcggtcgggacgattgcagacttcgtgggcgccgccccgcgcggctggctcgggccgggtctgaccgagacgctcgacacgcccgaccacctgcgcgcagccgggctcgaatacgtcggcgacttcgtggtggacgaccggccttgccggatcgccacgcgcacggggccgctcgtggcgctgccctactcggtggagctgaacgacatccccctgctggccatccagcaccaccgcgccgacgagttcgtggagcgggcgctcgccaacctcgaccgtctgagcgcggaggccgcgggcgaggggccgctcggcggcgcgaaggtgatgggcttcgccatccacccctacatcaccggcgtcccccaccggatcggcctgctggagcggctcctcgacgcgctcctggcacggtccgacgtcgcgttcatgcaggggagcgagatcctcgactggtatctcggcaccggtgacgacgcctga

SEQ ID NO: 8161 - DNA, 561 bp, Methylobacterium sp.
atgccgagccatgcagagatcaacttcgcctatgcgcattgggccgagcgcctcgtgcacgaaggctggaccccgtacctgctgaccttcatgttcgagaacttacgcggtccgtctcacgaggtcgcgcgccagatggagcgcgaggtcgagcgagtgtacgctaccctgctgccgcggattgtccgaaatccgactcgacccgcgatgaccggccgattacccgtttggttctgcgcctccgatcggccggttttcaagcgggccaagcagagcctgcgcgatgtcatgatcaacgatggccgccacgttcatgcggttgcgttccttccgccttggtcccggctactagaagacttggcagcgcatgtcgaagcctatcgggcgctctacctccgaccggagttcccgctcgtgcggctcgacgttgttccaattacccagcgggccggttacggcgtcgagtacgctagaaagtatactgggcgaagccttatcggtgaggatgccggcttcgtgctaccccgcgccttgagcgaggttcgggatcaggcggcctga

SEQ ID NO: 8162 - DNA, 609 bp, Methylobacterium sp.
atggcacgcatccgcaccatcaaacccgagttcccgcaatccgagacgatcggcgcgctctcgcgcgatgcccggctgctgttcgtgcagctctggaccatcgtggatgatgccgggagggctcgcgcatcctcgcgagtgctcgcgagcgttctctaccccttcgatgacgatgcgatgcacctcatcgagggctggctgcaagagctcgaagatcagggctgcatccgccgctacaccgtcgagggcaaaccctacctcgatgttcctaagtggttggaacatcagaaaattgacagaccgagcaaatcgaaactgccggaattcgtggaggcctcgcgagggatcgcgagcaatcgcgaaggctcgatgctggaatataggtcaaagaccatggaccatggaactaggaccgtggaccagggaccaaggaccagggaacagaacctagccgcagggtccgagtacggagggggctctcacgcgtatgcacccgcacgcgaggcccgagacccgaccggcgacgacgcgttcggggaccctgatcccgcggcttgggacgaccccggtcagttcggtcgcgacaggtccacgggaggctcccgatga

SEQ ID NO: 8163 - DNA, 102 bp, Methylobacterium sp.
accaaccccggcaagatcccgctcgaactcatcgaggtgcaggtcggatcctataccggcgaggacgacatcatccgcgtcgaggacatctacggacgctga

SEQ ID NO: 8164 - DNA, 102 bp, Methylobacterium sp.
accaaccccggcaagatcccgctcgaacttatcgaggtgcaggtcggatcctacaccggcgaggacgacatcatccgcgtcgaggacatctacggacgctga

SEQ ID NO: 8165 - DNA, 411 bp, Methylobacterium sp.
ttgatcgtcgtcgacgccagcgtcgtcgtaaaatggttcgtcgcggagaaagactcctcggccgcgctggcaatcttccatcgcggtgacgcactgctggcgccgagccacgcgatcggtgagatcggggaagtgctgctgcgcgcctatcgccgcggtgtggtctccctggacgatgtccagcgggcgaacgacgtggtggcgacgcgtcttgtcctacggtccccctccggtctcgtcgaccgggccatcggtatcgcagtagacgcagccgtcagcttctacgatgccctctacgtcgcggcggcagatctatgggcgctcgaactggtcacggccgacgcgaagctcgttgagcgcctgaggccgacgcgttggggtcctcgcgtcacgctcctcgggacggattga

SEQ ID NO: 8166 - DNA, 1017 bp, Methylobacterium sp.
atgccgacgaccccgaagcctcgtgcgatcgggctcgccacggctttcctccttatccacgcgggagccgcctccgccgtggaactgccagaggccgttcgggcctggttcgccacggaccggtcgatcgtctgcgtcgatccggacggcaacgaccgccgttgcgccatcgatgccgacacgcatctcgaactccggcggtcgcccgacgcatcgacggcgctcgccttcgtgacctacctgccggatccgacaggcaattcgaccgtgaccacggccgcaaccttccgggcgggcgagacggggtggcggcatgtccggaccctctcggaggtccggggccccctcgcgggcaaggtcacgttcggcgatcggaccgcgaccttcgcggtcgccgtgccgcgacggggtgatagccactgctgcccaacgggccgcaaggcctaccgcgtcgctctccctcgcgagacgcctgcggtggtcggtgggaagaccgacgcctcgccctcgcgacaggccgcgctggatccggctcgggtcatcgcggaacagatgcggctggagaagcgcggcgacatgacgggcctgttctccaagagcttgaaggccgcctacgacgccgtgccgaaggatgagcccaacgtgggcctgacgattctcggcggtgggtacgacgtgccccgcaaggtcttggggacttccgccccgcaatacgacgtggccgacccgaagagggcgtccgtgacggcaacgctgcactacaccaacgaggacgcgccggagccgtcgttcgaccgcagcatcgtggtggtcttcatcgcggaggacggccgctggaggatcgacgatgtccatctgatcgatccgaaagggcgccggacgggtcgcgaggtcgggatgaagcgcgcctttgggcgtctgacggaggaacgcgcgcgcaccatggtcgagcgccatgcccccgcgccccgtgcgggccgcaacgaaatgccggacaatcgccggagcgtaccatga

SEQ ID NO: 8167 - DNA, 360 bp, Methylobacterium sp.
atgaccactgcccaccagatcgcctcagggttcgaccgggctggcctttccctggccggtgtcgcggccggttgcctcgccgacgcccgcgctcgtcaggtcgccgtcgatgaggagcaggcctaccgaaacctgagcgccgcccagcgcaccgtccgggccgccgtccgccagcgtgcagagctccaggccgccgtcgacgagaacgcggccctccgcgccgaggtcgcccgactgcagcgcgcgctcgccgcgtcgcagtcccagaccgccaccgctcaggccgagacgggccgcatgcgccagcgcgccctccacgccgaaggggtcctcctgcggcaggcccgcaccatggcatga

SEQ ID NO: 8168 - DNA, 465 bp, Methylobacterium sp.
atggccacgatggacacgaccctcgacatccgcggccgcctctccgcgatccgcgcgggatggtacgccggcgccccggccgtctccccgcacgggcgccgcatgtactcgggcggcctcgtctaccacatgaccgctcaccaagagatgcggcagccgccgccatcccacgaggcgggacaggcgtacctgcgggccctgctccgggactggaggaccgcccatgccccgctcgcggagtgggacgcggccaacggtggagccctgcgcaggtgcctcgtggccgccggcgtcgccctgcgggaccagacggacgacgggcgcgagcgcgccgatttcctcgtcaggcaggcctgcctgtgcctgagcaccaccacgctcgcgaagctcgacgccaagatcgcgaagctggccaaggttcccgtcgggccgtggcgcatcggcggcgggctcgcgaaggtctga

SEQ ID NO: 8169 - DNA, 381 bp, Methylobacterium sp.
atgccaccgcgggtcgcggcgcgaccccggccagaggagtggaccgatgacgaactgctgaccctgcccgaggccgcggcgctgttctggccggacggcccgatcaccacgaacaccctgcggacggccggtcgtgacggcaccctggcgatcacgaaggtggcggggaagttcttcacgacgccgatggccatccgacggatgggccacgatgagaccggggagccgctcggtcgagaggcggcggtaccggaggcaagttcgccccgaaccctgttcgaggcgaggctcgaagaggcgagaaggcaaggccgcgaccgaaagcgtcggcagagggcggccaagagatccgtcgcgccccaggagggggcaggacggtaa

SEQ ID NO: 8170 - DNA, 432 bp, Methylobacterium sp.
atgggaagccggaccggaagccgcgtcaccgagaccccgcccgccccagccgccgaggcgcaggcccatttctcccgccgcctcgcgctggagaccgactgcgacgacgtccacgccgccctcgaagggggcgcgcccgacttcgtcctcctcgacgcgcgcggcccggccgccttcgcgcggggccatgttccgggcgcgctgaacctgccgcaccgggagatcacgcccgagcgcatggcggcctgggcgcccggcacgctgttcgtggtctactgcgccggcccgcactgcaacggagccgacaaggcggccctgcggctcgcccgctgcggacgcccggtgaagctgatgatcggcggcgtcaccggctggctgcacgagggcttcgccctcgccgagggcctcgctctcgcgagcgggctcgcctga

SEQ ID NO: 8171 - DNA, 591 bp, Methylobacterium sp.
ttgttcgcgaaccgcttcaccgccctgatcgatgcctgtactttggcgggtacgttgaagcggaacttgatcctcagcctcgcggaagctgagtttttcaggctgcgctggtcgggaacgatcctcgacgaaacgcagcgcgcaatcgcgggcatcctggcggcgaagggcgaggcggcggctgccgaccacgccgcaagagcgcgaggcgtgatggaggcggcgttcgaagaagctatgatcgtgggcttcgagccgttcttccccatgtgcccggcgttgcctgatcccgacgacgctcatgttgtggcggcggcgttgaagacgcgcgccgagatcatcgtcacagagaacctaaaggatttcccggcggatctgctcgaaccgctcggccttgacgtacggtccagtgacgatttcatcgcggatgcgatcgcgctcgatcccgggaaggctgtggctgcgattcggcgaatgcgtgagcgtctgaagaggccggcgaagacccccgacgtgctgctacgtgatatggaggctgccggtcttacagagacagtcaatgtacttcgtccgtacatcgactcgctgtag

SEQ ID NO: 8172 - DNA, 486 bp, Methylobacterium sp.
ttgagcgtcgcgaggaggaggttcgcactcatgaccatgccagcttccgccattgggatcgggggccgcttaccgtccgcccaggaacgggaagcagccaatcagcttcgtcagatcctggccgcgcaggctgccggcgaggcgaagctgagtgtgcttgagggcggcaagaagcctaccgaaatcaccctaacgcccggcctgtcagacctgctgatggagttgctgcgccacgttggcagcggcgatgccgtcacgctcgtgccggtcaaccagatgctgaccacgcagcaggcggcagacatcctcaatgtgtcgcggccgttctttgtgggccttctggagcggggtgagatcgcccataccctggtcggacggcaccgccgtatcagagctgaagacttgttcgcctataaaaacgctcgggccgccaagcggagcgaggccttatccgctctggccgaactcgacgcggaggctttttaa

SEQ ID NO: 8173 - DNA, 1131 bp, Methylobacterium sp.
atggatcacacccgtcacatccccgatcccacctccgatcgagaccggcccctcgaccctgcgaccgttgcctcgctcctcgcctgcatgcgcgacggtctcgtgcgtcggcgttttcgcctgcgcctcgtaggagcgcaggctccggaggacgtcagcgagatcacggatcgacgcgatgttgcgatcgccgatgtcggccggccactccaggacgacacggcgccggcacgttccgaggaggcgcgccgctgtgcggcccgggagaacctgaacgcccggatgcgcccgatcctcctcgcgctcgcgcagaatgccgcccttgaccccgctgtctggagggcgcgcatcgacgctccgatgccgctgaccgatcccgagatcgtacgcgctctgtccgaagtgttcgcgtccgacgccttccgcgacgcccgcgcggcctgccgggacctcaccttgctgccgccggagcagcgggccttcgccgaggcgccgttcgatctcggctttcacagaagcccgccggcgaagatcctcgccgattatccgtgctgggacctcccgttctcgcccgcggcccgagccccggagcgctggaccatctcggatgccgccgactggatgcgggaatggccgcccgagtccggcgagttgaagcatccgatcgatgcatgggacgcgtccacggccgacctctggctgcgccgacacaagctcttcgatggtcaggaggcggacaagacggacccgctcgtcgcatttcgtgaagggcggtcgcggaagagcccgctcacggttctggccgggctcgacgacgacgcgctgctcgtcctcaccgacgcggtgttgtgcgagcgcctgcgccgcgaggtgatgtccgggctgatgcaggatcgcgccgacctcatccatgtcgggatggatatggtggcgtgcggctatctgagcctggatgatgtgcgggcggcagtcgctgcgcatgacgaggcgcgggaggagacattccgagatgcctttgccgataacgacgactggatgggcgagtggatcgttgattggagcaggaggctgatcggtctctacgactggccgctgcgctacgagttccgtgccgtgtccaagggtgagtga

SEQ ID NO: 8174 - DNA, 441 bp, Methylobacterium sp.
atgagcgatcaggcctttgcgctcttcgttcttgccctggtgccgctgggctgggccttctacctgctgccggccatcgtggctttcaggcgccagcaccccaaccgctggctgatcttggcggtgaatgtgatgcttggcgctaccggcatcggctgggcggtagcgctggtctgggcctttcaggcagcacaccgcgctggcgagcccggcggctcgcatggcggcgaatcaggcctgaacctcttcgtgaacgacatcaggaccgtgcgggtattgcacgcagctgacacgcccgttgtcgctccagcgtcaggagccacgcttggcacacctgcgcagaggatcgagcgcctcaatcagttacgggcggccgggcatgtgacggaggccgagttcaccacgctcaaggctgcggtgatccaccatccgaacatatga

SEQ ID NO: 8175 - DNA, 1146 bp, Methylobacterium sp.
atggatgtcggattcatctccgaattcaccgagaacgatcgtgtgttccgcttcaccgacggcgagacgctgcgcagtcccatcgcggtcggcgggtccgacccgctccggcagagcttctgccactacgtggcggccggcctgatgcccgggctgctgcacgatgcccgcgaggatccggtcgcccgcggcctgccggccaccgacgcgctcccggtgggggcgcatctgagcgtcccgctccgctacgccgacggcaccgcctacgggaccctgtgctgcttcagcttcacgcccgaccgcacgctcaccgggcgggacctgaacgtgctgcggctctgcgccgacgtcgtctcggccgtgctccagaaggaccgccgcgccagcctcgacctggaggcgcggcgcgcccgcatcgccggcatcctggaggcgcgggccatcgacatcgtctaccagcccgtctaccgcacgagcgacgggcgcctgatgtcgttcgaggcgctgtcgcgcttccgcgcggcgccggagcgcgccccggacgtctggttcgcggaggccgccgaggtcgggctgctggaggaactggagttcctggcggtcggcctggccctgcgggggctggagcggctcgacccgtcgatcaagatcaccctcaacctctcgccgtcgagcgtgctgagcccggccttcgcccgcgccttcgcgggggtgccgctcggccggatcgtggtcgaactgacggagcacgccgaggtgccctgctacgcggccctgcgcgcggccctggcgcccctgcgggccggcggcctccggctcgccatcgacgatgtcggggccggccacgccaccttccggcacgtgctcgacctctcgccggaactgatcaagctcgaccgcagcctcatcgccgggatcgaccgggattccgcccgccgcgcgctcgccgacgctctgacgatctacggccggcgcatcggcgcggaggtggtggccgagggcgtcgagacctgggccgagtacgcggtgctgaaggagatcggcgtcacccgcctgcagggctacctgctgggcaggccccagccgctcgacgcggcccgcaccctgcccctgaccctggcggcgctgggcgaggccggcggctga

SEQ ID NO: 8176 - DNA, 960 bp, Methylobacterium sp.
cccctgccgccccccgacccgccggctctcgtccgggcggccgccgcgccctgcgacgccgcgacccgcgcgcggatcctcgccccggcggcaccgggcgcggagagcgtggcgctcacctgcagcctgcggctcggccccgagacccacgtgacgaagcggatcgtgctggagggcgcggcggcctcagggatcaccctcgactgcgcgggcgcgacgctcggccaagccgagccgccgcccgcccccgacgccttcgcgctggcgatccgctcgcgcccgctgcccggcggcggcttcgagcgcccgtcgggcattacggtgcgcgattgccggatcctcggccatgtccggatctggggcatgggggtgaacgggcagggcgcggcggtccgcgactcctcgcgcgcgcccggccacacggagcgggcgcaggcggcggccccgaccgaggtcgcgatcctcggcacgacgatcacggcactggggcacatcccgctctatctcggacccggcgtgacccgggtgacgctgcagggctcgcggctcgacggccgctcgcgctcgaccgcgctctacctggacgcggagagcgccgagaaccggatcgtggacaacgacatcgcgaccgagacggggcgcgagctcgtggcggtcgacggctcggcgcgcaaccgcatcaccggcaaccgcttcgcgctgcgggggcaggggggcgtgcggctctaccggaactgcggggagggcggcacggtgcgccaccagacgccctccgacaacgcggtgacgggcaacgtcttccaggggcgcggcctgttcgggtcggctccgatcgtggtcaattcccgcggcggctggcggctctactgcggcgaggatcgcggctaccccttcggcagcagcgcggacgacggcgacaacggcaccgggaacgtggtcgagccgaaccgggtcgagtag

SEQ ID NO: 8177 - DNA, 930 bp, Methylobacterium sp.
atgagcgtgtccgtcatcatgtccacgttcaaccgggagcgctacatcgccgccgcggtcgagagcgtcctggagcagtcccatcgcgcgttcgaactgatcgtcgtcgacgacgcctcgacggacggtacgccggacatcctcgcgcgtctcgccgcgcgcgacgatcggctgcgggtcgtgtgcaacgcggccaaccagggcctgccggccggccggaacctgtgcctgtccctggcgcgccacgacctcgtcgcctgcatggacgacgacgatctcatgctgaccgaccggctggcgcggcaggtggccttcctgcgcgaccatcccgaggtcagcgtcgtgaccgccgcagccaggctgatcgacgatgccgacaacgtcatcggcctgagcgtgccggagatcgacatcgcgcgcggccgggcggaggtccggccggccctgttcctgggcctgatccatccggccgtgatgtacaggaagggggatgtcctgcgggtcgggggataccggcaggtggcgctggaggaccgggatctttggggccggatggtcacggccggctacaccgtcgcggcgcagccggacgtcctgctgctgcatcgccggcacgccagcatcatgcagggcgacctcgacgccctgttcgagcagggcgagtacatcgacttcaacgtcgcccgccgcctgcgcggcctggaggacgtcacgctcgcgggctaccggcgcgcggtggcggccgagcccctgctgcagcggatctcacggcgtcgacggatgtcggccggcatcgccttccggaaggcgaccctgttctacagccggcgggagtggcggccgttcctgatgcacatggcggcggcgatgtccctcgaaccgatccaagtctgccagcgcatcgcgaagaaatacagccccgggcgctga

SEQ ID NO: 8178 - DNA, 231 bp, Methylobacterium sp.
atgccccacatcgtcgtcaagctctatgccggcaagtccgaggcgcagaaggccgagatcgccgaggcgctgacccaggccctgatggcgagcgccggctgctccgagaaggccgtctcggtcgcgatcgaggatgtcgcgccgggggactgggcggagcgcgtctaccggccggagatcgccgcccgggtggacagtctgtaccggaagccgggctacgacccgctctga

SEQ ID NO: 8179 - DNA, 1275 bp, Methylobacterium sp.
atggtcccctcctccctctcggcccgccagcgcctcctcgtggcgctcggcgtcctcgtctcgctgctggcctggctcagcgtccggccctgggacctccggggctggacgatcggcgccccgttcgggcgggacttcgtgaacttctggatggcgccgcgcctgttcctcgccggagagggcgccgtcgtcgcggacatcgcggcctatcgcgacgcggtcatggccgccttcgcgcttccgcgcgacccgcggctgctcttcgtctacccgccgcacgcgctgcttttcctgacacccttcgcggccgtgcccttcctgcccgggctcctcgcctggacggccctgaacctcgccgcgctcgcggccgccacgcggctctggctcggcccggcggcgcgacccggcctcgtcctggtggtctgcacggcgccgccggtcggcgcgatggtgctctgcggccatttcggcggcctcatcgcgctggcggggacgctcgccgtgctggagagccggcgccgcccctggatcgccgggctctgcctcgccgccctttcgatcaagccgcagctggcgctggcgctcgggctgatcctcatcgccgcgggccgctggcgctggatgccggccgcgctgctcggcaccgccaccctggcggcgctctcggccgcgctcttcggcgtggaggcctgggcgcgcttcgtcggcacgacgatgccgacccacagcgccttcatcaccaccttccaggcgggctggatcgcgcacgccgtcacgccctatttcggcgcgcgcttcctgggcatgccggcggccctggcctgggcgatccagggggcggtgaccgcgctggccttcgcggcggcggtactcgtcctgcgccgggcggacccggatcgcggtccggaccacacgccacctctcgatccggcggcgctcctcgtcgtgctgctggcgcccgtggtgatgcagccctacgcaagccactacgaactcgccgccgtcgcgccgggcctgacgctcgtggcgctcggccgcccggccgcgccgctcgcggccgccgtctggctcctgatccccctcgccctcgtgctgatcaccctcgaccagccgatcctctgcgcgctggttccgggtgccctgttcgccaccgcgtggcgcctgctcgcgcccggatcggcgccgtccggcgcgtcagcccgccccccggcggctcccggcacagcgctcgttaacccttcggggggatactcgggcgcgttcgggcggacctga

SEQ ID NO: 8180 - DNA, 9240 bp, Methylobacterium sp.
atggccaggcaaacattcgacgactcgatcggtgcttcgggtaacccgctgaccatcggcggctatgtttacgcgctccgcaccaatgcaggcgccaccacgggtacgctgaacgtgcagcgcgaattgctcggcgacgccgtgctcgacctgaacgcgaccagcggctacctgtcgatcgcgcaggcctccggcaccgccttcaatctcaacagtctcgtgatcgaccgggacatctccgttctcggcaacaccttcttcgtcggataccggaacggtctcccggtcatctcgcaggaggtcggaaacctcctcagcatcggtgaccaggcgatctccttcggcacccagtggcagaacctcaccgaggttcggctcttcgcgcgggacgtcctcgacgtgaatgtcggcgtcggcttcgcgatcgacgacgtggtgaccaccgacgtcacggccccgctcgcgccgaccctgagcgcaggcacgaccgccaccgccgacaacacgccgacgctgaccggcaccgccgagatcggcgcaacggtgacgatcttcaacggcaccacggcactcggtaccacgacggcgggcgcgaacggcgcctacagcttcacgccgaccctgccgctcgccgacggcagctacagcctgacggcgcgggcgacggacctcagcggcaatgtcggtctcgcctcggcagcggtcgccctgcggatcgacgcgacggcgccgggcgcgccggtcttcacggccggcggcggcctgaccaacgacaccacgccgaccgtgacgggacgggccgaggccggctccgccgtcacgatctacaacggcaccgtggcgctcggcacgacgaccgcggcggccgacggaacgttcagctccacccccaccgccgcgctcggccagggcagctacggcctgacggcgaccgcccgggacgccctcggcaacgtcagcccggcctcggccgcgctcgccgtgaccatcgacgcggtggcccccggggcgccgaccgccgcggtcccgggcctcacgaacgatgccaccccgatcgtcaccggcaccgccgaggccggcagcaccgtgacgctgttcaacggtaccacggcgctcggcaccgcggtcgcggcggccgatggcacctacagcgtcacgccgagcgcagacctcgccgccggcacctacagcctcagcgtcaccgccaccgacccggcgggcaatgtgagcgcgcgctcggccgccgccacgacggtgatcgacctcacggccccgctcgcgccgacgctgagcgcgggctcggccgccaccgccgacagcacgccgacgctgaccggcacggccgaggccggcgccaccgtgacgatcttcaacggcgccgcggtgctcggcaccgcgacggcgggcgcgaacggcgcctacagcttcacgccgaccctgccgctcgccgacggcagctacagcctgaccgccgtcgcgcgggacgcggccgggaatctcggcacggcctcggcgccggtcgccctcgccatcgacaccgcggcccccgcggtgccgctcttcacggcgggcggcggcttgaccggcgatccgacgccgacactgaccggcaccgcggagcccggcgccaccgtgacgatcctcaacggcacggcggttctcggcaccgctctcgctggcgcggacggcaccttcagcttcacgcccaccgacgcgctgagccagggcagctacacgctcaccgcgatcgcccgcgacgcgctgggcaacgcctccccggcctcggccaacctcgccctgaccgtcgacctcacggcccccggggcccccgtcctcgcgcctctcggagcgaccaacgacccgacgccgaccatcaccggtacggccgaggccggggccaccgtgacgatcctcgacggcaccgcgatcctcggaaccgccgtcgcgggggcgaacggcgccttcagcttcacgcccgacgcggacctgacgcccggcacgctgaacctgaccgcgacggcacgggatccggccggcaacgtctcggtcccctcggccgcgctggcgctgaccctcgacctcaccgccccgggagcgccggtcctcgcgccgctcggaccgacgaacgatccgacgccgaccatctccggcacggccgaggccggggccacggtcacgatcctcaacggcaccgcgatcctcgggaccgccgtcgccggcatggacggcgccttcagcgtcacgcccgacgcggcccttacggccggcacgctgaacctgaccgcgacggcgcgggacccggccggcaacgtctcgctgccctcggccgcgctcgcgttgacgatcgatacgcaagcacccgccgctccggtcctcgcggccctcggcccgaccaacgacctgacgccgaccatcaccggtacggcggagcccggagccacggtcacgatcctgaacggcgcgacggtgctgggcaccgcgatcgcgggcctggacggtgccttcagcttcacggcgccggccctgccggcgggcaccgccaccctcacggcgaccgcgctcgacgcggccggcaacatctcagacccttccaccctcacgttcacgatcgacacgacagcaccggacgtgccggtcatcacgacactgcccggcacggtcgccgacagcacgcccaccatcgccggcacggccgaggccggcgcggtcgtcacgctcctgaacggcacggcggtgctcggctccgcggtcgccgacgcgaacggcgccttcgcgatcacgcccgctgtgccgctaccggacggccccctcgcgctgaccgcgacggcgcgcgacgcagccggcaacctgtcgccggcctcgctcggtctggcgctcaccatcgacacgagcgtgcccggcgcgccggacctcgcctacgattcgccgacgaacgacgcgaggcccgtcatctccggaacggcggaggccggtgccacgatcaccatcgcggccgggggcaccacgttcggcaccggtacggccgacgcgaacggcaccttcagcgtcccgctcgaccggccgctgagcgagggaaacaatgccctcacggtgacggcgacgagccccggcggcatcacctcgccggccgcgccgctcaacgtgctgctcgatacgctggcgccgcccgcgcccgagatcaccggcgtcccgagcctgacgaacgacccggcgccgaccatcttcggcacggccgaggccggcaccacggtgacgatcctcaacggcatcgctgtcctcggcaccgcgacggcggacgcgaacggcgccttcgccttcacgccgacggcgccgctcgcggatggcaccgcgacgctgaccgcacgggcgggcgacgccgccggcaacctctcgccggcctccgaacccgtcagcatcagggtggacacggccgccccgcccacgccggagatcgaccccctccccgtgctcacgaacgacgcgacgccgaccgtcaccgggagggctgaggccggcagcacggtcacgctcctcagcgatggagcgatcgtcggaaccgcggtcgcggacggcggcggcctctacgcgatcacgccgaccatcgcgctcgccgacggcacggccagcctgacggtgagcgcgcgcgacgcggccggcaacgtctccggcagcacggatccggtcaccgtcgtgatcgacacgctcgcgccggccgctccgaccctggccgatctgcccgatgccgtcgcttccgcaacgcccgtcatcgccggcacggccgacccgaacgccgtcgtcacgatcgccaacggcggcacgttgctcggcatgacgacggcgggcgcggacggcaccttcatcttcaccccgacgagccctctgcccgacggcacggcgacgctgaccgccaccgtgcaggacgcggcgggcaacgtctcgccggcttccgacgccgtcacggtggtgatcgacacgaccgcgccggccgcgcccgtcatcacgacgcagcccggcaccacgaccgacaacaccccggtcatcgccggcaccgccgagcccggcaccagcgtcacggtgctggacgatggggccctgctcggcaccgtcacggcggacgggagcggcaactggtcgctgattcccggagcagcccttggggacggcccgaaccttatcaccgccaccgcggcggacacggtcggcaacatcagcccgctggcggccggcatcaccctgacggtcgataccggtgcgcccgcggccccggccttgaccagcgcgggcggcgccctcgccgacaacacgccgctgatcaccggcacggccgagcccggcgcgacggtcgcgatccgcgacggcgacacggtgatcggcacggtcgtggccgatgtcgacggtgccttcgcgttcacgccggacgcgccgctcggcgacggcagctacagcctgaccgccacggcgacggacgcggccggcctcaccagcacgccctcccagccgctcgagctgacgatcgacacggcggcgcccggcatcccgaccgtcacgggcggaggcggcgcaacgcagagcaccacgccggtcatcacgggcacgggcgaggccggcacaacggtgacgctgctcgacgggacgacgcctgtcgggaccgccacggtaggcacggacggcaccttcacggtcagcccggcgaacccgctcgcggagggtgtgtacgacctcgccgtgcaactcaccgacgcggccggcaatgtcggagcgccctcggcgccggtcgccgtcgtggtcgacacgcagatcgacgccccgcccgcgatcgcgttcacggtggcggcgaccgccgacggcacgatcaacgccgccgaggccgtggcgaccgccttcacggtggcggggctcgatgccggtaccgtggcgacggccaccttcagcgacggcagccgcaccgtgacagtcccggtcggcgccgacggcagctacgcggccaacctcaccggcctcaacggcaccgtgacgacgagccttcagctcgcggatgcggccgggaacgcgctgacgctcacggggccggccctcagcctcgacaccctggccccgaccggcacggcggtcgccgacacggcgggcggtccggaggtcgcgagcttcacctatcaggtgagcttccccgagaccgttgccaatgtcggcgccgacgacttcgtgctgaccggcagcggaggagccaccggaaccgtgacgaacgtgagcggctcagggagcagctacacggtcacggtggcggggattaccggcagcggtgccctgacgctggcgctcagcccggattccgacatcgcggatcttgccggcaatctcgccaccctggcaccggcggtccgggacgtgaccggcgtgccgccggtgcagcccgtgatcacgggctacgccgacgataccggcgtaccgagtgacgggatcacggcggatgccacgcccacgctcaccggcatcggcacgccgggcgcgaccgtgacgctcgccgccgcgaccgggaccggaacggtcacggccaccggcacggtctcggcggacgggacctggagcgtggccctgccgacgctcgcggacggcgcctacagcatcaccgcgagcctcgtgggtgccgacggcagcccgatcggcacctcagcgccgctcgccctgacgatcgacgccacggtggacacgggcgccgcggcggcgctcgccatcgacgcgacggccgacggcgtcatcaacggccaggaggcctccgccgtggccttcacggtgacgggcctcgacgcgggcaccagcggcacagtcaccttcgcggacggcgtgcgcaccgcgagcgtcgcggtgggcgccgacggcgcctacagtgtggatctcacgggcttcaacggcagcgtgacatcgacgctcgccctcggcgacgccgccggcaacacggccacggttcagggggacacgctctcccttgtcaccggccagcccggcacccctgtgatcgcgggcttcgccgacgataccggcacgccgggcgatgcgctcaccagcgacgccacgccgacgctctcgggcgcggccgatcccggcacgacgatccgcctcacggtgggtacgccggacgggccggtctcggtcgagacgcaggccggggcggacggcgcgtggtcggcgaccctgccggcgctgtccgacggcgcctacgcggcgaccgcggtggcgctcgacgccgccggcaatgccagcaccgtgagcctccccttcccgatcagcatcgacgcgaccgcgcccgctggcacggccgccgccgacctctcgggcggcattgccgctcagagcttcaccgtggcgctcgacttccccgaggcggtcgtcaacgtgagtccggaggacttcgtgctctccggcacgaacggcgcgagcggcaccgtcacggaggtcgtcggaaccggcggcagctacacggtgacggtggcgaacgtcaccggcaccggcactctgacgctgggcctcgcggcggacgccgacatcacggatgcggccggcaacctcgcgaacctcgctgcggcctctcggccggtcgcggtcagtccctccgccgcgccgccgacgatcacgggcttcagcgacgattcgggcacggtcggcgacggcatcaccaacgacgccgccccgacgctcaccggcaccggcatcccgggcggcaccgtcacggtccgctacgacggggcgccgggatcggcgccgctcaccggcgacgtcgatgcgcagggcaactggacgctctccgtgccgacgctcgccgacggtacctacgtcttctccgtcacgacgacgagcgcggacggtacgatcgccagcgccacggccgatgccctgaggctgacgatcgacaccgtggcggatgccctgccggcggtggcgctcacggtggacgggacggccgacggcgtgctcacgccgagcgaggccgcggccgcgcagttcaccctctccggcctcgatgccgggtcggcggccgtcgtcaacttcacggacggcacccgcaccgtcacggcgcaggccgcggcggacggggcctacacggccgacctctcgggcctgagcggcagcgtgacctccacggtcgccgtgacggacgcggccggcaacaccgcctcggccgccggcaacgctgtgctcgttggcaccggcacacccggcggcgggaccggcggtgacggcggaggaaacggcggcggcgtcacaccgcccggcggcggcgtcggtgagggcagcacgcccccggcgatcccggtgatcggtggaatccaggacgataccggcacgcccggcgacggaatcaccggcgacagcacgccgacggtggtcggtacgggaacgccgggctccaccgtgacggtctcctacaccgacgcctcgggcccgcagaccgccaccggcaccgtgggtcaggacggcacctggcaggtcgggctcccggcgctcgccgacggcagctacagcctcgtggcgaccgccggcaccgtcgccggcaccggctcggcgccctcgcagcccctgcagatcaccatcgacacctcggcgcccgccgccccggttctcgacggggtgtcagggaccgacgggagcggcccgatcggcgacgcgagcccgaccctcaccggcacggccgaggccggcagcacggtcgaggtccgcttcgacacgccggccgggccggccttcgtcaacggcgtcaccggaccggacggccgctggacggtcgatctcccgacgctcgccgacgggacctacaccgtcaccctcgacgcggtcgacgctgccgggaaccgtggcaccgcctccgccccggtcgcgatcgtggtcgacacgacgcccggtggcggaaccggtggcgatccgggcgacgggacgggcggcggcgtcgtgacgccgcccgtcggcgggatcggcgagggtgacggcaccccgccaggctcggcgcctgccctgacggcggatgcggaccgcacgctcacgcacgcgcccgccatttccggcaatctcttgcttaacgacacgggcagcggcctccatgtcacggccgtccggttcgccgacggcctgacggtgcaggtgccggacgagggcactgcccgggtgatcggagattacgggacgctgacggtcgccgccgacggcagctacagctatcaggcgatcggcgcgaacaacctgccgatcggcttcggttcgcgcgagcactttacctacacggcgaccgacgcggccggccggaccggcgagacgtccctcgacatccaactcgaggggcaggccccgcaggccagtgcgtccttcgatttcgccttcacgcaggcgaaggtcggtctcgcgggcgaggcactggtgctgctcggtcccgacgggatcgtgcgcgacatcagcgggatcgacacgctgcacttcacggacggcgagatccagaacaacgacggcaaccgcgtcgtcgacgacgtctactactatgcccggaacctagatgtctggcaggcccacgtcgacgccgacctgcactacgcagtcttcggctggcacgagggccgcgacccgaacgcctacttccagacgagccgctacctcgcggagaaccccgacgtcgcggcggcgggcgtcaacccgctggagcattacctgacctccggcgagcacgaaggccgcagcccgagcccggacttctcggcggaggcctatctccggagcaacccggacgtggcggagcagggtgccagcgcgctggcgcactacttcgagttcggtcgggcagagggccgctccgtcctcgcgggcgagagcgacggtccgaaccgggccatcggcagcttcgacgccggcttctacctcgcgcagaacccggacgtggcggcgaccgtgccggcaggcgtgacgccggagagctacgcgctgcagcactacctgaactacggtgcggcggagctgcgcgatccgaacgcgctgttcgacacggcctactaccttgcccagaacccggatgtggccgcggcgggcgccaacccgctcctccactatcaggagaccggctggcacgagggccgcaacccgagcgccgcgttcgacaccgacgcctatctggcgcgctaccccgacgtggcgcaggccagcatcgatccgctggcccactacatccagtacggcctgcacgagggccgtctggcgaccgcctga

SEQ ID NO: 8181 - DNA, 918 bp, Methylobacterium sp.
gtgcgcaaaatcatgcccttgaattgggaccacctgcaggtcttcctcgccgtcgcccgcaacggccagatgctcgaggccagccgccgactgggcctcaaccacgccaccgtggcgcgccgcatcgaggcgctggaggctgcgcttcgcacaaccttgtttcaccgcagaccgactggctcggcgctcacggatgccggagagcagttggtcccaaccgccgagcggatcgaggccgagatcctgacggccaccgcccgtatgcgggcgacagaggcggagccgagcgggaccgttcgcatcggggtgccggatgggctcggtaacctgttcctggcgcgcgagctcggccagttcgcgacgcggtacgccaatctcatgatcgaactcgttcctctaccccgctcgttctcgctctcgcgacgggaggccgacctcgcgatcgctctggatcaaccgacacacgggcgtctgatgctctccaagctcacggattacagcctcgggctctacgcggagcgcgcctatctcgatcgcgccggcccgctggttggcgagcacgacctagtgcatcacaccgccgtcatgggcgtggacgactacgcctacgcgtcggcgctcgactacacagcctttctgcagggccggacgcgcggcgtctttcgctgcgccgggacggtaggccaactcgaggccgtgcgggcgggcgcaggtgtcggtattctgcacgacttcgccgcgtccggctgcccagaactcgtccgggtgctcccagccatcgtgtttcggaggacctattggctactctcccaccccgacagccatgaggtccgccggattgccgcctgccgcgactttatcgtgcaacgggtccgcgaggagcgaaaacggtttcttcccagggatgatgaatcctga

SEQ ID NO: 8182 - DNA, 114 bp, Methylobacterium sp.
ttggccccgccctccggcaacccgatcctcagccccgagcggcgcctggacgaccaggaccagagcatccgcccgctgtcgctctccgagttcgtcgggcagagggcggcgcgc

SEQ ID NO: 8183 - DNA, 213 bp, Methylobacterium sp.
atgcgcgccgagacagccgccggctactgcgatgagccgagcgttgaggcgttcctggcgaaggtcgagcgcggcatctactcgcggccgcggcggcagcagggctgcatgccgaagtggcaccgggcaaagctggaccaggacattgcccggcggcacggcctcgcgatcgagggcatgctggtggcggaagacgtgtcggagctgatctga

SEQ ID NO: 8184 - DNA, 1239 bp, Methylobacterium sp.
atgagcattccctcggccaagggcggcaccgacacgtccgcagaccggctcccgttgccgcccgcgcgaccgcacctgatccgcgacgatgccgaggcgctcgcggtcgcccatgacgtcgccgcggtgttcgcggccggcgccggagagcgcgaccgcgagcgccgcctgccctgggacgagatcgaggcgttcacggcaagcggcctcggcggcatcaccgtaccgcgatcgcatggcggggcggacgtgtcccatgccacgcttgccgaaatcttcgcgatcctctccgccgccgacgcttcggcggggcagatcccgcagaaccagttcggcgtgctcgcgctcgtgcgcgcggccgctcgaccggaccagcaggcgcggatctacgccgacgtgctcgccggccaccggatcggcaatgcaggtccggcccgcaacggacgcgccatcacccaggtggagacgcgtctggcgccgggaccggagggcctgcgcctcagcggctcccgcttctactccaccggcgccctcttcgctcattggatcccgacccgggcggtcgatcccgcgggccgccccgtcctggtctgggtgcgccgggacgcgcccggcctgcgggtggtggacgaccggcagggcttcggccagcgcaccaccgcgagcggaacggtcgtcttcgaggatgcgccgatcgaggagaggctgaccctcgatctcgcgccgctcgccgagcgcccaggcctatccgggcccgtgtcccagctggtccaggcggccatcgatgccggcatcgcccgcagcgctgtcgccgccgccctggacgtcctgcgcacccgggcacggccctatccgtacacggccgagagcgtcgccgaggatccccatatcctcggcgaggtcgggcggctcgcggtcgacctgcacgctgccgaggaggtgctggcccgcgccggccgcgcgctcgaccgcatcgccgctgcgccggtgaccgccgagagctcggccgaggcctccgtcgccgtggccaagatcctcaccaccgagatcgccctggaggcctccgagcggatgctggaactcgcgggctcctcggcgacgcgcgaagggtacaatctcggccggttctggcgcgacgcgcgcgtccataccctgcacgatcccgtgcgctggaagtaccacctcgtcggcaactacgccctgaacggtgcgctgccggcccggcaccagtggaactga

SEQ ID NO: 8185 - DNA, 924 bp, Methylobacterium sp.
atgccctcggaggctgagctgacggatctcgtgctgggcgcccacggcttcctcgggcgccgcctcgtgcgacgtctcgaggccgacgggcgccgggtgatcgcaatcgggcgggacgccggcgatctcacggtgccggaggtcgcgcgggccgccctcggccgggcaccggtcgcgcggatcttccacttcgcgacgcgccagcgcaccggccccagccagtacgacatccaggcggagctgctcgcggtcaacgcgcggatgcacctgaacgtcttggaggcctggcgccagctgcagccgcaggcgaagctgatcacgccgggcagctcctgcatctaccccgaatcgcgcgcgccgctgacggaggcgagcttcggcctcgggccgctccatccctccgtcgcgggctacgcgctcgccaagcaggtcctggccacgggctgcgcggcctacgcgcgtcagtacgggctgcgctacctccactgcgtgctggcgaccacctacggtccgggcgatcacacggaggcggaccgcagccacttcgtgggcgcgctcctgcaccgggccgccggggagaagcggcggggcgcgacccgcttcacggtctggggcgatcccgccacggtgcgcgaggtgctccacgccgacgaccagatcgacgcgatcctccgcgcggacgcccagttcacggacacgatcctcaactgcgccgccgacacgcccgtgacggtcggcgcggtcgccgaggccgtgctccgggcgctcgactggcaggtcccgatcgagcgccccgccgaatccttccagggcacgccctacaagatgctcgattccggtcgcttcctggcggcgaccggctggcggcctcggatctccctcgatgacggactgcggcagctcgtccgggaggcgtacgcgtag

SEQ ID NO: 8186 - DNA, 963 bp, Methylobacterium sp.
atgacgggcctccctgacgcgcgggcgcttcccgaggcggtggtgctgttcggagcctcgggcttcgtcgggcgcaacctcgcggcgcggctcgccgggcgcgtgggccggctcgtcgccgtcaacgcgagcgggacgccggtccccggcgccgacacgacgctgccgatcgccgcgctcggcgccgtgcccgcgctgccgcgcgatacggtggcgatccacgtcgcggccccgcgctacgacgccgcccgcttcgccacggcgcaggcggacctgctcgcgggcaatgtcgacctcgccaaccggatctacggcttctgcgccgagcgcgggatcgccgaggtgcggatggcatcgagcgtcgcggtctacccggccgggcgcgacctcctcgacgacgcggtgccggtggatctgcacgcgccgccccacccgggcgaggccttctacgcgtggtcgaagcgctgggccgagatcgcggcgggcctgttccgcgagcgctacgggatcaacaccatcgcgttccggctgagcaacccctacggcccgcacgatgcgctggaggaggccgtggcacacgtgctgcccgccttcgtgatccgggcccttcggccgggcgaggtcttcaccatccggggcgacccgcgggtcgagcgcgacttcatccacgtggacgacgtggtgacggtgttcgagcgctcgctgcaccggcgcggcgagagcctgacggtgaacctctgcagcggcacgacgacctccctgcagacgctcgccgagacggtcctgcgtcttgccggcgtcgcgcgcccgatcgcggcagccgggcagaccggctcggcggtgctggcgcgccgctcgaccaacgcgctggtccggcaggccttcggcgacctgcgcttcacgagcctggaggacgggctgtccccgaccatcgactggtaccgccatgccctcggaggctga

SEQ ID NO: 8187 - DNA, 933 bp, Methylobacterium sp.
atgcgcattctggtgacgggcggggccggctatatcggctcgatcctcgtgccgatcctgctggcgcgcggcgattcggtgacggtgctcgacaccttccgggccggcggcacggagctcgccgcggcctgcgcctacgagggcttccgcccggtgcggggcgatgcgcgcgaccaccgcctgctcgacgagctggtgccccagcacgacgtgctgatcccgctcgccgccctcgtcggcgcgccgctctgccgggaggacgcggtcggcgccaccaccctcaaccgcgacgccgtgcgcgacctcgtcgcccgggccggcggcgaccagatcatcgtctaccccaccacgaattccggctacggcatcggcgagagcggcaagttctgcaccgaggagacgcccctgcggccgatctcgctctacggcgtcacgaagtgcgaggccgaggacgcggtgctcgccagcggccgcggcgtcaccctgcggctcgccacggtcttcggcatggccccgcgcatgcgcctcgacctcctcgtcaacgacttcacccaccgggcggtcaacgacggcgccctcgtggtcttcgaggggcatttcaagcgcaactacatccacatccgcgacgtcgcgaagggatttttgcacgcgatcgaccaattcgccgcgatgcggggccaggcctacaatctcggcctgtcgtcggcgaacctctcgaagctcgaactctgccagcggatcaaggcccacgtgccgcgcttcgtctacatcgaggcgccgatcggcgaggatccggacaagcgcgactacatcgtctcgaacgccaagctcgaggcgaccggctgggcgccggacatcgatctcgacagcggcatccgcgagctggtccgcggctacacgatgctgcgcaacgcccgcttcgccaacgtctga

SEQ ID NO: 8188 - DNA, 135 bp, Methylobacterium sp.
atggcaggtacgacgatgcctttcgtcgaaggcgctgcggcattggtcttaggcacgggcttcttcggcttcttcgtctcgcgattgccgcgcttcttttctgtcgccatggtctcgctcctgggaatgtcgtga

SEQ ID NO: 8189 - DNA, 198 bp, Methylobacterium sp.
atgtgcccggtgatgcagaaaatgatcacactgattgttcatatgtcgcagtttcctggccttctggagcggggacaactcatcgatcaacttacggatcttgaggctgagggcatcgcccaggatgcgccgtggcggacagttgaggcgatccgggcagcccggttgaagctacgcgtcgaaggcctgatggcctga

SEQ ID NO: 8190 - DNA, 363 bp, Methylobacterium sp.
atgcacgacaacgggatgtccgggacgatgcggggatggttcgcggctctggtacttctcgggtgcggggctctcccggcatcggccgcggagccgacggtccggatcgtcgggacggagctgcgcgcgcctccggactcccacgagccgcagagagccctggtctcgctgcacaatgccggcgtacctgcggccgggctcaccctggcctgcacattccaggacgagggcggccggccgctggacacggtggaagcgcctgtccgagacatggccgaaggcgcgagcgccgtcacggaggtgatctactacggctggccccgcgccagccgtgccgcctgccgcctcaccgggcgccggtga

SEQ ID NO: 8191 - DNA, 1230 bp, Methylobacterium sp.
atggagccggaccccgcggtctgcatcgtcggcggcggcccggccgggatgatggcggggcttctcctcgcccgcgcgggcctcgccgtcacggtgctggagaagcacgccgacttcctgcgcgacttccgcggggacacgatccacccctccaccctcgacctgatggatgaactcggcctcggcgaggccttccgggcgctgccgcaccggcgggtggagacgctggcgggcgtcatcggcgggcgcgccttccgcatcgccgatttccggcacctgcccgcgcgcaaccgcttcatcgcgctgatgccgcaatgggacttcctcgacttcctggcgcgggcgggcgcccgctatccgggcttccgcctgctcatgcggacggaggcgacggcgctcgtcgtggacggttcgcgcgtcaccggcgtgcgtgcccgcgggccggagggcgagcgcgcgatcagggccgacctcgttctctgcgccgatggccgccattcggccatgcgcgcggaggccgggctcgaaccggtcgtgttcggggcgccgatggacgtgctctggttcagtctctcgcgccggcccgacgaggatgcggtgacggcgggccatttcgggcgcgggcgcatcctggtcaccctcgaccggggcacgcactggcaatgcgcctacgtggtgccgaagggcggcgatgccgcgatccgggccggaggcctgccggccttccgcgcggcgatcggcgaactcgtgcccttcctggccgaccggaccggcgagatcgtctcctgggacgcggtgaaggtcctcaccgtcgcggtcgaccggctcgagcgctggtaccggccgggcctgctctgcatcggggacgcggcccacgccatgtcgccgctcgggggcgtgggcatcaacctcgcgatccaggacgccgtcgcggccgccaacctcctggccgggccgctgggggcgggcacgctcaccgcgttcgacctcgcccgcgtccaggcccgccggacgcgccccgtgcggctgacccagggcctgcagcggctgatccaggaccgggtgatcgcccgcgtgctcgacgcgtcaggcgcgctgacgccgccgctcgccctgcggctcctcgatgccgtgcccgcgctccagcgcctgcccgcccggatcgtcgggctgggcttccggccggagcacgtcgccgtgccggagcgcgctcaggcggccgcgccgtag

SEQ ID NO: 8192 - DNA, 240 bp, Methylobacterium sp.
atgacggttcagcccacggacacgcttccggccctgcaggcatccctggacggcctcgggaccgggcaggccctgcgcctgacgaacgcggattgcgaccgcctgttcggcgtcgacgacgcgctcctcggccgggtacggaacgtcgcgctgggccacggctgcatcgtggtctgggacgacgaaggtctgtccttctgccggcagcctcatgccaccggctgcaagcccctcggctag

SEQ ID NO: 8193 - DNA, 684 bp, Methylobacterium sp.
atgatcgtccatgtccgcaacgtgctcacccccgaggaggtcgcgctctgccgcgcccgcctggaggcgggcgcctgggtcgacgggcgcgtcaccgccggggcccaggcggcgcgcgccaagaacaacctgcagatcccggaggacgcccccgtcgcgcgcgagctcggcgacctgatcctgcgggccctcgggcgcagcccccagttcaacgcggccgccctgccactgcgggtgctgccgcccctgttcaaccgctacgacgtcggcatgggcttcggcgcccatgtcgacggggcgatccggatggtgccgggcgccggcatccgcatgcgggccgacgtctcgaccacgctcttcctcaccgatcccgccgattacgacggcggcgagctggtgatcgaggacacctacggcgcgcacgcggtgaagctgccggcgggcgacatgatcgtctacccggcgacctcgctgcaccgggtcgagccgatcacccggggttcgcgctggtcggcgttcttctggtcgcagtcgatggtgaagaacgacggcgaccgggcgctgctctacgacctcgaccgcggcatcacgggcgtgcgcgccggcctttcggacgacgacccggcggtgatcgcgctgaccgccagctaccacaacctgctgcggcgctgggcggagctgtga

SEQ ID NO: 8194 - DNA, 2268 bp, Methylobacterium sp.
ttgctgcgcgatgcgggcggcgcgggggcgctcggcctgagcctcgtgacggggctcggcagcttcctgccgatgggagcggtggcgcaggatctcggcgcggatgcggggccgggcatggccgtcaccctgggcgagctcagcgtggctggctggggcggctaccagcccaacacactgaacgccgatacgggcctgtcacggctgccgggccgggtgcaggacaccccccaggcgatcaccgtggtgccgggcgaggtcatccgccagcagcaggccacgacgctggagcaggccctgcgcaacgtgccgggcatcaccgtctcggcgggcgagggcaacggcggcctcaacggcgaccagttccgcatccgcggcttccaggccaagaacgacgtctatctcgacgggctgcgcgatttcggcgtctacgcccgcgacgccttcaacatcggggacgtcgtcgtcatcaaggggccctcgtccgagacgctcggcctcggcacggtggggggcgccgtcaacatcgtctcgaagaaggccctgctcaccgacttcacggcggtcgacgggctcggcggcagcggcccgaccgcccgcggctcgttcgacgtgaaccggcgcatcgacgacaccacggcgatccgcatcacgggcgtcgtccaccagcaggacatccaggaccgccgcggcgtgaagtcggaccgggcgggcgtggccgtctcgctcggcttcgggctgggcaccgacaccacctggcacctgaactacctctaccagcacagcgagcgcacgcccgattacggcgtgccgaccgccctgcgacccggcgaccgctacgcccggccgctcaccgagtacggcctcgaccgcgcgacgacctacgcgcgggccaccgaccgcgacatcgccgacgtgcatctggccacctcgctgatgaagtggacggtgacgccctggctgacggtgaccaacgacacccggctctcgttctacgaccgcagcttctcgaccactgcggcgacctgcacgaacgccgcgggcccgccggtcgccacctgcgcgcgggacttcttcgcgggcggcaacccgttcgtgacctacagcgcgggcggcggccagaccttcgatcaggacgcctggggggcgcagaacgtcaccacggcgctcgccaagttccacaccggcttcctgcgccacgaggtcgtgacgggcttcgacctgttctaccagaacgacgaccgcctgaactacgcggtgatcgggacccgcgccaaccagcgggtgcgcaaccccgaccagtccgccgccggctacgccctggtcaagaacccgctcaaccgccgcgtcggcgacggggccaatctcggctatttcttcagcgaccgggtctggctcaccgagcagttctcgctgctcggcggcgtgcgcgtcgaccgcttcgtgagcacctactcggccaccaacaccgcgaacggcctgttcagcccgaccgtcacggcggcctcgaccggtgtcagcccgaaggcctcggcgatctggcagccgacgccggagcagacctactacgtcacctacgcgcggggcttctcgccccagggccagtacgtggtgaactcgaccggcatcgagatcccgaacgccgctgcgctgaagccggaggagagcgacctctacgagatcggcggcaagatcggcttcctcgacggccgcctcggcgtcgccgctgccctgttccgggtcgacaagagcaacagcttcgacgtcgatccggtcacgggcggcctgatcctgggcgccctcgatgccggcgagaagcggcgcgtcgagggtttcgagatcaccgccaccgggcagatcacggagaactggagcctgctcgccggctacacccatctcgacggcacggtgcgctccggcgcgaatcgtggccgcgccgcgccctacgtgccggagaacgccttcacgctctggaccacctacgatctgagcccggtgatgcgcccgctctggggcctgcccggccggatcacggtcggcggcggggttaccctcgacgacggctacttcccggcgagcgacaacatcacccgcatccccggcaccttctcgctcgatgcgctggtctcgtacgagaccgacacctaccggctcgccgtcaacgcctacaacctgacggacgagctgaactacagcgccgccttctcgacccgcgccgtgccgacctccggccgcaccgtgctggtcagcgccggcctgcgcttctga

SEQ ID NO: 8195 - DNA, 252 bp, Methylobacterium sp.
atgagcgcacaccagatcgccagcgcgattgaggaagaggcgacggcgttctgccggtcccgcttcaccaacaccgaagcctatcttgaggcgaaggacgcgcactgccggcgcgtgtccgcgctcgttggtcagctccggcgcgcgatcggtaccaccgaacggctgacgttgcgcactggtcggcgccagtccgggcggcacaccttcgacgtcgtggcgcgggcgcggacggtcgccgctgaggcttaa

SEQ ID NO: 8196 - DNA, 993 bp, Methylobacterium sp.
atggatgatgtcctgagcttcgtcgacgcgatcatccggcgcgtctcggcgggcaacctgctcgccgcggggctgctgctcgccaccgcgctcctctgcgcgctgatcgcctacctgcgcacggccgagcgctactccctccgcgagttcttcgagttcgcgatcccgcacgaggtcatcgtccacccctcggcccgcgccgacgtgatgttctggatcacgcggcgcgtgctgatgccgttcctgatgctgccggccgggatcaccttcgtggtcgcggtgggctacgccaccagcacggggctcggcgcgctcctcggcatcgaccagccggtcctcggagagccggggccggtgacggtcgtggtcttcaccctcacgatgctgctggcctacgacctgtcctactacctctaccacaccgcgcagcaccgcttccccttcctgtgggagctgcacaaggtgcaccactcggcggaggtgatgatcggcatcacgaaggaccgggtgcacccgctcgacgagctgatgaaccgcgcctgggacggggtgatccccggcatctgcttcgggatctggacgctgctctcgctcgatcccgtcgaggtcacgatcttcggcgtcaacgtctacgtgatgcgcaacatcctgatgatggacttcgtgcgccacacccatttcaagatctcgttcggcgcgctcaacaccgtcatcctgtgcccgcactggcaccagctgcaccactcgaccgacccgcgccactacgacaagaatttcggcctgctgttctcgttctgggaccggctgttcggcacgctctgcgtcccgaaacccgacgaggatttcaagttcggcatcatggacagggacgcggcggcctaccagtcgctgtcgggcctctacatcctgcccctgcggaagatgggccggcacatcgcccgccgggttcggcgcctgcgcgggcttccggaccggccccggcagagcgcctga

SEQ ID NO: 8197 - DNA, 183 bp, Methylobacterium sp.
atgaagaacccagctctgagcatctggctctcggccgccaaccgcgcagccgggtggtggatcggcaccgccacgtccgtggcgcggcgtcagcaacagctcgcgctcgcggagatgacgaaggccgccaccggcaggaagcctgcgcggaagcgccggaccaagccgaagcgccgcacgtaa

SEQ ID NO: 8198 - DNA, 777 bp, Methylobacterium sp.
atgcgggagcaggagaccggccccacgatgagcgcccccttcaaggaccatttctcgtccgccgcccccggctacgccgcccaccgcccgacctacccggcggcgctcgccgaggcgctggctgaactggcgccggggcgcgggctcgctctcgattgcggctgcggcaacgggcagctcgcccggctgctggccgcgcccttcgcgcgggtcgtcgcgacggacgcgagcgcggcgcagatcgccgaggcctcgccgcatccgaggatcgacttccgggtcgcgcccgccgaggcgagcgggctgccggcggcgagcgtggacctgatcacggcggcccaggccgcgcactggttcgacctggcgctcttctacgccgaggcccggcgcatcgcccggccgggcgcggtgctggcgctgatctcgtacggcgtgctccacctcgatggcgaggcggaggcggtgctgcggcatttctacacgcaggtggtcggcccccactggccgcccgagcgcgcccatgtggaggccggctaccgcaccctgccgttccccttcgcggagctgcgcgcgccggatctcgccatcgaggtcgactggagcctcgacgatctcgtcggctacgcgggcacgtggtcggcgctgcgcggggcggaggccgcgctcggcacgagcccgctgccggacttcgcgcgcgacctcgccgccgtctggggaccgccggagacgcgccgtcgcgtgcgctggcccctggccttccgcctcgcgcgtctctga

SEQ ID NO: 8199 - DNA, 84 bp, Methylobacterium sp.
atgagcaagttcttcgaggaagaggttctgtcggttcaccactggaccgacacgctgttctcgttccgcacgacgcgcgatccg

SEQ ID NO: 8200 - DNA, 522 bp, Methylobacterium sp.
gtgagcgcccatctcgcagaggccgtgaacgcctgcgcctatgcccacgcggacggccccttgatctacctcaggaggcgtctggcgaaggcgctcaaggccgcgttcggccagccgatccgccttttggcgtccatcgaggaggacggcgagggaggatacgtccccggcaagtctcgggtcgcgcatctgcacatgaaacctggtctcgatcccgccgaaaagagtactctcgccaaggcgcgcgccgcgatccgtgcggcgtgcggtgagtggacggggccccggcgccggcgccagatcgtgatgaagccgactcgggatgctggttgggcaggctacttcacgaagtactgccgccttgccgcgccgcggatggtcgctttcctcaagatccacggcgctggcccgcgctggctgcctagccacgccgggccggtcctcacgatggaccgcgagaccaaccgcgcggccaaggttctgcacgagaaagcccgccagatcgtttgggaggccccctag

SEQ ID NO: 8201 - DNA, 3411 bp, Methylobacterium sp.
atgaccgcgctgttcgacccgcgcccgctcgtcttgggcacgctgcagaacctctccctggttctggagcgctcgaccgtgctgtcgggtcgtccgggcgtctcggggctcaccgtcggcggcagcgaggccagagccttcggcggcctcgagatgccgatcacccgcaccggcagatcggtgcccgcgaagcttcgctacggggcgatcaccgtcacgccgcgaccgcagggctcggccttcagcggcagcccgggggttcatcctgcgatcgagcgggcctacgacaacccgggcgtgcgcttcggcgatcgggtgcgcggcagcgagcgcccgacttcgtcggccggcgaaacgagttgccacttctcgcagacatcggtgtcgaagacctcgccgatccgcgagatgatcaaggcggcgcgcggcgggcgccgtctcaccggctcgcgcgccgccgcccacgtgctctacgtcgagcgcgtgggcgcgcccgagcagatccagcgcaagggcgagccgcgtctgtccggcgaagccttcggcgccgagatcgagcgccgtggcctcgcccgctccgccgccgcgcagcaggcctacatcgaacgcgccggtgctgctgaaggcatggagcgcaagcccggacggcggatcaccgacgaggcgctcgatgcgctcgacgaggcatcgttcggcacgatcggcgatacgctcgaggagcgcacgcgcttctggctcgccgtcgaggaggccgaggcgacaccgaagggcgaccgcgtcacgatcaagccggccgagaactcgacatggtgggccagggtcgccgagaatctcgatcaggccccacctgccgcgcagaagccgatccgcgacgccctcgcccgcgccgatggcgagcccttcgacgtcaagctgaccacggacaaggccttcgccttgcaccagtgggcggtcgctctcgactccgaggcacctatcgagatctcgcccgggcgcggagggcgtacgcagacgcgcgtgatcgcggaactgccgcacgagatcgatggccgcgagcggctccagatcgtgcgcgacttcacacagaagctcgccgaaaaaggcttcccatactgggccgtgatccacgcgccggacgccaacaacgacgcccggaacttccacgtgcacatcgcttactacgatcgacctgccgcgaagatgcagaaaccgggtggcacgggcgaggtctgggacttcgagatccaggatcatgtgatctacaagagcaagaccgggggagccaagcgtcacctgacgcggccctaccagcagaaccgcgatcgcacgacgcatgaccgggcgtggatcctggaattgcgcaagcactgggagacggtgtcgaaccgcgtcctcgatgaggccgggttctcgaagcgctacaacctcggcagctacgagcgcatgggcatcgacctcaagccgctcaagcacatcaacgcgcgcactttcaacaaggagcgcaagggcgccctgaccgaggaaggtccggtgctcgctcggcggcagtgggacaccgtccacgaccgcctggtcaaggagcacgaggagcgcgcccgcaagcggcaagtgtcgatcacgaacatgtccgaccacgcggcccgcatggttgcgccatttccctacggcgcgcaccgtgtcgccgaagtgaggcgactgaaggatatggggatcaaggcgagcttccagctggccttgctggagctgcatcaggatctgacacggctcgtggcggaccggatcgtctcgcgcccgaagctcatgatgcaagccgccgacgaggaggaccgcaaggccctcaggcagggcgcgtcgccagacgccgccccgcaggaccgcgcggttaccggtgccgagctcttcgggctgaaacgccgcagcgagatcgcgaccttcctgaccacgatctacgacggcgctctccactttgaccgggacaacgagcggcgctctcaggccgcccgcaacaacgtacggttgatcgtggcggagttgaaggcctggatggccgagcccggccgttcgctccatgccgcgcgccgctacgctcccgaggccgtgcagagcctcgacgacccggcacgcacggagcggcgcgagacctccagacgtgcgctgcaggagggcttccgcaaggcggtcgagggtcgaagcgcggagattctgcgggccctgaaagccgaggtctcggaccgttccgcgcctcgggctgcagagacagcgcttgctgccgcgccagcttcttccgcttcccagggacggaagcctgccgcgacagcgtcgccgacaggctcgaaccacgccacggggccctcggatgggcgccccaagccgcgctacacgcccggacggccggacagcccggctcccaagattggccagaccggcttccggccgcgaccggaacacgccgatctgagccgcttcctgcgtcggccgactgtcggcacgggtgcaccgtgtccgccggagccggtgcgagagaccccgcgaatgcgtcaggcttccgcgctgcctcaagccgaaccggcgttcctgcaagcgggggagcgctccagacatgggagctcgacgaccacgctgccgacgaatcaggagacgcttgggcgatcagggcagccgagctccggagtgccgcgaccctcccacgcttcgatcgccgcgcacgaagacggtggtgggccgcccggcctgcttggtgcagatccgggcactcggctcggcactccaggcccgatacacgtcggagccccagtgacggtcggggagcacatcgcaacatcgcccggcgcagcgcacgctgcgaatgagcgcggcgaacaggcggttgaatcgtgcgtcttgaagcccgctaatgtcagacgcgatggtcatcggacttcgccagaggagttggaatcctcacaacgccgagattcgcatccagctcgcggcgagggtccgctcgcaactggccggggtcagcgacgggctgattcggcgatcgcccgcacagatggagcaggcgccagctctgtaccggccagcgtcgccatcggcactgtagccagatcggaagaggagcgccgacagcttggaccggccgccgaaggcccgtcggtctcggcatcgtcggggagcgcagggcctcccgtcggccgccgccgcgggccagtgaacaaagaaggccgccttgaactggtggctccgaacctcgcggtgtcggtggacggtgacgaggcagccgatcgcgtcccgtctgcagagccagacgccgcggcgcacaaatctgacctcacggtagcgtcttctgctgcggataccctgcgaatcgtcggcgcacaacgtccacgcaagaaaatccgcacgcgggacaggggctgggagagatga

SEQ ID NO: 8202 - DNA, 516 bp, Methylobacterium sp.
atgaggaccgagcggcgcccctcggagcccgcccctaccctgttcaacagcaccatcgagaccggcatccgagccgtcattgtgctggaggcgatgtacccgcgcgcctgcggcctcgccgagatgacgtgcttcgaccacctcgtcgtgcattcggcggacgtggacggaccgccgagcctgcatcccgacctgcagccgcggaccggggagctcgtcgtcaggcgtggcctcgtcggcgaaggcctacgcttgatgtgccagatgcagctcgtcgacgagacgcacgacgagcacggcatccgctaccaggcgagcgatggcgtcccgagcttcctgcgacccatgcgagcgccttacacgcttgccctgagagagagggcgaagtggctcgcggacgaactccgcgacaggacggaggccgagatcgaggccttggcgaacgcgctgatcgcgcgctggacgctcgggccccggcccagcagcgccgggcaggacagcggagatctgcgttga

SEQ ID NO: 8203 - DNA, 1002 bp, Methylobacterium sp.
atgaggcaggactattggcgccacctgcggacgatgggcgaccgggacctggagcgcttcgtcaacgactggatcgcccgcaagatgacccggtacgccgggcaccagcgcatcggccaagccggcgacatggggcgagacgtggtcggctatctcaccgacaagcgcatgtccggcccatgggacaactaccagtgcaagcaactgctgaagcaactcgacctcccctcggccgcgcgggaactcggcaagattttctggcatgccgcccgcggggagttctcgctgccctccgcctacgttttcgtggcccccgccggggtcaagcgcgacctcgcagtcctgatcgacgacccggaccggttccaggccgctatgctgaccaagtgggacacgtggtgtaaggccggcatcgtcgccaacaacccgacgctgatgacgcccgagatccgcgcgctgatcgagggattcgatttcaaggcggtccgggtcctcgacgccgaaaccctcgtcgaggacccggacgtggtggcggtactggtggactggttcggccacgatcccggcaaggcgccccggggggtggtcccggagcagttccaggccgaggaggcggagttcgcggcggagttgctggaggtctacggcgagagggagggcaagcctttcccggacctgaacgcggtcgccgcccatccgcggcacggggcgcatttcgggcgccagcggcggtggttcttcgacgcggccgccttccgtcgcttctatcgcgacaacaccccgcatcggtacctcgtggatttcgaccgggacatgcacgatggggtcatcgacgtctatgaacgttcctatccggaccggctcgaacgggtgaacggggtcatgtcgcacgcatccctggtgaagccttccggcatcctcggcatccattccgaggtcggcgtcaggcaagggacctgccaccacttcgtcaacgacgggctgctctcgtggaaggaatga

SEQ ID NO: 8204 - DNA, 450 bp, Methylobacterium sp.
atgttcttcctgaaggaattgcctacgcagaagatgcttcaaacgtatcaagatcgctttcccgacactgatatccggaacatcgaggatgcactccggctgcttcgacgtggaagtctccttatgcgcgagctcgaagcatattttgcagcgcacgccctgtcgcaaacgcgcttcttggtcatgatggtgatcgatcgcgagccggaacgagagagccttttcccaagcgagattgccgaccggctggatgtctcccggcctgtggtgacggacacgatcagaacgctggaaaaggcgggcctgctgagcatcaagagcgcccaggatggacgaacgaagcaggttctcctcacgccccacggccggaccgtcctcgccaacctccttccgggctacttcgcactgatcaccgagttcatgacgcggggctcgcggcctgtcccgtaa

SEQ ID NO: 8205 - DNA, 150 bp, Methylobacterium sp.
atgaacccgctcaaggccggactgatcgtcctcatctgcctgatcctgttctggctcggcgtccggctggcgcgccgcgccatcgatctcggcatcgcggccggctacgaggccgagcgccggcgcaaggacgacgaggagcggccgtag

SEQ ID NO: 8206 - DNA, 1446 bp, Methylobacterium sp.
atggcccagccgcatgccccgggcggcacgctggtgccccggccgcatcaggcggaggccgcccgcgccatcctggcggcgcgcgcggccggccgtcccggcttcctgctcggcgacatgaccgggctcggcaagacgctctcggtctggagcgcgctcgccgcgatgccggaggccgccgtgctcgtcgtctgtcccaagggggcgatgccgcaatggcgccgcacgatccgcgatgcggggctggcaccgaaggacgtgacgctcgtgaactacgagcgcaccaagtcgctgatggcgcccccggaggcgatccgccgccgctcgacccgggcgaggaacaacgcgctcgccaagcacggcagcctcaagcgcgcgtggccgctcgtggtgttcgacgagagccaccggctgcgcaacccctacgcccagcagacgatggtctgccgccagctcgccgacgccgcggccttcacggtctacatgagcgcaaccgcggggcaggccccgcacgagctcggctatctcgggcggctgctcggccacgcggtgggcagcccgaccgagacgctcgccgacttccgcgccctgatgcagcggctgggcatcgggcgcgccaaggggcgctgggtgaactggtcgtggagcgccaacgcccgcgactgcgcggtgatggccgacctgctctacacgggcgcgaacgcgatcggcctgcgccgccgcccggccgacatcgcgggctggccggaggtgcagcgcgacctcgcgccgaccgcgctcaagccggacgagcggcgcctctacgacgcgacctggcgggagttccgccgggaattcggcctggccggcggcagcacccggcggcccgccggctgggccgcggatctgcgcttccgccagaaggcgagcctgctgcgggtcgccggcaccgccgatttcgccgagatcctgctggaggccggcgagcaggtggcgctctcggtggccttcctggagacgggcgcggccctggccgagaccctgcgcggccgcggctggcgggtcgacgcgatcgacggcacgcgcacgggcgaggcgaacgaggcggcccggctcgccttccagacgggcgacctcgacgcgatcgtgttcacggtcaccgagtcgatctcgctgcaccggaacgagctgcccggcggcgaacggacccgggcgctcgtcgtccacgacatgcgccacagcgcgatccagctcgcgcagatcgagggccgctgccaccgcgacggcgaggccgcggtgatccactacgcctacgcggaggatacggtcgaggaagcgatcgccgcgaccgtgctgcgccgcatggcggcgatggacgcgatggcgggcgaggataccggcctgctcgacgcgatcgcggactgcatcgcgcgcccggaccggacgcctgataccgtttccggttga

SEQ ID NO: 8207 - DNA, 1164 bp, Methylobacterium sp.
atgctacgcagagtcgccacggccgcgtcgatcgcgctcgccgccttgtgcgggggtcaggcccgcgccgacgagatcctggtcggcgcccacatgccgctgaccggctcgctcgctcgctcgggtcaggcctacgatgagggcatgcgggtggcgacccagatgttcaacgccagcggcgggaagcacacgatccgcctccaggtgatcgacgacgagagcacgcccgccaaggccgtctcggcggtggagaagctcgtctcggacggcgcggtggcggtgatcggcggctacggctcgaacatcgtcggaccggcttcggacgcggcggagaagctgaagaccacctacatcacggccggcgctgcgagcgacgagctgaatacgcgcgggctgaagaccttcttccgcatcaacaacaacgccggctaccagaacggtatggtcggactggtcacggggctgaagccggcctcgatctcgatcctcgcctcgaccaaggagtcgacggcgctgctggccaagggcctgcagaaggatctcacggccgccggcatcaaggtaacgctgcacgagttcgatccggcgatcaccgacttcaagccgctcatcaacaaggtgaagctgcaggacaaatccgagatcctgatgatgtcggcctacgagaacgactacgtcggcatcatccgcgccgccaaggttctgaagccgccggtcaagctcatcgtcggggcctgggccctcgcggtgccgaagctgtaccaggaattccccgacctgatgaacaacgtcgtcggaacttccttcctgcccttcccggtcgagatcaaggacgaggagggcaagcgcttcgccgaggcctaccggaaagcctacggcaaggacgtcgactatcacgccaccctgagcttcgtggagaccacgatccttgccgaggcgatcgccaaggcggccgaggccggcacgctgaaatccggcggcctaccggagatcgtgcgtgccaccgatcgcgagacggtgctcggccgcgtgcaattcgatggcaccggctacaatccgcgcttcgccgtgtcgatgggccagcaccaggccggcaagatcgtgctggtctccccggccgccacggcgaccggtcagatcgtcttccccggtcttccctggtga

SEQ ID NO: 8208 - DNA, 1164 bp, Methylobacterium sp.
atgcttcgcagagccgtcgcggccgcgtcgatcgccctcgccgccttgtccggtgggcaggcccgcgccgacgagatcctggtgggcgcccacatgccgctcaccggctcgctcgcgcgctcgggccaagccttcgacgagggaatgcgggtggcgatccagatgttcaacgcccgctccgagaagcacaagatccgcctgcaggtgatcgacgacgagagcacgcccgccaaggccgtctcggcggtggagaagctcgtctcggaccgcgcggtggcggtgatcggcggctacggctcgaacatcatcggcccggcctcggacgcgtcggacaagctgaagaccacctacatcacggccggcgcggtgagcgacgagctgacggcgcggggcctgaagaccttcttccgcatcaacaacaatgccggctaccagcgcggcatgggcaccctgctggagagcctgaagccggcctccgtctcgatcctggcctcgaccaaggaggcgccggcgctgctggccaagggcctgcagaaggacctcgccgccaagggcgtgaaggtcacggtgcacgagttcgacccggcgatcaccgacttcaagccgatcatcaacaaggtgaagttgcaggacaaatccgacatcctggtgatgtcggcctacgagaacgactacgtgggcatcatccgggccgccaaggtgctcaagccgccggtcaagctcatcgtcggcgcgtggtcgctcgccaccccgaagatgtacagcgaattccccgacctgatgaacaacgtcgtcgggacctccttcctgcccttcccggtcgagatgaaggacgaggagggcaagcgcttcgcggaagcctacaagaagacctacaacaaggaggtcgagtacctctcgaccttgagcttcgtcgagaccacgatcctggccgaggcgatcgcgcgggcggccgatgccggcacgctcaagaccggcggcctgccggacgccatgcgccagacgcagcgcgagaccctgctgggccccgtccaattcgacgccaccggcgacaacccgcgcttctccgtcgcgatgggccagcaccgcgcgggcaggatcgtgctggtctcgccgcccgcctccgcgaccggcgagatcgtcttccccggcctaccctggtga

SEQ ID NO: 8209 - DNA, 309 bp, Methylobacterium sp.
atggagctcagcgaaggcgaacttggtcgtgcggtcgatggcgacgagcaggtagagccgtccttcggccgtgtggacctcccccagatcgatgtggaagtagccgagcgggtaggccttgaagcgggacctcttgggcttgtcgccgtcgacctctggcaatcggctgatgccgtggcgctgcaggcaacgatgcagcgacgagcgggtcaggtgcgggatcgtcgcctggagcgcgtagaggcagccatcgagtggcaggagcgtgtgacggcgaaaggcgacaacgaccgcctcgtcctcaggtga

SEQ ID NO: 8210 - DNA, 702 bp, Methylobacterium sp.
atgctcatcacgcgtgacctgggcggcggctacggcggacgcccgatcctcaagggaatcgatatcgagatccgcgagggcgacaccgtcgcggtcctcggagcgaacactgccggaaagaccacgctgatccgcgccctgaccggcctgctgcctcaggtgactggccaggtgctgctggcaggcgaggacgtcacgcacctgcccgcgcaccagcgcgtgactcgcgggatcgcccttgtaccggagggccgacatgtcttcccgcggatgaccgtgcgggacaacctcttggttggagcctaccgacgcagggaccttgatctggaaaccgacctcgaaggttgcttcgtgatgtttccgcgacttaaggagcgactggggcagcgggccgggacgctgtcaggcggcgaacagcagatggttgcgttgggccgcgccctgatggcgaagccccgcctcctcctcctcgacgagccgagccatggcctcgcacccctcatggtggccgaggtccacgaggcgatcgagcgcgtgacccgcaccggcatcgccgtgctgctcgtcgagcagaacgtcgcgagcgcgttgcgcctcgtccgccacgcctacgtgatcgaggcgggcgccatcgccctttcgggcactgccgacgaactcgccggcaacgacgagatccgccgaacctatctcggaatctga

SEQ ID NO: 8211 - DNA, 606 bp, Methylobacterium sp.
atgacggccgccgcgctcgtgctcctgctcgccgctgcgcaggtgccggcccgcgccacgccgtccggttcggcgcgggatgcgcccgccatggccgctgctacgaccgcggacatcgaccccgccacgggtttgcgcgtccggaactaccgcgcccccgtgaccatgcccgtgagggggggcacccgcatcgacctcgacgcggtcgaccggctccgtacggagggcgcggcgctgatcgacgtgatgcctcagcgcggcggcttcgatccggcgggcggcgcctggcggatcgtcgaccggcacgcgaccatccccggcgcggtctggctgcccgagaccggccgcggcgcgatcgagccgcggctcgccgcctacctcgcggcctggctcgccaggctgagcggcggcgaccggggccacccgctgatcttcttctgcatggccgattgctggatgtcctggaacgcggtgcggcgggcggccgatctcggctaccgccgcgtctactggtttgccgagggcacggacggctggagcgaggccgaccgcccgctcgtaccggccgagccccccgcggtcccgcccctcaccgccgcgccttga

SEQ ID NO: 8212 - DNA, 210 bp, Methylobacterium sp.
atgaccgctgaaccggacaatctcgtgctcgtcttcctgcggcgcatcgacggcaaggtcgatcgcctcatcgacgacgtgaacgacctgaaggccggggtctccgcggtcgaggagaaccttgcgggcgttcaccgccgcatcgatcgccttgagcttcgcgtcgagcgcatcgagcgccggctcgaccttgccgacgcgacccattga

SEQ ID NO: 8213 - DNA, 984 bp, Methylobacterium sp.
atggcagtgcaaacccgcctgacgcaggcgttcgggatccgtcatcccatcgtcctggccccgatggatccggcctcgggcggcgccctggcagccgcggtgagtgcggcgggcggcctaggcctggtcggcggcggctacggcaaccgcgagatcctggaggcggagttcgccaaagccggcaatcagcgtgtcggctgcggcttcatcacttggtcgatggcacgtgacccggtcctgctggatctggccctcgcgcataagccggcggcgatgatgctgtcgttctccgatccggcccccttcgccgagaaggtccgggcggccggcgtgcctctgatttgtcaggtccacaatctcgagcacgcccgccgcgccctcgacgccggtgcctccgttctcgtggcgcagggcaccgatgcgggtggccatggcatgaccacccgcggcaccatcacccttgtcccgagcgtggttgacctcgtcgcccgcgagcgcccggaggttttggtgctcgccgccggcggcattgccgacggacggggaatcgccgccgcgctgatgctgggcgcggacggtgcgcttcttggcactcggttctgggcgacccaggaagccctaatccatccggcagccaaggcccgcgtcgtggccgccaccggcgacgagacggtccgcacctcggtctacgacatcgtccgcaaccgggcttggcctcccgcatacaccggccggctgatgcgcaaccggttcatcgagacttggcacgggcgcgaggacgaactgcgcaacctcgtgggcgcggagcgcgagcgcgtcgagagtgcagaccggagcggcgactacgacgtctcgaacgtgacggtgggcgaggccatcggtctcgtccgagacctccccgcggccggcgacttggtcgcgcgtctcgcggcggagacggaggcgcgcctcgcgacgctaccccgcgcgctcatcaccgcctga

SEQ ID NO: 8214 - DNA, 1017 bp, Methylobacterium sp.
atgaagaagatcggatttctgtcgttcgggcattggtccccgggcgcccgctcggaagcccgctccgcgggcgacaccctgctgcaatcgatcgatctcgcgatcgccgccgaagagctcggcgcggacggggcatatttccgggttcatcatttcgcccggcaactcgcctcgccgtttccgctgctcgcagcgatcggcgccaggacgaagcgcatcgagatcggcaccggcgtcatcgacatgcgctacgagaacccgttctacatggtggaagacgccgggtcggcagacctgatctcgggcggacgcctccagctcggcatcagccggggctcgcccgagcaggtgatcgatggctggcggcacttcggctacgctccggccgagggcgggagcgatgccgacctcggacgccggcacgccgaggtgtttctcgacctgctgcagggacgcggcttcgccgagcccaatccgcggccgatgtttcccaacccgcccgggctgctgcgcctggagccccactcggaagggctgcgcgagcggatctggtggggatcggcgtccgacgccacggcggtatgggcggcgcggcagggcatgaacctgcagagctcgacgctcaaggccgacgagaccggcgagccattccacgtccagcaggccaggcagatccgccgctaccggcaggcctggaaggaagcggggcacacacgcgagccgcgcgtctccgtctcccggtcgatcttcgccctcgtgagcgatcgcgaccgtgcctatttcgggcgcggcgagagcggcgaccagatcggcatcatcgacagcatgcgggcggtcttcgggcgctcctacgccgcggagccggagcggctggtcgccgagctcgggacggacgaggcgatcgcagaggccgacaccctgcttctgaccgtgccgaaccagctgggggtcgcctacaacgcccacctcatcgaaaccatcctgaagcaggtcgctccggcgctgggttggcggtga

SEQ ID NO: 8215 - DNA, 762 bp, Methylobacterium sp.
atgaacaaccggttcactccgctcttcgaccagatctcggatctccggtcgatcgcgatcgaggcccgggcgcccgcgaatcacctcgcgcttctgacggagcatccggtcgcctacgagagcaacgaccacaaggcgccgtggggcacgaagaacgacaatacccgcagcgcccgcttctgccgcgcgctcgaggcgcatttccggcggccgatcagcgcgatggatctgggctgctcgggcggcggcctcgtcttcgatttcctggtgcgggggcacctcgccatcggtctggaggggagcgactactcgttgaagtcacagcgcgccgagtggcgcgtcatcgacgactatctctacacctgcgacatcaccaagccgttcgatgtcgtggacaagacgagccgggcgacccacgccttcgacgtcatcacgatgtgggaggtcctcgaacacatccacgaggagcatctgccgcagctcttcgcgaacgtgaagaagcacctcgttccggacgggttgttcgtcggctcggcggcgctctacgacgatgtcgtgaacggcgtcagctaccatcccacggtgaagccggagatgtggtggcgcgagacggcccagcgcaacggcctcgaattcgtgccgaaaacgatgttcgacttcgccgatttctgccgcggtacgggcaacggaccgctcgacccgaacttcgcgcaggatcccggcaagggcttccacttcgtcatgcgtcaccgggcagcgtga

SEQ ID NO: 8216 - DNA, 1404 bp, Methylobacterium sp.
atgggctacagcgttttgaaggtatttcgggaccagctgactggcagcgaaagcaagcgacacggcctgcgtgaaatgctcgccttcgtgggcgcaaacaagaatgcgcattatcgcatcgtcttcgatcatctcgatcgcttcacccgcaatttctacgaccatgccgatctgcggcgcgagattgcgaagctcggcgcgatcctcgaaacgcccgcaggcgtgcttgacgagcgttcgtcgtcgcggctcatggaaaacgtgacggtcgccttcgcggattatcaccgtgtcaacaaccgcgagcagacgctcaaccggatgcaggcacgcgtctcaaacggctttgccgtgttcgctgcgccgaccggctacgcctatgggcgcgtgccgggcttcaatggccgaatgctcgtgcccaagcagcctgacgcctcgatcgtccaagaggccttcgagagatacgtgtcgcgccagcttgaatcgcaggcggacgtggtgcgcttccttgaagagcatccgctctaccccaagccgaagaatggaaggattccgcaccagcgcgtcggcgatatgctccgcaacccgatctacgcgggctacgtcgaagcgccgtgctggggcgtggagcggcgtaaagggcaccatgagccgctgatctcttacgagacgttccagcgcgcccaggaccgcctaaatggcctgcgcatcacctaccgcaccgaccttagtcaggatttcccgctgcgtggattcgttctgtgtgacgactgcgaagcgccgctgacggcctgctggtcgatcagcggcagcgcgcagaaaaaacgtcacgcctactatcagtgcttcaagaaggggtgtgcgagttacggcaagacgatccgccgcggcgtcatcgaaggcgagttcaaggcgatgctcaagaccgccgagcccgagccgcagctgttcgacgtcgtgacggcgatgatgaaggacctttggcagcgcaaacaggcgaacgtcggcagccagaccaaggccctgaaagccagtctggtgaaggtcgaggagcagatcgatcaaacggtggagcggatcgtcgaaacgaccgtcccggctgtcatgcgggcgcttgagaaaaaggtacagcggctcgaaaacgagaagctgcttctgcgtgaaaagatcgacagttcgacaacgccgcagggcgattttgaccgacgagttagaacgggccttgcgttcgtcgcaagcccttggaatttatggagtactggccggatcgaggaccgccgcgcggtgctcaaactcacgtttgcccatcgcctccgttacaagcgcggagagggatttagaactcccaatttgacgttgcctttcagggtcttaggcgatttttttagcggtgaaaaaggaatg

SEQ ID NO: 8217 - DNA, 1044 bp, Methylobacterium sp.
atgcccctcaccgtggactggtccgtcagcatcaacgggaccgattacacctcgcgcttcaacccctacgtgatggagatcgaggtcacggacggatccggaagcgacggggacagctgccgcatcacgctcgccgacgacgggcgcctcattatgccgaaaaagggcgtgaccatcgcagtatccatcctcggcgtgaaggtgttcgagggtattctgaagacgccgcgctgtacgacggcgaagggccaaggcggcaagatggtcctgaatgcgacagggcacgacacggaggacgagggcaagcagagtcagcacttcgcgatggaagagaccaccttgggggagtacctgtctggcctcagcaagaaggccgggtatgagatcaaggtcgaccctgaactcgcgaagatcaagcaatcgtggatcggctcggaggggcgctcgtttctggagcacgcccagctgctggccaatcggtacggcgccacgctgaagctctcgggcaagcaggctgtcctggcccggcggggtaagggcaagacgcctggcggcaaggatctccccacggtgcgcgcggtctcgccgggcaacatcatcaacgcggacatcgagccctacgtcgggacggccgccgtgcgcgacgtgcgcttcgacttctttaaccgggacaaggcgcggttcgaggaacagaaggccgacgtgcgtctcggcatcggatcgagcaagactgcgcggagggtgctgcccggcaaggcagcgagcagggaagacgccgaggaccgggcgaagggggccgcggccgactcggagcgcgagcgcggctcgggtaccgtcgagatcgacatcgagccgcaggcccgcgccgagggcacctgcatcgtgtccggcgtccgccagggcatcgatggggagtatcgcatcgagagcgtcacgcatacgctcacggcgggcgacggcggcggctcgaccacgaagctgaccctgaagcagcccggcgacgaggccggctccgacaagcggaaggccggcgagggggattga

SEQ ID NO: 8218 - DNA, 1182 bp, Methylobacterium sp.
atgttggaagctcttccggcagacgccctcggtacgccgcttcgggacggcgcgcgcgggaggtgccacgtcgccgtcagccaggatctcgaggccctgcgggaggtctggagcgctctcgaggcgcgttcgggcggcgtgttccagagctacggctggtgccggacctgggaggcggccgcgcggcgagccgggtgccggctgacgccgcgcatcctcaccgttcatcaggacggccggctcgtcctgctctggcccctggtggtgcaacggctcggcccgctgcgcgtcctgcgcagcttcggcgagcccgcgacccagtacgcggacgccctcctcgccccggggggcgagcgcgcggcgtggctcgacgccgcgtggcaggcggtgcgggcgatgcgcgacgtggacgccgtgctcctgaagggcgtgcgcgcggatgcggccatcgcaccgctcgtcaccccgcgcggccgcttcgcgacgcgcggcgcggaggcgccgttctgcgatttccgcaacgccgaggcccgccgacgctcgggccgcacgcgcaacacgcttcagcggaacctgcgccacctcgccgagaccggcccggtggcgttcgaggtcgtggctgagcccgaggcgcgggtccggacgatggcggaggcgttgcggctgaagcaggcatggctgcggcgcaccggccgcgtcagcgccggctacgcccacccggccaacgcggccttcctgcaggggctggcggcctgcccgaacgccctcgtgctgcgcctcacggtgggcggcgagaccgcggcggtggaggccggcctggtccacgcgggcgcctacgcctccctcgtccaggcctacgaggcgcgccatgcggcgcacgggcccggccggctgctgttccggcacatggtcgagaatgcggcgagcctcgggatcgaccggctcgatttcctggcgcccgcgtcccggcacaagtcggaatgggcgacgggggcgatgccggtgcgcgattacgccctgccgctacgcctgcgcggctggatcctgctcgcctatgtccgccaccttcggccgcgcgccaaggcgtggcgcgagtggatcggcgccgtgctgaccggtctcgcgcggcggcggcaggggcccggcacggtcgatcagggccgggcggccggtagaatatga

SEQ ID NO: 8219 - DNA, 906 bp, Methylobacterium sp.
atgcgctccgacctgaatctctgggatctgcaccatcacagcgtggccgactggcagcggatcctcgccgggcatccgggcctcgccgcccgctggctccgcttcgccgccgagcgcggcttccggtcggcgcagctcgtcctcgggcagatgctgctggaggggcgcggggtcgcgcgggatccggccgccgcccacggctggttcgcccgcgccgccgcgatcggcagcctcgacgcgcgcaacatggtcgggcgctgccacgaatacggctggggcgtgccggtcgatcacgcggcggcgctggcgcagtaccgccgggccgcggccgaggggcatgcctgggcccgctacaatgtcggctgcctgctgctctacggggacgtgccccgcgaccacgccgaggccttccgctgtttcgcggccgccgcgcaggcccccgacgaagcagccgccggcaaggcgctcggcatgctcgggcgctgccacgaggagggctggggaaccccgccggaccacgccgcggcgctccgctgctaccgcgaagcggcggcggccggcgatggctggggcgcgctcaatctcgggctcctcgccctggaggcgggcgacgtctcgggcgcggcgtcggcgatcgagcgggcggcggcgctcgccgccccgaacgggctggcggcgatcgtgcgggcgctggcggggcgggacgaaccggccctggcggccctgcgcgagcgggtgcgcgcgggcctgcgcccggtcggcggcaccgtaccggacacggccccgccgcgccgcatcgccgcccggccgctcgagtggcggctgagcgcggccctcttggccggccatctgctgcgccggggccgggcgccgcgcgccagaaccatccctgccaccaccggttga

SEQ ID NO: 8220 - DNA, 2925 bp, Methylobacterium sp.
gtgggcaatctaacctcatccctgacgctcaagctgattgacgatggcctggccgcaaaggtcaaggctgacgccgatgcaatgcgtaagctcggagcgagcgcccaggacttgaagaagctgggtggcgcatcaagccacgtggcgaaattgaacaaagagctcgacgcccttgcgaaaaagggcggcaagctcgaagccctcaaagtcaatgagcgccagctgagtacgctggccgcctcgtacaagacggcccgccaggaagtcgcggccacggcaaaagcggtcgccgcgctcggcccgggcgtcagcgcgaaggaccagcgcgccgcggaacgcgcgcacaagaccgcgatgcgtcgcatggacgccgcgcgcgacgcggccctggaacaggcccgcctggtgaaggcggcccatgctgaggcgctgggtgggtccggcaagggccggatcggcatggctcgggccgaacagcagctggcggcagccaccaacgcgaccaacgccgctctgcgggagcaggtcggccttgtcgggcgcctggcggccaaggggcgcgccgagcgcgacgtgctcgccgggatgggcctggctggccgcggccagggcgccaagatcgcggccgaccgccgcctggtggacggcatgggcgcgccggcgcgcgcagccgcggccgctgccgcagctgctgccaaggctgccgttgaggccgagggccgacgccgcagcagcgccagcggtgacatgctgcgcggtatgggcggcatcggccgccgcgagcacgagcgcatcgccgctggccgccgcgtggcggaaggcatgagcgcggcgggtcggcgcacgggctcgatggccggcggctccctgcctcaggcgggtgacgcggaaggggccgccatcttcgacaccctcaagggtgttggggccagcgccgcggcccggagggcgttcgatgcgacgacttcaaactgggcaacgatggacgaggccgtacgccggcagcgcgcaattcttgatatcgatgaggataagcaagaacaactcaaagcccaggcgtaccaaatcggcaaagatacccggttctccaacccggatgtcatcaaggggcagacccgtatcggctcaagcctgcccgaccacctgaaaaatcctgcggtgatcgcggccattacggagaacgcgaaggactatgccctggcgatgggcaccaccctggacgaaggttccagcgccgtcctgggccgaatgctcggcatgcgtatggatctgtcaacaaccgggtctgccggggccgcttccctggatgctgcaaacaagttggtccagtgggcgaaggcgtcgggcgccgaccacaacgacgtgatggggtacaccaagttcggtgcggccccgggcaatgtcggtgggttctcgccagagttccaagacgccctgtccgcccagcttcgccgcatcggcttcgagggctcgatgggcggtaacttcgtgcgggccgcggcgaccaagctcgcggtgccgacctcgaagggcctgggcgcgctcgcggccgccggcatcgaccattcggactacgtgcagaagggcaaggagctctcggccgagaacctgaacaagtcgctgaagctcaagtacggcaagggcctgaccgatagccagcaggcgcgcatccacgcgctgatgcaagatgagacggtggtgggcaaccgggatgagttcattcctgcggttgccgaaatcgtgcaggaaacgctggcccggaagaccaagaaagggtcaataaacgcgcaggatgccaagagcattgccaaagctgttggcgagttcctgaacgtttcggcgggtgcggtcgatattgagcgcctgatgcgggatgttatcccgcttctgaaggggtcgcctgcgctgtccaaatacttgttcgggcaggaacatggcggccgcgcccaggcgcttgatgccgccacgctcgaaaaggacacagaaagcttccgcaatacaccgagagatcgcgccaagggtgtaggcaatataacgaatgctgggttccacggcgcgcgagaccgatactatgggtcggttgaaacgttctggacccgcctgggtgaagtcgccaacggcccgctgaccacgttttatgaaacccttggcaactcgattgaccgcgtgtccggcctgcctgacgccctgctgggcgtcgggacagcggcggcctcagccggcgcggccctgctgacgatcaagggcgcagcaggggccggcgcgttgctcggcctgcctggcgccgccgcggtctcggcgggggcgtccgctgccggtggcgttgcgaccgtcgccgccggcggcgcgatggcaacggccatcgccaacgaagccatcaaaaacaaagagttcgcggccccgtacctcgatggcgggatgctgggggcggacccggccggatacggcatcggcgccggcatcatgcacgcccccgaagccctcaagcagatgtccgacgccaacaagcgccggatgggctcgcttccgcctggtatggcgggggtgccggcccagctgccgccgcgcctgcccgggctcgatggcaggccgaaggtggcgccagccccggcggtgcggcccgtgacgctcaacccgggcgacgaactgcccggtgtcgccagcagcctggaacaggtcagcggcaaggcggaccaggcgcgcagcagcctggaacaggtcaatggcgtgaaagtggacccttccatcagcacgggcagcctcgacgccatgctggcgaagatcggtcaggtgatttccggccttcagcagatcaccggcctggcggcatcagccaacagcagcatcgccagcgtgaacagcggggccgccctgaaaggacggtccttcagcgacggcgccacccctgggcgtggcacagactaa

SEQ ID NO: 8221 - DNA, 234 bp, Methylobacterium sp.
atgctccggttcctcggccggcatgcgggcctgctggccttcggggtggtggccgccgtcgtcctcgggcccctcacggtgttctggccgggcgccggggcgctggccgtcgccctcctcggcgcgctcggagcgctcgccgcccatgcccgcgccaccgcgctgcgggcgcgctgcgacgtgctctcccgcgaggtcgacgggctctccaagcgcctgctgcgggcggaatcg

SEQ ID NO: 8222 - DNA, 168 bp, Methylobacterium sp.
cccccgcccgccccgggcacgcagcgctacatcaccgagccgccgcgcgctcccgagacgcccggcccgatgccgagtccggcgcccggccgcggcacgggcgagagcctgtcgcgcgacctcccctcggaagcctaccgcccgccgccggagcgcggcgggcgctga

SEQ ID NO: 8223 - DNA, 198 bp, Methylobacterium sp.
atggcccgtcgtcaaaccgccacgcaagccgcgatttctcgtgccgtgaagggtgcgcaggccgccggtcttaagatcggccgcgtcgagatcgagggcgaccgcatcgtgatccattccagcgccgagcccgtccaggccgccccggcgtcggacttcgacgcatggagggcgaagcgagatgcgcgtccggcttaa

SEQ ID NO: 8224 - DNA, 1134 bp, Methylobacterium sp.
atggaacggttcgagatcgtcggcacggcggagcggcttcgggcggtcgggccggcctggagcgggctctgggcggcgagcggcgccccggtgttccagagccacgcctggatctcggcgtggtgggacagcgtgccggatcgcggccggcggcgcctgatgatcgtgctggcctggcgcggcacggatctcgtcggcgtgctgccgctcgccaccatgcgccgccgcggcctgcgcgtcctcgaatgggccgccaaggcgtgcagcgacttcgcggacgcgctcgtcgccccggacgcgggcgccgatctcctgcaccggatgtgggcccatctctcgggcgcgggcgggttcgacctcgcctatctgagccatctgcggccggaggcgcgggcctgcgtcctgggcgaggcgcgctcgggcggggtccggctgcggccgaaccaccgcaccgagcagaactggcgggtctgcggccccgtcccgagcgggaaggcgtggttcgacgcgcagcccaagaagatgcgccagaaccaccgcaggggccggaagatcatcgccgagcggggcgccctgacctcgcgcctgctcccgccggacgcacccctcgacgacctgctcgcctggttcgtcgaccgcaagcgcgcctggctcgcggccaacggcctgcccccgggcctgttctacgccgagggcgcgcgcgcgctgcccgcgatggtgcgggtcctggccgaggccggcctgctgcgcgtcttcgtgctggactgcgacggggcacccgtcgccgcctcgatcaacttcgtgcagggcggcacgatgatggccttcgtcaccacctacgatccggatttcgagcgcgcctcgccgggcctcgtgctgatgatcgactacatcgtctgggccttcgaccacggcctgcacacggtggatttcctctgcggcgacgagggcttcaagggccgcttcggcacgcactgcctgacgctcggctcgctgatgggcgcgcgcaccctgccgggcgcggccgcgcacctcatcgaccgcggcggaagcgggctctcgcggcgtctgcgcgcacgtcgccctgcgccggccggggggcagaacgaggcccgggatgatgccgcggcctga

SEQ ID NO: 8225 - DNA, 1095 bp, Methylobacterium sp.
atgaagccacggatcgcgctcggccttcagggcggcggtgcctacggcgcctatggctggggcgtcatcgaccgcctgctggaggagcatatctggatctcggcggtgagcggggcgagcgcgggcgccctcaacggggccgccctggtctcaggcctcgcaagcggcagcgacgacggcgcgcgcacggccctggcccggctctggcgcgcgaccgccgaccgctcgccgctgcgggcctgggattgggcggccagccttccgccgggcgccgcagactggatggcgccctggatcgagccgtgggtggacgcctgggtcgagccctgggtggagcagtccctcaccttcacccggctctacggcggccacgtcaccccctactttcccgacttccgggcgatgcgcgcgtggcgggaagccgtgacggcgagcgtggatttcgaggcgctgaccgcgccgcgcgcgatcccgctctacgtctccgccacggacgtgctcacgggtgcggcacgcctcttcacgggggccaagatcaccgaggacgcgctgatggcctcctgctgcctgccggagctgttctcgcccgtcgagatcgatgggcggcgctactgggacgggggctacgtcgccaacccggccctcgacccgctggtcttcggggggcacggcgcgaccgacctcatcgtggtccagctcacgcccttcgttaccgacgccgtcagcgagcgggccgacgaagtggtgaagcgggccagcgacatcagcttcaacgcctgcctcatgcgcgagctgaagacgctgaccgagctgcaatccgccgtgcggctggcagcctccccatccccccgcctgcggccgatcctcgacatcaacatccacctcctgcgcgcgccggccgagctcgcctcgggctgcgtcgacaagtacgacacccgctggtcgaccctctgcggcctgcgggatctcggccgggcgacggccgaggcgtggctcgccgagacgggcgacgcgatcggctcggcctccagcctgaccaccctggacgaggcgctgacggagcacgcgccgcgtggcgagggggtggaggcctga

SEQ ID NO: 8226 - DNA, 699 bp, Methylobacterium sp.
atggccatgatcaacggcggcagcctgcagatcttcggccggatcaatccgccccgcaaggagacggtcgccctcgacgaggcctacacctccgagacggatgccgagggccgcttcgcgttccagcttccctaccttcccgcgcgctgtatcgcccgtttgaaggccggcatggacgcgcgcgacgtcgtcgtgggttactgcgcgccgcgcgaacccgagcgggtcgccgcggccgagccgaaacccgccaagctgctgcccgccgcgaacgtcgcgaagccggaggtcggaccgcgggggccccaagggatcgccggacctcagggaccggaaggtccgcaaggggtgcgcggcgagaagggcgaggccggcgccgccggtcagaccggaccggcgggccagcgcggcgagaagggcgagcccggcccgcgcgggcctcacggggagcgcggtcccgccggccctgccgggccgccgggggcgcccgcggcggctgggatcgccttgcgcgtgcaggtcgaggactgcgccggcggtgcgcggtgcgtcgccagttgccgcgacgacgagttcgccgtgaacggcacctgcagcggcggtgagcggccggcgatggacgagagcagtatctactgcgtcggcctgggacgggtgccggcagccctcagagcccgcgccatctgtgcacgccagtga

SEQ ID NO: 8227 - DNA, 1023 bp, Methylobacterium sp.
atgatcacacgacgcagcctgctcgccaccgccgcggcgggggccggcctcatcgcctgcccggccgtcctgcgggcgcagagcccgaagatcctgaagctgtcgcaccagttcccgggcggcacgatcgaccagggcgacgcccgcgaccgcatcgcccgccgcttcggccaggcggtcgagcagcgcaccggcggcagcctgcaggtgcaggtctacccgacctcctcgctgatgaagacgctcgcccagttcagcgccgtgcggaagggcgccctcgacatgagcctcgtgccgctctcctacgcgggcggcgaggtggtcgagaccaacctcgcgctgatgccggccctcgtctccagctacgagcaggccgcccggtggcgcaccgcccggatcggcgaggagctctcgaagacgctctccgacaagggcgtgatcatcctcacctggatctggcagtcgggtgcggtcgcctcgcgggtgaagccgatcctcgagcccgccgacgtgaagggcgtgaagatccggggcggcgggcgcgagatggacatgatgttccaggccgccggcggcatcgtctccaccatgccgtcgagcgagatgtatatcggcatgcagaccggcgcgctcgaggcggcggtcagcgcctcgaccagcctgatctccttccggctcgacgagatgaccaagaacctgaccgcgggccgcggccgctcgttctggttcatcctggagccgctgatcctgtcgaaggcgaccttcgacgcgctgacccccgagcagcagaacgttgtgcgcgatgtcggccgggagatggaggccttctcgttcgaggcggcgagggccgacgacgaggaaatcgtgaagatctacggcgcccgcggcgccaaggtgcacgacctcaccgacgcgcacatcgccaggtggaaggagctcgcccgcgacaccgcctggaaggatttcgcgggcaagaacgcccgctgcgccgagctcctgaagctcgccgaacaggtcgcttag

SEQ ID NO: 8228 - DNA, 267 bp, Methylobacterium sp.
atgaccacccgtttcaccaccgccgccgtcgcgattgccctgagtctggccgccccggccgcgttcgctcaggccggcaactggccgcacacggagcgcgcgccggtgagcgcctacgacgacatcaccacgggctccatcggcgtcgcccgcccgcaggtgcgcgacggatggggcgcggtcagctcggccaaggccggcaacgcgaaccagcagaacttcccggtgcagcagtacggccagacctcgggcggtccggcctactga

SEQ ID NO: 8229 - DNA, 162 bp, Methylobacterium sp.
atgatcggtcttgcaagcctcgcgagcctcggcctcggcgcgacgttggccgcgctcgcccctcgggcgggcctgagggccgcgacctgcgagacctgcggcgggctgttcctgatctcgggtctcgcgctgctcggatcctgcctgccgctgttccggtga

SEQ ID NO: 8230 - DNA, 297 bp, Methylobacterium sp.
atgtcctgtctctggtccggtatcgcggccctcgcgcttcccgtcgccgcggcgatgccgggggcgggcggccccgttctggtggtcggcgcaccgggtgccggaccggcggcggtcgccgagatcgtcgcacgggccgacggcgcgctcctgcgccccacggtcctgccctggatcgtcctcgcacgctccgatgccggggatttcgatgcgcgcctgaggcgggcgggcgcctggctcgtcctcgacgggaccgccctcgcgggctgtgcgggcggccgcgggagcatccggtag

SEQ ID NO: 8231 - DNA, 978 bp, Methylobacterium sp.
atgccggtgaccgatgccgcggaccctaagccgctcatcctgttgacgaacccgatccacccggaggcggtggcgcggctcacgccccatgcccgcgtcgtgaccgcgccggatacgggcgccgacaccctgcggcgacttgcccgggaggccgccgggatgatcgtgcgggcgcaattgcccgacgacatcctcgatcacgcgcccctcctgcggggcatcgtccggcacggggtcgggctcgatttcgtgccgctggcggccgccaatgccggcgggatacccgtggcaaacctgcccggtagcaacacgcgggcggtcgcggaatacgccttcgcggccctgttcgagttgcgccgccggctcggccatctcgaccggacgctccgccagagcggctggctcgccgccaagacgctggccaacgacctgcccgagatcggcggcaccgcgctcggcgtgctggggctcggcgagatcggccgggcggtggcggggatcggccggcacggcttcggcatgcgggtgctcggcacggcgcgcaatccgcgcggccttgagggcctcgccgagccggtgccgatcgagcggctcttcgcggagagcgacgcggtggtgatcgcctgcccgctgaccccggagacccggggcctcgtgggtgccggcctgatcgggcggatgcggcccgacgcggtgctgatcaacgtcgcccgcggcccgatcgtggaggccgacgcgctcgccgacgcgctggaggccggccggatcggcggcgcggcgctcgacgtcttcgcggtgcagccgctgccggaggaccaccggctacgggggtgcccgaacctcctcctcacgccgcacgtggccggcaccaccgcgaccagcctgcgcacgatggggctgggggcggccgacgccatgctggcgatcctgcgcggcgagcggccggcgacggtggtcaatccggaggtgtacggctga

SEQ ID NO: 8232 - DNA, 237 bp, Methylobacterium sp.
atgatcagcgtgcagccctactggctcgtccacggcgagggccctgccagccgtcggcatgacaccaaggcctcggccgatcgggaggccgatcggttggcccggcttcatcctgggcaggtcttcgtggtgctggaatccgtcgaggccttccgcaagatcgacgtgcaacgggtcagtctgcgcgggcccgaggggcgcgttgctcccggcctgatggacgatatccccttctga

SEQ ID NO: 8233 - DNA, 90 bp, Methylobacterium sp.
aaggcgttctcctacggcatgatcggcgcgttcgtggccggtctcggcctgacgctccggggctccctcggcgttctcgccggcctctga

SEQ ID NO: 8234 - DNA, 90 bp, Methylobacterium sp.
aaggcgttctcctacggcatgatcggcgcgttcgtggccggtctcggcctgacgctccggggctcgctcggcgttctcgccggcctctga

SEQ ID NO: 8235 - DNA, 426 bp, Methylobacterium sp.
atggcaggcggctacgcgccaaacacgttcgcagtgctcctagtcgaggacgtgccggtccagatgatggcggcggccagcgccctgcgggacgccggcctgcgggtcgtcgaggcgccgacggtcgaggcggcgacttcggcgctcgccgctgatcccgagctgcgcgcgatgatcgccgacatcgaccttggcggcgaaccgctcatggggctgaccctagcgaaggccgtcgcggcgcgctggccggatgtcgtgctgctgctcatctctggcgctatcgtacccgagaccgaggccatgccggcgggggcgaggttcctgcgcaagccgtttgagccagaggcgctggctgaggccgtgcgaggcctggtcagcgcgcgtgaggcgggtaggcttgcgccagacggatcagtgatggggtga

SEQ ID NO: 8236 - DNA, 597 bp, Methylobacterium sp.
atgaacgaacccaccaaatcggcccctctgggccacttcatcggctacgcccgggtcagcacggacagccaggagctgaccaaccagcaggccgccctgaaggctgagggctgcacccgaatttttgcggagaagatcaccggcgcgaagcgggatcgcgtcgagctggatcggatgctggaccatctgcgtgcgggtgacgtcgtggtagtcactcgcctcgaccgcttggctcgcaacacccgcgacctgctcgacatcgctgagcgcctgcggggtatcggcgccgggctgcgctcactggcggagccctgggcggatacgaccagcccagccggcaagatgatcctgaccatcatggcgggcatcgccgacttcgagcgatcgctaatcctggagcgcaccagcaccggacgcacggcggccaaggctaggggcgtgaagttcggccggacgccggccatgacgtcggagaagctggccgcggccaagacgctcctggccgagccgggcaagaccatgacccaggtcgccgccgcgctcggcgtgcaccgggctactctctaccgagcgctcggcgctgagggcgacgcatga

SEQ ID NO: 8237 - DNA, 2271 bp, Methylobacterium sp.
atggccgagaccgacgcgcagatccttcggctgcaggtcgccaacgcccggccgcaggatgccgggcgcggcatcgcccgcctcggccacgcggccctgacccagctcggcctgcgcgagggcgacgtcgtcgagatcgtgggcaagcgccacaccgcggcgatcgcggtcggcccctacgaggaggacgaggggctcaacctcgtgcggctcgacggcctccagcgcgtcaatgccggcacggcgagcggcgaccatgtcgaggtccgcgccgcgtcggagatccgcccggccggccgcgtcgtggtggcgcccgcgcagaagaacgtccggctccagggctcgggcgaggcgctgcggcgcacgctcttccgccggccgctggtggcgggggacgtcatctcgacctcgacgcagtcgcgcgccgcgcccgacccgcgcatcccgccggagctgcgcccctatctggagggcccgacctacgggctgcaggagatccgcctcgtcgtggtctcgacgcagccccgcggcatcgtcttcgtggcggagggcaccgagatcgagctgcgcccgctcttcgaggagccgaaggacggccggcgcgccgacgtcacctacgacgatatcggcggcctcggcgacacggtcgaccagatccgcgagatggtcgagctgccgctgcgccatcccgagctgttccagcgcctcggcatcgatccgccgaagggcgtgctgctgcacggcccgcccggcaccggcaagacgcggctcgcccgcgcggtggccaacgagaccgaggcgcgcttcttccacatcgccggccccgagatcatgggcagccgctacggcgagtccgagcagcgcctgcgcgaggtcttccaagaggccgcccagaacgcgccctcgatcatcttcatcgacgagatcgactcgatcgccccgaagcgcgagcaggtcaccggcgaggtcgagcgccgaatcgtggcccagctcctcaccctgatggacgggctggagccgcgccagaacgtcgtggtgatcggcgccaccaaccggcgcgacgcgatcgacgaggccctgcgccggcccggccgcttcgaccgcgagatcatcatcggcgtgcccgaccagccggggcggcgcgagatcctgggcatccacacccgcggcatgccgctcgccgaggatgtcgatctcgacgcggtggcgcgcaccacctacggcttcgtcggggccgatctcggcgcgctggtgcgcgaggcggcgatggacgccgtgcgccgcatcctgccggaggtcaacctgcgggagggtatcccggccgagaccctggaggggctgagcgtccggcgcgacgacttcctctcggcgatgaagcgcatccagccctcggcgttgcgcgagatcatgatccaggtgccggatgtgacctgggacgatgtcggggggctagccgacgcgcagatgcgcctgcgcgagggcgtcgagctgcccttgcgctcgccgcaggccttccggcgcatcggcatccggccggccaagggcttcctgctcttcggcccgcccggcaccggcaagacgctgctcgccaaggcggtggcgcgggaggcggaggcgaacttcgtggcgacgaagtcttcggacctcctctcgaagtggtacggcgagtccgagcagcaggtctcgcgcctgttccagcgggcccggcaggtcgcgccgaccgtgatcttcatcgacgagatcgacagcctcgcccccgcccgcggcggcggcctcggcgagcccgccgtgaccgagcgcgtggtcaacacgatcctggccgagatggacgggctggaggagctgcagggcgtcgtggtgatggcggccaccaaccggccgaacctgctcgacccggccctgctgcgtccgggccgcttcgacgagctcgtctacgtgccggtgccggacgcggccgggcgccgccgcatcctggcgatccacacccgggacatgccgctcgccgaggacgtcgacctcaacctgatcgccgaacgcaccgcccgcttcaccggcgcggatctggaggatctcacccgccgcgccggcctcctggcgctgcgggaatccctcgacgcgacgcaggtccaccgcgtccatttcgagcaggccgcccgggagacccggccctcggtgacgcccgagatggagcgggactacgaggagatgctgcgcaccctcaagcaggagggcccgcagcgccagccgatcggcttcctggcggcgcggtaa

SEQ ID NO: 8238 - DNA, 273 bp, Methylobacterium sp.
atgccgcccgtcgaaccggtcagccccgttctcgataccctgctgtccctgctcgccgaggcgccgccgggccgcgaccgcaaggcggcggagcacgccgcggaacggctcgaccggctcgaatacgcggcgcgatgggacggcgcggccccggagacgctcgcggcgatcgccggcgcgcggatgctgctcggcctcgctgcctatccgtgtccccggcgcccccgcatcgcgccgcgtcacccgatcgccggggccctgctgccgcattga

SEQ ID NO: 8239 - DNA, 591 bp, Methylobacterium sp.
gtgagcccgacccggattctctgcgtcgaggacgaccgcgagatcgcagacctgatcgccgaggtgctggccgaggagggcttcgccgtcgagcgcgccgcgaccggcccggaggggctggcgcgcctgcggacccgcccggacgccgtgatctgcgacatcgacctgccgggcttcagcgggctggacctgctgcgccgcgcgggcgaggcgggcctcgccgcgcccttcgtcttcctcaccgccttcggcggccgccggaaccagatcgaggcccggcgcctcggctgcgcggacttcgtcacgaagccgatcgatttcgaactcctcgtggcggtgctgcgcaacgtcctgcagcgcgcgcccgtgcgccggaccgtgcaggagcccgcggtccagatgaccgagcgcgagcgcgagatcctgaccctggtctcgcggggcaagtcgtcggtcgagatcgcgcagatcctcgcgatcagcgagcggacgacgaacttccacatcggcaacgtgatgaggaagctgaacgtgacctcgcgcgtccaggcggccgtgatcgccctctcgatgggcctgctcgagaagtag

SEQ ID NO: 8240 - DNA, 378 bp, Methylobacterium sp.
atgaccgagcaccggattgtcagccatagcaagctgcgcgacgagatgatggccgttgccagggggcagcaggccgcgccgccgaatgccggggggcagagcttcgagtccgtcgaggcgctgatgcgccttctgacgccggacaaccggcggctgctggccatgatccgcgatcgcaagcctcaatccattgccgagctggccgaatggtcgggcagggctgcccccaatgtcacacgcacactggcaaagctcgaagcggtcgggttcatccgcatggaagaaaatcagcggcgcaaagtgccgacggctgtggtccacaagcttacgatggagatagacccgttctcgcagaatgaccggctggaaatcgcttag

SEQ ID NO: 8241 - DNA, 675 bp, Methylobacterium sp.
atgatcaccgtcgttggcggcactaagggggggtcgggcaagtccaccgtcgccacgaacctcgccatcatgctggcgagcgccggccgtgacgtgctcctggtggacgcggatgatcaggagacctcgaccgacttcaccaacctgcgcgaggccacccggccgggcggcgcgggctatacctgcgtcgccctaacgggcgcggccgtgcgctcaggggtccagcgcctcgccccgaaacatgcacatgtcatcatcgacacgggcggccgtgacacggtaagccagcgcgcggccctctcaatctgtgacgcctacctcgtgccgttcgccccccggtccttcgacgtgtggaccctcgacaaggtggccgagctggtcgaggaggcgagggccgtgaacccggagctgcgggcgctcgccttcatcaaccgggccgaggcacgaggctccgagaacgcagaggccgccgagctgatccgctcgaagccgggcctggagttcgtgccggcggcgctgggcgcccgcaaggcgttcgcccatgcggcggcctcaggcctgtcggtcacagagctgcgcccgcaggacccgaaggccagcgaggaaatcgccgccctctacgggcatctgttcgataccgccaagatatcctcccgagatccgaaaggagcctga

SEQ ID NO: 8242 - DNA, 759 bp, Methylobacterium sp.
atgaggcttgggtaccatgagtacccagatcagcgcaagacgaaacgtacccaacatgtcgggtacatgttgttcatggaacagggcgaccgcgcatcccgtctgaagctcgcgagggagcgagcaggctatgagagcccgagggcggccgcgcgccatttccgttggaacgagaacacgtacaaagcccgcgagaatggcctccgagactatagcgttgaagacgccaaggagtacggccgggcctacaacgtctcgtggatctggctcgccggtggcgaaggcggtatcgagcgcaaaagcgtggcgaggatagaagggttgatcggtgcgggtggcgagattgatacgaacttgagccaagcctacggcgaagacgtcgtcgaggttgaagttttggtgccacttccgccggacgtcaccgcctatgaggtatggggcgattcgatgctcccgaaatacgatccgggagacatcatcctggtgcggaacggcaaccaaccggcggacgagctgctgggcgatgtggcgcttgtcgtcaccagcgagtggaagcggtacttgaagcgcatcctacgaggcagcggcgatggcctctatgacttggagagcttcaacgcccgtaccatcaaggacgtgcgcgttttgcaggtcggcgcgatccagatggtgatcccatcgaagcaggttgagcgtgtcgcgaatggcaaagaagtcgagcgccgctaccaactaaagtccgccgacgctgccgagtag

SEQ ID NO: 8243 - DNA, 1155 bp, Methylobacterium sp.
atgagcgcagttgtctacaatggcccgcgcgacgtggcggtgcaggacgtgcccgacgcgcggatcgagagatcgaccgatgttctggtgcggatcacgagcaccaacatctgcggctccgacctgcacatgtacgagggccggaccgatttcccgcgcgggggtgtgttcggccacgagaacctcggccaggtggtagaagtaggcgacgccgtcgaccgggtgaaggtcgggaactgggtcgccatccccttcaacatcggctgcgggttctgcaagaactgcgagcgcggcttgagcgcgttctgcctgacaacggcggaccgaagcgtcgtgccgaacatggccggtgccgcttacggcttcgccgacatggggccgtatcggggcggccaggccgacctgctgcgcgtcccctacggcgactacaactgcctgaaactgccgccggatgccgaggagcggcagaacgagtacgtgatgctggccgacatcttcccgaccggctggcacgccaccgagctggcaggactgcgccccggcgagtcgatcgtcatctacggggccggcccggtcgggctcatggcggcccatgccgcgatgatcaagggcgcctgcatggtcatggtcgtcgatcgccatcccgaccgcctgcgcctcgcaggcgagatcggagccctgcccatcgacgattccaagggctcccccgtggaccaggtgcttgagctgacgaacggcatcggggccgaccggggctgcgagtgcgtcggctaccaggcgcacgacccgcagggtcacgagcaccccaacatgaccatgaacgacttggtcaaatcggtgaaattcaccggcggcatcggcgtggtcggcgtcttcacgccccaggatccggctccgcaggacccgctctacaagcagggcgagatcgtcttcgaccacggcctgttctggttcaagggtcagacgatcggcgtcggccaatgcaacgtcaaagcctataaccggcagctgcgcgacctcatctcgaccggccgcgcgaagccgtccttcatcgtctcgcatgagcttccgctggaagaggctccgaacgcctaccagcacttcgacgcgcgcgacgagggctggaccaaggtgattctcaagccggccgcatga

SEQ ID NO: 8244 - DNA, 600 bp, Methylobacterium sp.
gcgcccacccagccccccttcccatccgcactgccgacgctcccgcgggccggggcggcgcccgccgcgacgggcctcgtggtggcgccggggcgggtgctgaccgcggcggccgcgctcggagggtgcgcgccgcgcatcggggccgcggcggcgcgcgtgctcgcgagcgacccggcccaaggactcgcgctgatcgaggcgccgggcctgccggcctcggtcctgccgacgccgcgcgggacgccggcgggcgtggacgaggcgctgacggtggtggcggcgagcgccgaggggagcgtcgtcgcgccgggcgcggcgctgggatccggcgtggtggcgccgctccagccgggcgcggccggcgcgccggtgctcgaccgcgcgggcgcgctcgccgggatcgtcgcccgctacccgagcacgccgcgcctcgtcgccggcgtggcgccgccgacgagctacccgatcctgccgggcgaggccgtcttgggcttcctgcgccggaacggcatcgccccctcggcagccggcgggtccgcgggggcgtcggcgggcgcgatcgcgccggccgtggtggcggtcacctgcgcgcgctga

SEQ ID NO: 8245 - DNA, 252 bp, Methylobacterium sp.
ttgccgatcatgcccgtcgagcgcgtcgccgcgttccggtccccgcgctcccgccgcccgatcggcgaactggacgtcgtgaccgtgctcgtatctgtgcagaccgacgagggcgagccgatcgccgccggcacggcgggcccggtggtggccgtctgggccgggggcgcagcgttcgacatcgagttcgacgagcccgtgctgggactcgcgaccgtgcgttccgagaatctggaacgcctgggcgattag

SEQ ID NO: 8246 - DNA, 1236 bp, Methylobacterium sp.
ttgatccgcacggcgcggctcgccgcgcgcccggtcgcgcgcgcggtccggcggcatatcctcccgcgggtcctgcccacagtgcgccatcccttcccggagcaggtgcgcaacgtgcgcgtcgtcgggcttctctcctcgtcctccggtctcggcgagtccgcgcggctctgcatcgactcgctgacgcaggacggctgcgccgtctccaccgccaacgtcgccgccctgttcgacagcgacgacggtgtcgcctacccgcagcgggaatcgggtccgccggccgacgtggcgatctaccatctcaacccgaccatgctcctgccgagcatccttcgggcggggctgccgcagcacctgcggacctacagcatcggctactgggcctgggagctggagacgctgccgccggaatggatcggggccctccgcttcgtcgatgccgtcatggtgccgagccggttctgccaggaggccgtgcaggcctacacgagcaagccggtggtcgtcgtcccgcacccggtcgcccagccggccacggcggcgggcgcggccccccgcgccccgggcgcccggtttcgcgtcgtcagcatcttcaatctcggctcgtccttcctgcgcaagaacccgctggcggcgatcaccgcgttccgcaccgccttcggcgagtccgaagcggccgagctggtgctgaagatcagcgacggtgcccgctacccggcggagcgtgaccggatccacgccgcgatcgcgggagcgcgcaacatccggctgatcgatgcagtctgggaccgcgccgagctgcaggctctgctgacctcggccgatgcctacctgtcgctgcatcgctccgaggggttcggcctgacgctggccgaggcggcactccaggcgatcccggtcgttgcgacgaactggtcgggcagcaccgatatctgtcccccgaacctctgctacccggtcgatcacgcgctggtgccgttcagcgatccgcacccggcctatgcgggtctgaggcgggcgcgctgggccgagcccgacaccgagcacgcggcccggcagctccggcgcatccaggccgatccggccgaagcacgggcgcgggccgtcgccctgcgggcatggctcgccggatacctgggacagcacgattaccggggcgcgctccgggagatcgcagcccggatgccggccggcgccccgcccgcggcggacgagaccgtcgccccgagctga

SEQ ID NO: 8247 - DNA, 450 bp, Methylobacterium sp.
atgtccaagcgaaatgtagagcccgagctcacggctgcgcagctacaggaactcatcggcatggcgcgggggaacagcgagaccttgtccaccatggacggcaacaaccaagccctgtttctactgcgcacattcgacacggcagaccgtgtctatggtctctggccagattcatcgcggcccggcggctatgactacaacatcatgaagggtgagttgggcagcgcggccatgcggcgggttgcgaagagccccaacatctccgtcacggcagtattccaggagaacgagaaccacgccgaactgacacgcgagatctacgtggggctcgaaacgactggcgatgcttaccccgagacgtatgcggaggctttccacttttggatcaatatcgtgcccgctaacttcgaggacaccaagcggcgcatccggggctacatccttggctga

SEQ ID NO: 8248 - DNA, 420 bp, Methylobacterium sp.
atgcatctcgaaaccgcgcacgtcctcgccggcctcattgaggcgatgcccgaggacatccctgtcgacgacccggacgacgaggcggaaggcgcgcccgagaccgggtcggcgcgctcggctcgggagcgccgggatgctgcccagcgcaagcgcgacgagcgcgcccgccgtaaggctgggggcatgccggaccctcgcgtggtggacgctgccatcgccacggccatcgccgacatctgcatccgggcggacttccgcggccgggcgaaggcgaagggctctatcaagggcctgtccatcgggctcgacgccatcatcgggcaggtcatgcaggtgctcgtcgaacagcggaacgtcgggcagccgcaggctaagaaggccgcgatgcagcgcctcggcctgacccggcaggcctga

SEQ ID NO: 8249 - DNA, 735 bp, Methylobacterium sp.
gtgacctcctcgcattccgccgccggtccgcagcgcgtgctgatcacgggcggcacatcgggcatcggggcggcgatcgcggagcgctgccgccgggacggctacaccccgatcatcctcgaccgcgtgcccgcggcatcgggcgcgtgcatcgtcgccgacctgtcggaccgcgagcagaccgcccgcgcgctcgacgaggccctcgccggggggccgatcacgcggctcgtcaacaatgtcggcgtggtcgtgccgagcgaggtcgacacgcagccgctcgaatcgctggacctcgccgtgtcgctgaacttgcgctgcgcgctgcaatgcctgcaggcggtgctgcccggcatgaaggcggcgggcttcggccgcatcgtcaacatgtcctcgcgcgccgcgctgggcaaggaactgcgcacggcctacgccgcgacgaaggccgggctgatcggcatgacgcgggtctgggcgctcgaactcgggccgttcggcatcaccgccaacgcgatcgggcccggcccgatccgcacggcgctgttcgaccgcgcgaaccctccggacgcgccgcggacccgcgccatcatcgatgcggtgccggtcaggcgtgtcggcacgccggaggacgtcgccgacgcggccgcctacttcctcggtcaccgcagcggcttcacgacgggacagaccctctacgtgtgcggcggcatgacggtcggcctggcaagcgtctga

SEQ ID NO: 8250 - DNA, 834 bp, Methylobacterium sp.
atgccgatgcgctgccacatcggttccgctttgcttctcacggggctcgcctgcgcgatgccggtcggggcggaggcgggagcggggccgcgggttcggatcgcctacgagaatccggccccgggcgaggccagggagatctaccgcgaggtgagggagcgccgggtgctcgagggacttcgaaaccttctctcgcatctccgcctgccccgcacgctgacgctgcggatggccgcgtgcggcggcgagcccgatgcgtggtacgcggcgcgcgatcggaccgtgaccgtctgctacgactatgtccgggacgtgcgggagcgcgcgcccgccaccgtcacgcccggcggcgtgacccggcaggccgccatcctcggcgggttggcgcaggtcttcctccacgaggtcggccacgcgctgttcgacatcctcgatatcccggtcctcggccgcgaggaggatgcggccgaccagttcgcggccctggtcgtcctgcgccttccgccggaggaggcccgccgcgcgatcgacgggggcgcgcatctgttcaggagcttcgcggccgaggaagcggtggaggaggcgatcctggccgattcccacgggccgttcgcccagcgcctctacaaccttctctgcctcgcctacggctccgaccgccgcgccttcgcctatctggtggagcgcgccagcctgccgagcgcgcgcgcggccgagtgcgccgcggagtacggccaggccgcggatgcgatggaccgggtgctgcaccgtcatctgcagggccggcgcctcggccgcggtcaggtccggcgggccttccggtggatcttctga

SEQ ID NO: 8251 - DNA, 987 bp, Methylobacterium sp.
atgccccacctgcaaccctcgcgccgcgcgatcctggccgggggccttgccgtcgccgcgctcccgctctcggcgcgggcgcaaggggcctatccgacccggccgatcaccctgatcgtgcccttcgcggccggtggctcgaccgacgtggtcgggcgcctcgtcgcgcagaagctgtcggaggtgctgggtcagcaggtggtcgtcgagaacgtggtcggggccggcggcaatgtcggggccgcccgcgtcgcgaaggcggagccggacggctacaccatcctgatgggcacggtcgcgacccacgcgctgaacccgctgatcctcaagcgcaagccctacgacccggtgacggacttcgcccccgtcgcgctgctcgcggtcgtgccgaacgtgctcgtggtcaacccgagcctgccggccaagaacgtgcaggagctgatcgccctgctgaaggccgacccgaagaagtacaactacgcctcctcgggcatcggtacgccgctgcacctctcgggcgagctattcaagagcatggcgggcgtgcagatgcagcacatcccctatcgcggctcgggcccggcgctcaacgacgtcgtggccggccaggtgccgatccagttcgacaacctgccctccgcctcggaattcatccgggcgggcaccctgcgggcgctcgccgtgaccacgaaggagcgcgcgtcctccttccccgacgtcccgacgctcgcggaatccggcctgccgaactacgagacctacacctggaacgccctgttcgcgccgcccggcacgccgcggccgatcgtggacgccctcaacgcggccgcccgcaaggcgctcgccgacccggccctggtggaacggctgaagaccttcagcgccaaggtccagctctccaccccggaggaactgggcgagcacgtgaaggccgagaccgccaagtggaccccggtcgtgcgcgaggccggcatccaggccgactga

SEQ ID NO: 8252 - DNA, 1416 bp, Methylobacterium sp.
atgtcggacctgtcttccaacctgtcccccttccgcgagcttctcggcgagggcggtgtcgtcaccgatgccgacagcctgacccgctacacccatgaccagcgggccctgatgcaggggcagaccccgggcgtcctgcgcccgcgctcgacagaggaggtccaggcggtcgtccgcctcgcggcgcatctcggcttcggcctcgtgcctcagggcggcaataccggctatgtcggcggcgccaccccggagcccggccgcgggcagctcgtcgtgagcctcgagcggatgagccggatccgcgcggtcgacgcggccggcttcaccctcgcctgcgacgccggcacgatcctcgccgacgcgcaggccgccgcggaggcgcagggctgcctgctgcccctgagcctcggcgcggagggaagctgccgcctcggcggcaatatcggcaccaatgccggcggcctgcaggtgctgcgctacggcatgacgcgggatctcgtcctcgggctggaggtcgtgctgccggacgggtcgctgttctccgacatgcgcaccttgcgcaagaacaacatcggctacgacctgaagcagctcttcgtcggcgccgagggcacgctcgggctcgtcaccggcgtggtgctcaagctctggcccgcgcagacgcggcgcgccaccgcctggctccagctcgcggagaacgcgcccattcccgagatcgcggccctggtccggcgggagaccgcggatctcgcctccaccttcgagctcatctcggcctcgtcgctggcgctcgtcgccgacatgcgcggcgccgatctcgggctcgcggccgggcccggcggcgcggtcctcctcgaactctccgcctcctcggagcgcattcccctggacgacgtgcttctgggcaccttggaggcgctgatggaggccggccacgtcgaggatgcggtgctcgcgcagtccgagcggcagcggcgcgagatgtggacgatccgcgagacgatccccgaggcggagaagcacgcgggcggctcggtgaagctcgacatcgcggttccgacctcggccgtctccagcttcctggttcgggcgggcgcggtcgtcgcggccgaggcgccgggcacgcgcctgtcgttctacggccatgtcggcgacggcaacatccacttcaacctgatggtgccggcgggccgcgaccggctcgccttcacgcgggaggtggaggagggcgtcgcgcatgccgtgtacgcggtcgcggtcgatctcggtgggagcttcagcgcggagtacggcatcggccgcttcaagcgggacctgctggtccgctacggcgagccgaaccgtctggccctcctgagcgcgatcaagcgggccatcgacccgcacggtttgatgaacgcgggcgcgatgatctga

SEQ ID NO: 8253 - DNA, 768 bp, Methylobacterium sp.
atgctcgcggcgggccttgccggtcctgtgacggcacgcgccagcccgatcaccgaccagtggtccgcggaggccgcgcagacccggcagggccatacctatcgcaccgtgctgaccttctcctacgacggaaaggtccagaatgggcgcgccttgtggctggtcgatgtgcggtgcgaggtccgcagccctggggcgagcaaggtctcggcggtcaccggctcggggactgccatgctcgcgcagggcggttggggcggaaacgcgccacccgtcggtgacgtctacgtcatcgaggcggagaacgacccggagggcaagggcaggctggaagtcgacaacccaggctgcgcgtccggcacacctaccatcaagcggcggcccggagaggctaccgtgccgacgctgccgaaggtcgaaccgaccggtcggccgtggatgcacaacggcagcatggtcatgatcgaccccgaggccgggatcatcgcctatcgtgagcccaaggcgtccctgcgtcctgccgtgggccccggcacggtgctgttccgggggaccctcaagcccggcggcggcgcgcacggcaccgcctacgccttcaaggaaggctgcccgcccgcaccctacgcggtccgcggccggtactcagaccgtgactacacgctgaccctgcgcggcgccggacccgtccggaagggttgcgaggtcgtcggctactccgagcgcagcccgcatgccgtgctcgccttctcttacctcctcgacgattga

SEQ ID NO: 8254 - DNA, 987 bp, Methylobacterium sp.
atgggaattgccgtgcgagccgcgatcggggccctgttgctgaccgccacctcggcgcaggcctgggaacccaccaagccgatcgagatcatcgttccgttcccgcccggcggagcctccgaccagatggcgcgcaccatccagggtgcgatccagaagggcaacctcgtcaaacagccgatcatcatcgtcaacaagcccgcggccgccggcggcgaggcgatgctcgacatccagaagtcggccggagacccgcacaagctcatcaccacgtcgagcggcatctacatgacgccgctcgccaccaagctcccggtgagctggaaggacttcaccccggtcgccatgatggcgcaggacgcgttcgtgctctgggtcaacgccgcgaaaccctacaagaccgcgcaggacttcgtcgcggccgcgaagacggcggcgccgccgctcaagaccggcggcaacggctcgaagcgcgaggaccatctcatctcggtgacgatggagcaggccacgggcaccaagatcacctacgtgccctaccagggcggcggacccgcctcggtgcagctcgcgggcgggcacatcgacgccaacatgaacaacccggccgaggagatcgccaactggcgctccggctccgtgaagcccctgtgcgtattctcgccgaagccgatggagtacacccagaaggtcacggccgacatggcatggtcggacatcccgacctgcccgtcgcagggcgtgaacgtcacctaccagatgctgcgcggcatgttcatgcccggcaaggtgacgccggagcagcaggccttctacgtcgacctgttccagaaggtcacacagactcccgagtggaaggcctatctggagcggaacgccctggtgcccgatttccgcgccggtcagagcttcgtcgacttcctgacggaggacgagcgcaagcacaaggagctgatgaccaaggccggcttcatcgcgacgaactga

SEQ ID NO: 8255 - DNA, 498 bp, Methylobacterium sp.
atggcgcaagcctcacccccgctcccggagcgcggcctgtcgcgccggctcgtcgagatcctcgtggcgctcctgctgaccgggctcgccgcgctcgccctctgggactcgtacggacgcggggcgggctgggacaacggaccggagaacggcttcttcccggcccgcgtcgccgcgatcctggcgatcgcggccggcgccgtcctcgtgggagccgtgcgccgggaggacagcgtgttcgtcacctacggccagcttcgcctcgtggcccaggtcttcgtgcctctgttcctctacgtgctggcgatcgcgtttctggggatctacctggcctcggcgctgttcatgggcctgttcatggtgatgctcggtgccttccgctggtggcaggtcgcgctcgccgtcgtgctcacgccgctcgtcaccttctgggtgttcgagctccagttccgggtcccgctgccgaagggacccgtcgaggccatgctcggcttctga

SEQ ID NO: 8256 - DNA, 1542 bp, Methylobacterium sp.
atggacgacctcaaccagctcctgctcggcttccaggtcgcgctgacgtggcacaacgtgctgttcatggtcgtgggcgtcctgctcgggatcgtggtcggcgtgctgccgggcttgggcggaccgaacggcgtcgcgatcctgctgccgctcacgttcgggatggacccgacctcggcgatcatcctgctgtcgtcgatctactggggcgccctgttcggcggcgccatcacgtcgatcctgttcaacatccccggcgaggcgtggtcggtggccaccaccttcgacggatacccgctggcgcagcagggccgggccggcgaggcgctgacggcggccttcaccgcctccttcatcggcgcgctctcaggggtcgtgctgatcactttcgtggcgccactcgtggcgaagttcgccctgcgcttcggcccggcggagttcttcggcgtgttcttcctgaccttctgctccttcatcggcatggggcgggagaacaaggccaagatcgtcgcctccctggcgctcggcttcctcctcgcggcggtgggcctcgacaccatctcgggcgacctgcgcctgaccttcggctcccctgagctgatgaagggcttcgacttcctcgtggtggtgatcggcctgttcggcgtctccgagatcctgctcaccatcgaggaggggctgcacttcaagggcaagcgcgcggccatcgatctcggcgtggtcctgcgcacctgggccgggctgccgcgctactgggcgacgctgatccgctcctcggtggtggggatgtggatgggcgtgacgccgggcggggcgatcgcggcctcgttcatgggctacggcctcgccaagcgcttctcgcgccggcccgacgggttcgggcgcggcgagatcgagggcgtgctcgcgcccgagaccgcggcgcacgccgcgggcacctcggcgctgctgccgatgctggcgctcggaatcccgggctcggccacggcggcggtcctgctcggcggcctgatgatctggggcctgcagccgggcccgatgctgttcatcgagaagaaggagttcgtctggggcctgatcgcctcgatgtatctcggcaacctcgcgggcctcctcatcgtgctggccacggtcccggtcttcgccgcgatcatgcgcatccccttcgcgctcgtcgcaccgatcatcctcgtcgtctgcgccatcggcgccttcacggtggaatcctcacgcttcgacatctggctgatgctgatcttcggcgtcgtcggctacgtgttcaagaagctcgactacccgctcgcccccctggtgctcgcccttgtcctcggcgaccgcgcggaggacgccttccgccaagcgctgctcgggtccggcggagacctctcggtcttcttctcgaacgccctcgtttcgacgctgatgatcctcggtctgctgcttctggtgtggggaccgctcggcaacctgcgccagcgcctcacgcgcaagggcggcatcgatcaaccaccccgggaaattgccggttccaaggcctcttga

SEQ ID NO: 8257 - DNA, 981 bp, Methylobacterium sp.
atggcggcagaagaacgatcccacgggctgacccgccgaaccggcctcgccctcggtctctcggccgccgcggcggtctgccgcccgttcgccgccgcggccgccccgcgccgctacgccctcgacccggtccggatcgcggagggcgtctggacggtctacggcgcccaggaagcgatcacggccggaaacggcggcgccatcgccaacgtcaccctgctggacacgcgcgagggctgcgttctgatcgatgcgggcccctcgcaccgcttcggcacggccctcgacgccctggcgcgggacctgacgggcaaaccggtcgtccgggtctacctcacgcatctccacgccgaccatagcctcggcgccaccgcctttcccgacacggtgctccgggccggccccggcctgcggaccgacctcgcgcggttcggcaacgatctcgcgagcgggatgtaccgcgttgccggggactggatgcggggcacgggcgtgcccaagcccgccatggaagcccgtgagggcgtggaggatgtcggggggcggcgcttccggctgctgtgcctgtccggccatacccgggaggatctctgcctgttcgaggaaacctccggcctgctgttcccaggcgatctcgtcttcctcgaccgcgccgcgaccacgcccgatgccgatctgccgcgctggcgcaccgccctgcggacgatcgctgacatcccctgcggtctgcttgtcccggggcacggccctgcggaggccggccgccgcggcatcgatcaaacgctcgcctggctcgatgccgtcgaggccgggatcggagccgggttcgagcagggtctcgacgttactgagatcatggcgcgtcctctgccggcctggacggacaggatcgcggtagcgcgctacgagtttgcccgctccgtcatgcacctcttgccggctatcgagacggaacggctcccaaacctcccaactctgtag

SEQ ID NO: 8258 - DNA, 591 bp, Methylobacterium sp.
gtgactgccaagcgcaaatacgctcgcctcaccccggcgacctgggccaccatcgaaggcctctgggcctcgggcagtgcgaccctgtccgaaatcgcagagcgcttcggcgtgtcgccccgtgccattcaggcgcacatgagccaacgcggcattggcaagggcagtgctgccgaagcgcttgccgcgaacgtgcgctcggaggtccttagcagggcgctaagggagcctgacgatctggttgcgcgtgcggccgcaatccgcgaaggcgctgtccagggtgccgagaaagtcgagcgcctacttcatgccgccctcgacgctgcggccgccgaccccggcaaggtgttcgccctggctgctaccgccaaggcgcttgccctgagcgctcagaccttggagcgcctccacaagctcaagcgctcggccctcggcctcggggatgacgatacattgtcggatgaattgcccacgctgctcatcgaggatctgagcgcatcggatatcgctgccatgcgtgaggatgacgaggaggacgacggccccaaggcacgccacgaggaggacaacgaggttgtgctgatcacgtga

SEQ ID NO: 8259 - DNA, 624 bp, Methylobacterium sp.
atgacgctccagacgtggtggctcttcctcggcgcggtattcctgctttcggggacccccggcccgaacatgctgcacgtgatgacctgcagcgcccggtacggcctcgggccgagcgccttcgcgatggtcggctgcctgtcgggcctcgtgctggtgctgatcgcggcggccgcgggcctcggcgcggtgctcgcggcctctccgctgctgttcgagatcctgcgctacgccggtgtggcctacctcgcctgggcggggatccgggcttggcggggcggcggcgcggcacccgatccggccacgggcatcgcccgggcgccgtccgccggtggcctcttccggggtggcttcctgatcggggtgagcaatccgaagcttctgatgttcgtggcggccttcctgccgcaattcatcgagccggcccgtgcgcagacgccgcaattcgtcgttctgatcctcaccttcgcggcggccgaggcgttctggtacgcggtctacggcgtcggcggccgtcggatcgcccggctgctggtccggccgggcgcacggcgcctgttcgaccgggccacaggagcgatcttcctgggcttcggcgcggcgctcctcggcgggcaccgatga

SEQ ID NO: 8260 - DNA, 363 bp, Methylobacterium sp.
atgcagcgggcagcggtgtggcgggccgccatcggcgtgctcacgctctacgcgctcgtgctgcagggcctgctcggcggcgtcgccgccacccggatgagcctccaggccaccggcatcctgtgctccgaccaccgcgcggacgcgagccaggagccggacggacaggccggccaccaatcctgctgctccaccgtctgccggctcgccggtttcgcgctggccgccccggaggtcgaggcgatacccgccaccgtgccggcgctcgcccgcgagcggcactggcacgccgtacaggcccacgcgccgcccgcccggacccaccgctcagccgcgccccgcgcaccgcccgccgccgcctga

SEQ ID NO: 8261 - DNA, 105 bp, Methylobacterium sp.
gtggcgccggcccaggtgcgggcaccgaaccggccggaatggccgcacccgctgaacgaagaggagctccgcgccctggaaaccggctggggtttcgtcgagtaa

SEQ ID NO: 8262 - DNA, 1878 bp, Methylobacterium sp.
ttgagcgcggaacaccggaagggtctgacgctgcgccacctcgccttcaccggggcgggcaaggtggcatacgttccgttcgcccccggcctcaaccttgtctacggggcctcgaacacgggcaagtcgtccatcgccaagtcgctggacttcatgctcggcgggtccgagtggctgaagtcgagcacggaaaaccagggctacgacagcggatggctcggcctcgacctgcccgacggccgggctgtaaccctctacaggtcggtgaagggcgcgaacttcatcctgtacgacggccacgtcgtcgagaaaccggacggcgccggccgtgtcctgcgcgagaagcacagcacgaaggcccgcgacaacgtctcggtcttcctgctggaggcgttcgggttgggcgtgcggcccatcgtcaagaacgcgaacggcgagacgaacaccgtcagcttcaggaagctgtcgccctacgtcatcgtggaggagaacgccatcatcgacgagaagagtccggcgctctcggggcagcgccaggacgtcaccgtcgagaagggcatcttcaggctgctcctcaccggccgcgacgacgacggggtggtagcggcccccgatgcccgggacctgaacgctcggacgagtggcaaggtcgagctcatcgacgagatgatcgccgacctggatgtcgcgctcggcgaggcgggcggggatcgggccggcagcgagcgccaggccgaagccctgcagggcacgatggagcgttggaccgcggtcatacggacccgtcaggccgacctcgacgccgccgtgacccgccggcgcgagatcctcgacgaggccgagcgggcgggggggcaccacgtcgagctggacgtcacggtggcacgctacgaggagctcgacagcgtctacgcctcggatcttgggcggctggaatccctcgaagagaacagcttcctactcaagacgatccgtggccgagaatgcccgacctgcggcgccccggaggactgccagcgccacggccctggtgtcgcggagatcgagcgtttccaccaagcgacgatggccgagatgcgcaaggtcgagcgcgaccggcgtgatctccggggcgtcatggagacgctgcgcgccgaagcgcgcggggcgtctacccggagggtcgagctcctgcgacaggtcgagggcatagaccgcaacatcgaacggttgcgcggggaagaagcggcgacgcgcgccgactaccaagctttgatcgaacgctcggaagcgacgagccgcatcgctgcgctcttcgagcagcgggaccggctcgttgtgcagcgctcacaactcgacgcgccttcggccggccgcgcgcagaggccgagcctcgtcgttgaagtcgatggcgtcaccgcgttcgcgttcgcgaaggtcgtcgagcgggtcctgcacgcctgggggttccctggtacaccgcaggttggatggagcggaccctcgcaggacatcctcatcgacggcaaggaccgtgccgcaaacggcaagggtgtgcgggcggtgctgcacgccgccttcaaggtcggcctgatgctctactgccatgaaaagaatctgcctcacccgggctttgtcgtgctcgatacgcccctgctgacctaccgcgagccgatggacgagaagcacggcgagctcggagaggacgaggtcgccgtcaaggagagtggcctcaacgagcgcttctacgcgcacctgtcgagcatcgccgacgtcgggcaggtcatcgtgctcgaaaacacggacccgcccccgggtatcgaggcgctaggggaggtgacgaggttcaccaagcgcaacgggccgggtatgcgctacggcttctttcccaccgagtga

SEQ ID NO: 8263 - DNA, 543 bp, Methylobacterium sp.
gtggcacgggtcgcagacctcgcggtcgactggggcatgctgccgatggtgcgcttgaacgagatccgcctcggcgaggtcgcggtggatctgccgccggccaccgatgcgggcctgatcttcatcggcaccatccgcacgccctggaccgaccggctggcctgcccccgccagggccgcctcgacggcccggtctgccgcctggagatcgccgagcccttcgtcgcggcgctcgccgggctggagcagtacgccgaggtcgaggtgctctactggctcgaccggtcgcgccgcgatctcgtcctgcagagcccgcggcgcgacggcgcggtgcgcggcgccttctcgctgcgctcgccggtgcgtccgaacccgatcggcagcgcccgcgcccgcctcgtcgatatcgcgggcgcgacggtccgcgtgcaggggctcgactgcctcgacggcacgccgctgatcgacctcaagccggaccgctgcgccttcacgccgctcgccccgccgcagcccggcgatttcgagaccggaccggcatga

SEQ ID NO: 8264 - DNA, 411 bp, Methylobacterium sp.
gtgggcgctctcttctccatcctgccgatgctgatccagttcctcggcccggtgctcgacaaggccatcccggatgccgcgcagcgcgcgcaggtacaggccgatttccagaaggccgtgctggagaaccaggccgcgctcaacgcggcgatggccgacgtgatgaaggccgacgcaggctcggaatcctggctcgcccgctcggcccggccgatcgtggtcatctggtcgctggtgatgatcacgtggtgcggcgtcgttgcgccgatgctcggcgtccagaaggaggttttggccgcgctccaggccgtgccgtccgacctgtggtcgctcgcgagcgtcggcatcggcgccttcatgctcgcccgcaccgtcgagaaggtcgccccggcgatcgccacccgcaagtag

SEQ ID NO: 8265 - DNA, 1254 bp, Methylobacterium sp.
atggaacagaggacggccaaggggccgggatcggcgtcccgtttcgaaacgctcgacgcgctacggggcgtctgcgcgctcgcggtcgccttcttccacatgccgttcgcgcacccgctgcacggcgcgccgcgcttcgacaacgtgcaattctgcgtcgacgtgttcttcgtgctgtcgggcttcgtgctcctccacggctacggagggcggctggcgagcccgcgtcaagcgctgcgcttcatgctggcccggttcgggcgcctgtggccgctccacgccgcgacgctcgggctgctggtcgcgctggaggcggcgcgcctcgtctacctcacgggccatccgggcacgccggtggtgacgccgcccttcggcgcggcgcatcggccggtcgaggtgctcacccacctgctgttcctgcaggatttcctcaccttcggcgagttcagctggaacttcccgtcctggagcatcgcggtcgagttctacgcctcgctcgcactggcctgcaccgtgatgctggcggggccgcgggcgcgctggaccttcgcgggtctggccctgctcgccgccctcgccctgcacgcggcgagccccgggaccctgttcgcgatccaggactggggcatcctgcgctgcctgttcgatctgttcgtcggctgcctcgcctactgcctgcgcgacgcggcgcgcgtcccggaccgctgggcgggccgggccgaggccctggcgctcgcccttctcctcgcggtcgccaccctggttccgccgggagactgggcctacggggcgcccctcgtcttcggcgcggcgatcgcgctgttctcgcacggccgcgggaccgtctcggccgcggccaggcacgggctgccccagacgctcggccgctggtccttctcgatctacctgctccacctgccggtgctgcaggtcgtcctcaccgggctgcactacgcggtgccccgctcggcgggcctcgcgcccgacgcgggcgtcgatctcggcggctcgctcgtgaatctcgcggcggccctcggcatcgtcggcgccgccacgctcctggcggggctgagctaccgactcgtcgagcagccggcccgcgcccggttcaggatgtccgatccgcgaacccgcaccggtcggaccggccgcgtgtctcagattgagaaggcgtcgcccccgccggcctgcggggattggtcaccaatcggacagtatttctggagccgagcagtgttgcgtcgaccggagtga

SEQ ID NO: 8266 - DNA, 858 bp, Methylobacterium sp.
atgcgcgtcgtcgccattctcgccagccacaacgaagaggtctacgtccgggcctgcctggacacctacatcgcccagggcgtcgaggtgtacctgatcgacaacgactcgacggatcgcaccgtcgagatcgcccggacctatctgggccgcggcctgatcggcatcgagcggtttccgcgggcgggccagttcgagctgctgcccatgctccggcgcaaggaggagatcgccgacgcgatccgggccgactggtacatccacgccgacatggacgagatccgcctccccccgcgcgggcagggcacgctggcccgggcgctccgggaggtcgaccgggcgggctacaccacggtcaacttccgcaacttcctgttcatgcccccgcgggaagagcccgaccacttccacgcgcgcttcgtggagacgatgcgctggtaccgctacatggagccctcctacccgaaccaggtgaagggctggaagcggcagaagcacttcacgctcggagagcggctgcgccgccttctcttcgggctcgaggcccggccggggccccgcagcgtcgacctcgcgggcacgggcggccaccgcgtccacttccccggcgccacgctctgcccggacgacttcatcctgaagcactatccggtgctcagcctcgaccacgccgtgcgcaagtacgtggagaagacctacgcggagaccgaggtctcggtgggcttccacggctggaaggcgcgggccgccgcggtcgacctgcgcctgccctcggtcgcggagctgcgcgagttccggggcgacgccgcgctcgacatcgccgacccgatcacccgaacgctgatctacgccgcctga

SEQ ID NO: 8267 - DNA, 1623 bp, Methylobacterium sp.
atgaccctgcaccagcatgcggctcgcgccgcactcacgctcgctgccctttccctgaccacgccggctttcgccgcaccggggcagaccgccggcctcaacctgacggcgatcgtcctcttcctcgccttcgtgctgctcacgctctggatcacctggcaggctgcccagcgcaccaagtcgaccgatgatttctacgcggccggcggcaacatcacgggcttccagaacggccttgcgatcgcgggcgacgcgatgtcggcgggtgccttcctgggtcttacggcgcttgtgttcacctcaggcttcgacggtctgacctacgccatcggctacaccaccggcatgccgatcgtggtgttcctgctcgccgagcgcctgcgcaagcttgggcgctacaccttcaccgacgtggtgtgcacgcggctgtccgaggggccgatccggatctttgccgcctgcgcctcgctcgtcgtggtcgccttctacctcatcgcccagatggtcggcgccggtcagttgatccagctcctgttcggcctcgactacgcctacgccgtcttcctcgtgggcgtcttgatgatctgctacgtcatgttcggcggcatggtcgccaccacctgggtgcagatcatcaaggccggcctgctgctcgccggcgcgacgctgatcgtggtgctggtgctggtggcgttcgggttcgactacggggccctgctcgcccgggcgacggcggtccaccccaagggtgccgccatcctcgccccccaggccgcctcgcgggatccgctctcggccctctcgctcggtctcgcgctcatgctcggcaccgcaggtctaccgcacatcctgatgcgcttcttcaccgtgccggatgcccgggcggcccgcgtgtccgtgttctgggcggcgacgttcatgaactacttctacgccctggtcttcgtcctcggcttcggtgccctgaccctgaccgcggccaatccggactacgtcgatgcggccggtgcgctgcgcggcggcggcaacatggcggcgatccacctgagccacgcggtcggcggcaacgcgatgatgggcttcatctcggcggtggccttcgcgacgatcctggcggtggtcgccggcctgacgttggccggtgcctcggcggtcagccacgacctctatgcaggcgtgatccggcgcgggcagctcgacgagcggagcgaggtgcgcatctcacgcatcgcgaccttcgtcctcggcctggtcgcaatcggcctcgggctcgccttcaagggtcagaacgtcgcctacatgatcagcctcgccttctcggtcgcctgctcctcgaccttcccggtcctgctgctggccctctactggcgcggtctcaccacggcgggcgcggttgctggcggcacggtcggccttttgagcgccctcggcctgacactgctcggtccggcagtctgggtgaaggtgctgggcaatccggctccgatcttcgcgatggacccgcctacgctggtgacgctgccgctcgccttcgcgacctgttggctggtctcacgcctggatcgaagtgcacaggctgcgcgcgaccgtgcccgcttcgacctgcagcaggccgccacctga

SEQ ID NO: 8268 - DNA, 516 bp, Methylobacterium sp.
atgactgaacctgagcagatagcccggctgcgcatcagcctcgaaggcatcgagccggctatctggcggcaggttgaggtgccccttactgcgacgctaaaagccctgcacgacgtgatccaagcagcgttcgggtgggagggctaccacctccatcttttccaggtaggtgaggagcgctacggggcgcccgacccagagtgggagggtctgcggccgattcgcccggagaagggtatgcgcctcgctgtcctgatcgagcgtggggttacgagcttcacctacacctacaacttcggcgacgactggcggcacgagatcgtggtcgaggcggtcgaggcagcggacccggctcttgagtacccgcaccttgttgctggcgcgcggcgcgccccgcccgacgacgtcggcggcgtataccggctacgaggagttcgtccgcgcgatgacccggccaccccatcgggagcacaaggccatggtggcgtggcacggtggtccctacgatcctcatga

SEQ ID NO: 8269 - DNA, 276 bp, Methylobacterium sp.
atgcgcaacgatgccgaatctccgggatggtccccggacctgctgagcgcccaggcactgcgcgtgcaggacgccgccctgatcctcgcggacgaatgcgtccttctctcgctgggcgcgcagatggcgtggctcgatctctggatgcgcccgctcctccaggcaagcgctgagatgcaggtctggcaggagcggcaggccaggactgcgcggctgatgcggcggggcatacccggcccggtagcgcgcgaggggcttcacctgctgccgagctga

SEQ ID NO: 8270 - DNA, 2217 bp, Methylobacterium sp.
atgcagatgaacgccggatcttcgcggcggccctggcggattctcgcccggccggccgcacgccgtccgcgcgtggcgggagccttccgccggctggtgccggttctggcccgtctcacggcctgcctcgccctcggcgcccacggggccgcggcgcggaccatcttcgtgacgccgaccggcgccgggccgggctacgccgccgatggtcgcctcgtcgccgagcgcaccgagtccttctcgacggacacgatgcggacggtcctgccgggcgacgtggtgcaactgctgctcgacacgcccgatccggccgcgacgacggtctaccgcgcgcacgtcgtcctgtcccggaagacgagcctcgcgcccgccgcgatcgtgatccgcggcctcgggccccggacccggctggtcggccggagcgtcgagcaggtccgcgactgcccgatgccggaggacggcgccgagcgcgcctgcggcgatctctacagcgccctcgcggcggccgagacgccggatctgctcgcggcgctgttcggctcggccgccgtccgggccacgccgggcgagcgcgcggccggtgcccggcccgccatcccgatcggcaggaccgggcgactggccgaggcggcctgcctcgacctcgaccgggtcgacggggtcgtcgtcgaggacctgaccttccaggattgctggctggtggccgtgcgcgccctcggcagccggcgcgtgaccgtccgccgtgcgctggtcgtcggcggcagctacgggctggccgcgcgcgggcgccccggccagcccgccgaccacatcaccgtcgaggacgtgacgtgggtgcaggacgcgagcggctacgacgcggcgagcctgagccgcgaggggccgttccggtgccgggacggccgcgagacggcgttgggctgcccgggcctgatgtggcggagcatcccctggggcgtcagccatcacggcgtctacgagcacttcaacggcgcgctcctcgggggcgccgatctcgccggcccggtcgtcttccggcgcaacacggtcctgtccgcctataacgggatccgcctcaaggcgagcgcctgcgaggatctcccggcatcgagcctctccccggcgacctgcccgtacaatgccggcctctggatctccgagaacctgttctcgtacctccgcgacaacccggtcgagctggagacctgggcgaccgacgcgcatgtggcccgcaaccggatccacaacgcccacgcctggttctcgttcgacgacatggccggcggcccggtctacgtctacggcaaccgcggctggttcgacgacatgccggcgctcgcatggtcgggctcggcgcccggcggtgccccctgccgccgccggcccgtctcggctccgcccgatgcggcgggcttcgatccggttctcgaccgccggttcgactatctcaaggcgcgctggctcccggtcggcgtcgaggcggtcgacgcctccggccgggtccagcggatggatgtcgaggagcaatcctgcgaggcgagcgtcgcgggacgcgtcgtcaagctggcgctgccgccgcggggggcggccccggacacctaccgctacccgacgcgggggccgatccacctcttcaacaacagctggtacctgcgcgcgccggtcaccgggatcggcgcggccgccaacctccggcactggaacaacgccatcctgttctgcgagccgggcacgccgggctacgcgcccgaactctgcgaggcgcgccccgagacgttcgacgcggccgcgtgcgggcgggagttcgtccgggcggacggaatcggccgcttccccggtgcgcggggaagccttccgttcttcgattgcttccgatggctgcccgtggacgagcgcggacgggatctgccggaccttgccagcacgttcgaccacgacatcagcagcaacggcttcccgcagggtttcggcgggccggcgacgttcgagctccagggccggcagggcgatcccggcttccgcgcgcccgagcggggcgacttcaccctgctgcccggtgcgctggcgcggacctccgcctgccgcatcgaggaggccgacgacggacatctcgactgccggcccgtgccggccgacgccgccttcgccggagccgtcgcgcccgacggccgcctctacgagcccccggcctcgccccgcttccggcccccggactga

SEQ ID NO: 8271 - DNA, 1647 bp, Methylobacterium sp.
atgacggaaacgctgaaactcacggagttcgaggccctgagcccgttcgagatcaaggacgagctcatcaagctcgcgaaggcgacgtcgcggcgaacgcagtcggccttcctcaacgccgggcgcggcaacccgaactggatcgccaccgcgccgcgcgaggccttcttcctcctcgggcagttcgctctcaccgagagccggcgcgtgatgagccacccggccggcctcggcgggatgccccaggccggcggcatcgccgcgcgcctggagggctggctcgccgagcgtcccgacacccctggcgcgccgttcctgtcggccatggtcccctacgcggtgacgacattcggcttcgagcccgatgccttcgtgcacgagctcgtggattcgatcatcggcgacaactatccggtgcccgaccgcatgctggtccacaacgagcggatcgtgcacgaatacctgatgtgggcgatgtgcggcgggcagaagccggcgggccggttcgacctctacgcggtcgagggcggcacggcggcgatgtgctacctgttcaagtcgctcaaggcgaaccggctcctgatgcccggcgacacgatcgcgctcggcacgccgatcttcaccccctacctggagatgacgcacctcgaggactacgccctgaacgtcgtccacatcagggccccgcaggagaacaagttccagttcccggacgaggagatcgacaagcttctcgatccgaagatcaaggccttcttcctggtcaatcccggcaatcccaccggcatggcgctgagcggcgagacggtcgcgaagatcaccgagctcgtgcggaccaagcgtcccgacctgatgatcctcaccgacgacgtctacggcaccttcgtcgagggcttccgctccctgctgggcgagctgccgcggaacaccatcggggtgtactcctactccaagtatttcggctgcaccggatggcgtctcggcgtgatcgcgatccacgaggacaacatcttcgacgaggcgatcgccgccctgccggccgccgagacggcggccctcgaccggcgctacggccccctcacgctccagccgcgccagctcaagttcatcgaccgcatcgtcgccgacagccgcgacgtggcgctcaaccacacggccggcctctcgctgccgcagcaggtgatgatgagcctgttctccctggcggagctgatggacgagcggaaggcctatcaggccgcgtgcatggagatcgtccaccggcgggtctggtcgatgatcgagggcctcggcctccacctcacgccgaacccgaacttcgacgcctattacggcctcatcgacttcgagttctgggcgcggaagaacatcggcgacgaggcggtcgagtatctgaaggcgaacgtccatccgctcgacctcgccttccggctggccgaggtccacgggatcgtcctcctcaacggcggcggcttcgaggcgccgaactggtcgctgcgggtctccctcgcgaacctgccggacgaggtctacgacgatatcggccgcggcgtgcgggccgtcgcgcgcggctaccgggacgcctacgaggcgagcagacggacggcgcagacgcgggcggagatcgcggaagcgccggccgagtag

SEQ ID NO: 8272 - DNA, 300 bp, Methylobacterium sp.
atgaacacagccgtcttccgcgtctcacagatcgccatgccctgcgtcgggctgtggttcggcctgcgcacctacgcgtggctcagcgcgcatccggccgtctacgatccgctcagcgggtccgtcagcatcggcgtcgccgtctggctgctgggcggcgctctcgtcgtcgcgctctccgaggcgatcgcgaaggcctacgccgatgcccggcagacccgcacgcgtcccagcttctacgccatgctgatcgccgccgcctcgctcgcactcggcgtcctcagctatctcaccaagtga

SEQ ID NO: 8273 - DNA, 540 bp, Methylobacterium sp.
acggcgctgggcgacggcaagatcctgttcagcgccagcaccgcggcgaacggccaagagctgtgggtgacggacggcaccgacgcaggcaccaccctcctcaaggacatccgcactggctccggcagttccgccccgaccggcctcacggcactgagcgacggcaaggccgtgttccgggccactaccccaacgcatggcagcgaattgtgggtgacggacggcaccgccgcaggcaccaccctcctcaaggacatccgcactggctccggcagttccgccccgaccggcctcacggcactgagcgacggcaaggccgtgttccgggccactaccccaacgcatggcagcgaattgtgggtgacggacggcaccgccgcaggcaccaccctcctcaaggacatccgcactggctccgataacaatgtgatggccggtttcacggcactgggcaacggcaaggccctgttccgggccaccaccgcaacgaacggcaccgagttgtgggtgacggacggcaccgacgcaggcaccaccctc

SEQ ID NO: 8274 - DNA, 393 bp, Methylobacterium sp.
ggctttactacgctgggcaacggcaaggtcttgttcagcgcctacaacgcgacggacgggcgagatctgtgggtaacggacggcacagccgcaggcaccaccctcctcaaggacttcaatacagggtttgctcattcccagccaaccggcttcaccgcgctgggcgacggcagggtcgtgtttagcgccagtactgcgacaaacggccaagagctgtgggtgacggacggcaccgctgtaggcaccaccctcctcaaggatatcaacactggatctgacgactcccagccgaccggctttagggcgctgggcgacggcaggatcctgttcagcgccagcaccgcggcgaacggccaagagctgtgggtgacggacggcaccgacgcaggcacc

SEQ ID NO: 8275 - DNA, 1206 bp, Methylobacterium sp.
atgaccgatgccttcatctgcgacgcggtgcggacgccgttcggccgctacggcggcgccctcgccgacatccgggcggacgacctcgccgcggtcccgatccgggcgctcatggagcgcaatcccgcggtcgcgtggggggcgctcgacgacgtgatctacggctgcgccaatcaggcgggggaggacaaccgcaacgtcgcccgcatggccggcctcctggcgggcctgcccgtcgaggtgcccggggtgacggtcaaccgcctgtgcggctcgggcctcgacgcgctcggtgccgcggcgcgggcgatcaaggccggcgaggccgatctgctgatcgcgggcggcgtcgagagcatgacgcgcgcgcccttcgtggtcggcaaggcccggagcgccttcgcgcgcgacctgagcctgcaggacaccacgatgggctggcgcttcgtcaacccgcggatgaaggccctccacggcaccgacgcgatgccggagacggccgagaacgtcgccgaggattacggcgtgagccgcgccgaccaggacgccttcgcgctccgcagccagcggcgcgccgccgccgcgcaggcggcgggacggctggcggaggagatcgtgccggtcacgatcccgcgccggaagggtgagccgctcgtggtcgcgcgcgacgagcacctgcggccggacacgacgccggaggcgctcgcccggctcgggggggtggtaggccccgagggaagcgtgaccgcgggcaacgcctcggggatcaacgacggggcggccgcgctgctggtcgcgagcccggcggcggcggagcgccacggcctgcggccgcgcgcccgcatcgtcgccagcacggcggccggcgtcgctcccagggtgatgggcgtcggcccggtgccggccgtgcgcaagctccttgcgcgcaccggcctgagcctcgcgcagatggacgtgatcgagctcaacgaggccttcgcggcccaggcgctggcggtgacgcgcgaactcggcctgcccgacgacgcggcgcaggtgaacccggacggcggcgcgatcgcgctcggccatccgctcggtgccagcggggcccggctcgcgatcgcggcgctgcgccagctcgagcgcggcggcggccgctacggcctctgcaccatgtgcgtcggcgtcggtcagggcatcgcgctcatcgtcgagcgcgtctga

SEQ ID NO: 8276 - DNA, 2202 bp, Methylobacterium sp.
atgaacatcaatcctgctcctctccgtttccaggccggcatgcggccgagccctctcgcgttcgcggaccgccgatccaagacttggacgatcacgcaggtcgtcgatgcggcggtgcgcagacgccggaccgttgcgctcgtcacgctggcgtgtttcgcgatcgcggcagcctacgcaaaccttgcggcgccgacctatacctcgatggcaagtgtcgttctggacacgaagctgacgccgccatcgccgggtacggtatcctccgagacgacgattgatcccgccgtggtcgacagccaggtggagatcctgaaatccgacaagatcgctctcgatgttgtcgaccgcctgaatctcaccagggattcggagttcgtgggctcgaagccctcgttcgtccacgccctcatcggccgcatcatggcgctcttcgagccggacgcgggcggggccgtgcggacggacccgcgtcaagccgcggcggcagcgctcagccgcaaggtcaaggtcacccgggccggccgcagcatcttggccgagatcacggccacgagcttggatccggccaaggcggcggcggtcgcgaacgcggtcgccgaggcctacatccaggatcagctgagcagccggatggaggcgagccagcgcacgacggactggatgcagcggcgcctcgccgaggtccgcgaacggctcgatgccgcgaacgcggccctggccgcctaccgggccggcgaggacgacggcaagagcggcgtcggcggcacccgcgccgagcgtgaaggagcccgtgcgcgcgcggccgacgctctgacccgcgctcgggccgatctcgaccggagcgcgcagctccgcgccgccgtcgcgcagggcgatcccggcagcgagaccctcgaccagatcgatcggctcggcgatcccgcgctctcgaagctggtgaccgagcagcgcggggccgctccgggcgccgcagtgctccggacgctcggcgagcggctggacgcgcgcgtcgaggcccagcgcaaggcggtcgccgcagcggagctgcgcgcgacgctgctcgacaagcagattcaggatctccggtccgacggctcgagatccgacgttcccaggacggatgacggccgcgagcgcgcgctcgagcgcgccgcgcaggatgcccagggcaactacgaggcgctgcagaaccgggtgatgcgcgtgagcgccttcctgcagcagcaatcgatgccggtcacggaggcccgcatcgtcaccacggcgctgccgccgctctccaagagtgcgccgaaatcctcgctgatcctccttctcggcctgatcgggggcatcggtgcgggcgtcgcggcggccttcctgaaggatgccctcgaccggcgtgtacgctggtcgcggcagatcacgcacgagctcggccagccgtttctcggcaccctcgaggcctgcccgacccgcgcgcgcgagttccggcacgcggccgacggctcgccggggtccgaccgccgcctgcccgtccccctcttcatcgcgaacgggtccgggtcgcccgcggtcctggagaccttgtgcaccacgaaggtctccatcgatcaggccctgcaccgcgaaacctgccgcgtcgtcggcgtcatctcggccaacgcacaggagggtaagaccacgctggtcacgaacctcgccgtgctgctcgtcgagatgcgcgcccgggtcctcgtcatcgacgccaaccttcacggatcggggctcgccggtctcgtcgagggcgatcccggtccggggctcgcgcgggcggtcacggagcgccgcgctcttccggagtgcgtggtcgcgacgccgctcggcttccacctgctgcccggcagcgtcggcccggttccgaaccacccggtcgagatccttggctcggccgctctgcggcagctgctggccgaggcccgcgaccactacgactacgtgctcattgaggtcccgcccgtgctctcggccgtcgatgcgcgggtcgtctcggatctgatcgacgccttcgtgctggtggtgcggggcggccggaccaagcgcgacgaggtcgagcatgccttcacgacctgcccggccatcgccgaccgcatcgtcggcgtggtgatgaaccgcacgaagtccggcgagcgccccgcgccggcaagcgccgcaccgtcctacctgcagggagccgcctga

SEQ ID NO: 8277 - DNA, 930 bp, Methylobacterium sp.
atggacctcgcccagctccgcaccctcgtgcacgtggccgagctcggcagcctcagcaaggccgccggccgtctgcggatcgcccagccggcgctgagccggcagatccgcctgctggaggacgagctcggtgcgcgcctgttcgaccggcacggacgcggcatggtcatcaccgaggccggccgcgaggccctgcgccacgccaagcgggtgctcgccgagaccgaggagctgcgggccagcgtctcgggaccgggcgccgaactcaccggccacgtcgcggtcggcctgccgcccacactcgccgacatgatctcggtgccgctggtggcggccttcggcgccacgcatccgcgggtgcggctccagctcgtggcggcctatacgggctacctgctcgacagcctctaccgcggcgagatcgacctcgcggtgctctacgacccccgggcgccccgcagcctgcgcatccgcccgctgatgcaggaggccttgttcctgatcggcccgggcgatgccggcctcacggccgaggaaccggtgccgttccgggcgctcgccggccagcgcctcctcctgccgagtacccggcacgggctgcgcaacatggtagagcacttcgccgacgaggccggcatcgccctcgacatcgccctggagatcgacagctacacggcgctgaaggacctcgtgcgccagggctacgggcgcaccatcctgacgcgcgccccgatgcacgaggacatcgcggcgggccggctcaccgcggcgccgctggtcgaccccgccccgatccggcggctcgtcctctccttccagcccgaccggccggtctcgcgcgccgccgagttcgcgggcgcggcgatcgccgccatcatggcagagcagctcagccagggcgtctgggtcggcgagatgctggcggggtga

SEQ ID NO: 8278 - DNA, 312 bp, Methylobacterium sp.
gtgcgcacgctgatcggcccgatcgccgctgatgccgcgttcgccggcctccatcccgcccgcggccggcccgcttacgcaccctggcgcttggcccgcgtcccgctcctgcggttccgcgaaggcctcggcgaccgtcgggccgccgatgcggtccgggcgcggatcgcctggaagtacctgctcccgaccggctgcggagccgcgcccggcccgagtggcacgcgcgctacgctcgccgcatcgacgatgcgcgcccgggcatcgcgcgcagcatcccgatggccgcagcagcgcagcgacacgacctga

SEQ ID NO: 8279 - DNA, 1389 bp, Methylobacterium sp.
gtgtcgctctggctgcaggacctgagcgcactcaaggaccgcctggaggactggcgcgcggccggtatgaccgaccttcgcacgtggctgcgggaccctgagcacctgctcgccgttcagatgctgatccggatcgagcgcgtgaaccggcagacgctccggctctatgaagcccgcgacgaggcggagctgttcgctcacattccggcgatcttcgacgatccgcgcgcagacgccctggtcgaggtgttgtgccagctctgggcgggggcgacgcaggcccgcctcgtcacccgaaacaggaccgtcgccggccgcgttctcgacgtgagctacgcgggccggatgctgcccgggcacgaggcgagctgggcgcgtttcctgatctcggtcgaggacatcacccagcgcgaggagatgcgccgccgcgaggacgcgctggcgcgcttcgccgcgagcctgttcgagcgctcgcccgtgccgacgctggtgcgcgacgaatccgggctcgccgcgatgctggcggacctgcgcgcggccggcgtggtcgatctggcagcccacatggccgcgcatccggactggacggaggcggcccgcgcgagcctcgccctcgtcggcgcgaacgcgcccgcgctcgccctgttcggtgcggcggatggcgacgcgctcgcccatcacgtcgccgtgggcctcggtgcggaggcgcggcgggtcttcgccgaggaggcactggccctctgggccggggcgggccacggggtccgcgacgtcctcttccggcgcatcgacggcggtgcgctccacctcaaggcgcagtacgccgagcttccgggccagggcgacgggcgccgcctcgtgcagatcgcgctcacggatatcggtgcgaacaagcgcgccgaggcgcgcctggagaccctgagccacaccgattccctgacgggcctgctcaaccgcgcggcctacgcggcgcatctcgaacggctggaggccgagcggatcgtgccgacctccgtgatcgtcgccgacttgaacgggctgaaggccgtcaacgaccgccgcggccatgatgcgggcgacgcgctgatccgccgcttcggtcgcgtcctggcggccaggacgccggcctcggcccacgcggcgcggatcggcggcgacgagttcgcggtcctgctgccgggcaccggcgccgagggcgctgccgcgctggccttgcggatcgccgaggggatcgagcgggcgaacggcggcgccgacatcccgctcggcgtctcgctcgggatcggcacctggaccggcgagggtccgctgaaggcggcggtcacccgggcggacgcgcggatgtacgcggccaagcgcggccgccgcggccgggtccgggtagcctga

SEQ ID NO: 8280 - DNA, 795 bp, Methylobacterium sp.
atgcagaccgtgaaccgcctcgtgctcctcgcgctccagatcggcgttggcctcgtcggcctcggcatctggcacgtcctgaccgtctaccccattctgggcgagacgcggcagatccagttcttcttctcgacaccgggcgccgtgctctcccgcgcctggtccgagatgctgacgcccgagatctggggccatctctggatcaccctgcaggagaccgtgctggccttcgtgttcggggcggccggcggcatcgccttcggcttcctgttcgccaggaacgcgctgctcgccgccgtgttcgacccctacatcaaggcggccaacgccctgccccgcgtggtgctggcgccgatcttcgcgctgtggttcggcctcggcatctggtcgaaggtggcgctcggcttcacgctcgtgttcttcatcgtgttcttcaacgtctaccagggcgtgcgcgaggtgagcccggtggtgctgaacaacgcccgcatgctcgggatgagcgagcgcggcctcctgcggcacgtctactggccctcggcgctgacctggatgttctcctcgcttcacaccgcggtcggcttcgcgctcgtcggcgcggtggtgggcgagtatctcggctcgtcggcgggcctcggctacaagatccacgaggccgagagcgtgttcgacgtcaccggcgtcttcgccggcatgctgatcctcaccgtcttcgtcatcgtgatcgacgcgctcgtcacgctgatcgagaatcgtctcctcgtctggcgcccgcaggcgggcaaccacggctga

SEQ ID NO: 8281 - DNA, 255 bp, Methylobacterium sp.
atgtcggatgaaattaccttggttgctgagcagtgccgcgccgcccgggccctcatcgggtggtcgcgcggggagctgtcggagcgctgcggcgtggccgcctcgacgctggcagacttcgaggcgggcaagcgcgcgccctatccccgtacgctggccgatgtgcgccggaccctggaggaggctggcgtcgccttcatccaggccagcgtggacgggggcgcgggggtcaggctcaaggccggcgtcgcctaa

SEQ ID NO: 8282 - DNA, 1185 bp, Methylobacterium sp.
atgacgctcgaagaagctctcaaggttgcttctgattttatcgaggcccaggaccccgggaatgctctgaatctctatcagcagattgcgaatcgcatcccgacgcatgtcgaggcgcggctgggcatggcgaaggcctttctgttgcaggacaagtcgttgcaggcgaaatcgaccatcctcaacgtcgcgatcggcaacgctaccgacgccgccgtcctgtcggattgtgcgggcatcctcgaggcgagcggcttccatgacgaagcggccgccgtccgccagttgctcgtggacctcggcaacaacgtgagccggatcctgaatctcctgagcgacgacctgtccatgatcgacctcggatcgtccgggcaggccgtcattcaggctcccaactggatcgcgccgaggatcgccttcacctccctcgatgcgctttccgtcggcagcaaccattctcgtttcggagcctatcaccccgtgcgcgaggtgatcgccccggaggccggacccgctgtgtttcacgagcgcgcgttcctgccctgttcgtctctcctggacatcgaccatgagacgttcagggcgttcggccttcaggatctgagtgcgatcgtgaagtctcatgaggtcgtcgccacgaccctcgccgatgtccttcgcgacgcacggatagaccggatcgactatatcaagaccgacctcgaagggatggacgagagagtcgtccggagcgccgaaagcttggtcgccggcgccgccgtcgttcagatggagcttcgcttcctgccgctgttcgagggtgagccctacctcgatgagactgtcgcctacatgcgcggtcgagggttcgaggtgctgcatctcagcacggagacctggcgctacaacacggagcaccgagattatacgcaaagaggtagatcaatatttgcagacacgacattcatcaagaatttcgaggcgtactctctcattcatggcaagagcgatgagactgtggtgaggtattgcctcatttgcctgctgtccggaaatgtgaattacgccgagtacgtcatcgaaacacatggcgccctcgtcgacccgagcgtgagatccgcgttgaagttcctgatcttcccgctgggcaacgcgcagcccgcaccgtaccggcgcgagtccctcgcgcatgtcggcttcagctag

SEQ ID NO: 8283 - DNA, 315 bp, Methylobacterium sp.
atggtcgaggacgatatcttccgggcgctggccgatcccacccgccgtacgatcttcgagaagctcgcgggcggccgcatgaacgccagcgcgctccgcgagggcatggcgatcagccagcccgcgatgtcccagcacctcgcggtgctgcgcggcgccgggctcgtgcgcgaggcgcggcagggccgcttcgtgaactacgacgtcgatcccgaaggggtggcgctcatcgcgcagtggctggcgaagtaccgcgcctactggcccgcccgcgtcgacgcgctcaaggccgtgctgaaggagatggaccagtga

SEQ ID NO: 8284 - DNA, 2433 bp, Methylobacterium sp.
atgagtgaggtgctctcgtttccgcctcccgctgcggcggcccggcgcggctggtcgcagcaggaactcgcggaattctaccgggtcgaggccgcgctggtccgggccgggctgccgatcgacagcgagcagggtctcagcgacgaggcggagccgtggttcgtcttctgccgtccggacggtgcgcccatcatgcatttcgcgcggatcggcgggcgctacctggttgcctccgaggtgctggacagccccctgtggggcgacgatttccgcggccttatcaaccaagtggcgctgcgccatcccgagcttctgccgatccggcagggtggcgacggtacgcgggtcaccgtccatccggccgccctgctcgcggcgctggtggctgccgcgaccgtgatcctgtcatccgaggatgccgaggccgccgtgttgggcaacgccgcggcgcccgtgcccgccggccaactcgaacaggctcccccgccgcgtacgggaggctctgccggtccggccgaggcggaagagcgggacagccatcgcatgcagttcgaggcgctcgtcgtctcggccatgatctttgctgcctttgcggcggaggaggcggagtcgagagccgggctggagtcgctcgccgatccgcaggtgcgcaccgcgacgcagcaggatgccccggctgatgctgggtcgtcagcgtcgctggacggtgcggtccacaggtccggcccgggcacgcagcaggcgcagggaacggccggcgcggttcccgctggctccggctcggccgcacaaccgggtgcggccgccggtgtccgccccgtgggcgccgaggtcgggccggacggccccgaaagggcggcgcccgcgcccggcggctcgctcgcggcggcggagccgaacggccatgtcgtcctccggcccggcgaggcggggccggcccgggccgcgggatcgcctgcatccgtcgagcctggcccggagcggagcgcggcatcgtccagcgccgccagcttgggggacgcggcgggctccccgcgcgcgggcgcggacgacaccgctgtgcagagccagccgcggagcgtcgcgcatccggtccaggacgcggtctcgggcgggacggctcggatcgagcgcgtccttcaccgcgatgcggacaagggtgcgaccgaggccgatgaggcgggccgcggagcggccaagggtatcgagggggagaagggtatccgaggggagaagggtaccgaaggagcgaagatcgcaggcgatggccacgctgggagggggcccgcggagcgcccgggcgagtcctccggcaaatcggatccgggccgccgggacagcgacgacgatctcgaccggggcggcgacagaggtgacgaccatggcggtccggcggcggcccgcgggcagcacgctgtggcgtcggccgatgcgcccacggcggagccggatgccatctcccaggacggtcgcggcgattcccgacccgccaacggcagcgacaaatccgatccgagcgagcatggctccgggaaaccaggcgcctcggcggagtccgcatccgcgtcgcaccccgcgacgcaggcgtccgagacccaccccgcacagggcgccgagccatcgggcaaggccgcgggcggggccgagcagtcctccgggcacggcgcggacgcacccggttccggcgagcatggctcggagaaggcagccgctgcctccgcggcgcacgcggagggcggaccaagcgcggcgacccattcgccgtcttccgggtccggacgcgacggcaatgttcccagccagcacggcgaggacaagctcgctccggccgggcagggcgaggcgcgaccgggtgcttcgggcgaagctgcatccgcctcacacccgcacggcgaaccgacccatgcggacgaagccccgagcgccggggcgcatgggcgcggctctcacggacccggccagacgaccggcctcggcacggacagcgcggctccggatccgcgcgacgccgcgggcaaatccgcagccgcctcccatctcgcggaccgacctctcgacgtgaaccgaaagccggacgccgggaatttggagaccgatgccggacacggccgggccgccgatggcgccgtgctcgctcagcagccggatcctgcggtgcacgcccccgctgcgtcgcatcagaccccgccacagaccgacgacggatcggtgcagactcgaaacgctggcgcggcctctgctcagggcccgggaaaggcgctcgcggcgagcgtcgatgcgcacggcaacatcgtgttcccatccgatcccgggcatgactcagctccggcaccgggccacgtgcaggtgtacgatggcgcgcacgccgaggtcggtctggtcgggctggcggaccatcccgggcagatgtatcacctcgatctccacgggtga

SEQ ID NO: 8285 - DNA, 411 bp, Methylobacterium sp.
atggatgagagcgaaatacacacgctcgccttcctgctggatttcgacggccgagtgcactggtacgagcagggctacttcgtgaagttcgagatcaagcggatcgaaccgacgaaggaacggcctcacgggctgcgctactcgttcacgctacatgcgccggaaggcgagcggatgatgggcttcgacaatgcccataccattgcgccgggaagccggtatgcgaaacgccaggtggaggcggaccactggcaccgcgacgaaaccgatcggggccggccttatacgttcacggacgcggcgaccctggtcggcgacttcttcggggaggtcgaacggattttgacggagcgcggcgtcccgctcgacgccgtgagagaagggaccattgaagaaaggaccaagccatga

SEQ ID NO: 8286 - DNA, 852 bp, Methylobacterium sp.
gtgatttgcgacctgtggagcgagggctgcaatgccgccgccgtgttggacctgatcggcaagggcgcgcacatcaggacggtcgagggcttccacgccaaaacctacctgtattcggaccgggttgtgctgggctcggcgaacgcatcgcggggcggtttgggcgccgagagcgagccgtcgacccggacggaaactgcgctgtggtgcgacgatgccgctgtgctggaagaggcgtccagctggttcgaaaccacttggctgcggggcacgcctgtcgatgctgtgatggtggaggcggcgcgcgacgaactcgcggccatcagagacgcccggcgcatatcgctcctgcacacgctagcgcatgagccaaagccgttcgacggcctcgacgtttatgtcacgctctatgaggatgaaggcgtcagcgaggaagcggagcaaacctgggacgtcgttcgaggcaagtatggcgccgatgatcgggctgcctatgaggcgcgcggcgaatggccgttctatgaggtcgcaggcgaccagctcgaaaactgccctgaaggcaggatctacctcgacttcacccgcgggaagaagggcaagctgaccttcaacggcatctggaaagtgcgcacaggcggccacgagccggttggcgacacgggtcgtttccttgtcctgctcgaccgcctgccgagcatacacgggcgccggatcatcgatgctgagatgaaggcgttcgctgctgccctggcaagcatttcatcggaggatcgggcagtcagttcgaaggagatccgggaggctgcccgccaagcttttcaggctgccgccaagcagccctctggcaagtaa

SEQ ID NO: 8287 - DNA, 516 bp, Methylobacterium sp.
atgatctacgtcgcgccggaggttcacagggccgtcaggcagatcgccctggacgaggatagatctacgagcgagatctacgtcgaggccgcacgagccttccttgcccatcggggagttgctctccaggggcatccagtacccgcagctaaggtcgagcccgaaccatcacgtcccattattgctccgtccgtgacgacggatgacatcgccggtctcatggatgcgctcgcacatcggatcgaagcggtccttgagcgcgcggtcgaacgggtcgggtccccttccaaggacgacccgtcaccgccggctgggatcaggacggcagatgccatgacagccgtcctccggatgctgcgggaagccggttcggatggcatcggcagcgccgagctggatcaggccttgcacgcggcccgcattcggtcagggaccgcagagcaggccaaggcggttctgcgggacgctggtttggcgcgctacgaaaggcgtcgctggtactcggcgagcggctga

SEQ ID NO: 8288 - DNA, 783 bp, Methylobacterium sp.
atgacgcagattcctgacggcaccgccctgcgcggcaagcgcgccctggtgctgggcgtggcgaacgagcactccatcgcctacggttgtgcccggatcttccaccggctcggggcggaggtcgccctgacctacctgaacgagaaggccaagccttatgtcgagccccttgcgcgcgcgctcgacgctccgatcctgctaccctgcgatgtgcagcgcgagggggatctcgacgcggtattccaacacctcgccgagacctggggccgactcgacatcgcgctccactcgatcgctttcgctcccaaggtggacctgcagggccgcctcgtcgacagctcgctcgctggtttcggcctcgccatggacgtgtcctgccactccttcatccgcatggcccgcctcgccgagcccctgatgacggaaggcggcactctgctgaccatgagctatcatggcgccgagaaggtcgtgccgaactacaacctgatgggtccggtgaaggcggcgctcgaatgtgcagtgcgctacctcgcctacgagctcggcccgagcgacatccgcgtccacgcggtctcgcccgggcccctgaagacgcgcgccgcctcggggctgaaggatttcgacaccctactcagcgaggcggtcgagcgctcgcccatcggcgagctcgtcgatatcgacgatgtcggcctcaccgcggcgttcctcaccacgccctacgccgcgagactgaccgggatgaccgtccatgtggacggcggcctcagcatcatggcctaa

SEQ ID NO: 8289 - DNA, 327 bp, Methylobacterium sp.
atggcctcgcagctctccctccccatgccgacgcccggcgtcacgtccgaggacgaggctctcgtgcgggccttcgttgccgacatcctgcctcgggacgtgccgacgtacgtgaggcgcgtgctcggggttgcctcggacaggtacggattcgtcgcccggatcgagcttccggacggcggctggtgcgacgtgaccatcaccggccgcctcggcgaggggggttacgcatggtccttccccgacgggggagcgccgttcggctgggacgaacgccgtcggaagtgggtccgctacccgaagctgaagaaggcggacgacgggtag

SEQ ID NO: 8290 - DNA, 1092 bp, Methylobacterium sp.
atgcgaccgctgcggtttcgccggagcgtggtgcgtgacctgcgcaaccgcatccgcttcgcgctcgtcggcctgctgatcttgatcggcctgcacgtcgcctcaatggtcgccttcgagcacctcagcctcggcgaggcgatctggctgaccttcaccaccatcaccacgaccggctacggcgacttctcggccaagacgacggcagggcgcgccgccaccatcgtgctgatctacctctcgggcatcttcctgttgacgcaggcaggcagcgccttcttcgaattcaggatcctgcggcgcgagcgcaagcggcggggcgagtggaggtgggatatgcgcgaccacatcgtcttcgtgaacgcccccgcggacgagcccggcgactaccttcggcggctcctcgaccagttgcaccgctcgcacgccaactacgccagcgtaccctccctcatcctgacggaagccttccctgacgggctgccgccggatctcgaggacgacccgctcatcgttcagctaaagggccgcttcgacgaccccgcggcgctcgaggcggcaggtgtcgatcaggctcgtgtgctggtcatcctggccgagcaggaaggcgaccggctctccgacagccgcaccttcgacatcatccaccgcctacgggagcgcggcatcactgcccgcatcgtcgcggaatgcgtggacgacctcaaccgcgagcgcctgaagcgtgcgggcgcgtccgccatcgtgcgcccactgcgcggctaccccgagatgatcgtccgtgccatcgtcgcgcccgggaccgaatggatcatcgagcggctgttctccagtgagggcgacgagtgcctccgcttcgacgtgaaggtggatggcctgacgtggtcccggatcgtgccggccgtgctcgaggcgaacttcggaacccctgtcggctatgcggatgcccagggccagccgcacagcaatcccccgccagacaccacgatctcggccgaggcgctcttcattctcgtggacgagacacaaaagccgactgccgcggcattgcaaaaactgcttagcggtttggcaacgccgcacgtgggatag

SEQ ID NO: 8291 - DNA, 165 bp, Methylobacterium sp.
gtgaccgccgtgaccgcccggcaggcatgggctcgcgccgcgaccgaggacgagatcctcgccgccgggatctcgctccccgtcgccctggtgggcgccgatctgctcgcggccatccgggccgaggcggccgaggacgccgccgccgcgcccgaggcagcctga

SEQ ID NO: 8292 - DNA, 201 bp, Methylobacterium sp.
ttgccggaatgcctgacccgcttcctcgacatgccgctccccggcgcaccggcgcccgcggcaccgccacgggtggtgcagccacgggcggtatcgcgccgacacccgaatcgggcgctgcgcggcacgctcgtctgggccctgctctacaacctgatcgggttcacggtcatcgccatgctctggcaggcgatgccctga

SEQ ID NO: 8293 - DNA, 288 bp, Methylobacterium sp.
atgacgcgtccgtttctgtcgacaaccgccgttctggtgctcgcagccagcctcggcgcctgcgcctccaagcgcctcgacgccccgcgaacccgcgggccccaggccgccctcgacacctcggtgccggcggtcccctcgggcgccgtgaccacgagcccgctcgcccccccgccgggcgtcgccgcggcgccggacgagccggtcgccgcccccggcacgcaggtcgcggccgccgcgccgcccgcctcgaacgtcatcccggagcccttggcgtcccaggtgccg

SEQ ID NO: 8294 - DNA, 852 bp, Methylobacterium sp.
ttgcaggcgacgggcttcgctccggccctcgtgctcgccagacgggacgagcgccacgaggtcgtgctcaccgcaccgaaccggaaccagccctacgaacaggctgcgctggccgaggcgcgtgagcatctccggctcagcctcggcctcggacagacacgcttcgggctgcgcatcgacgctgccgatcgcccgcgtaccgctctgcccggtgtcgagcatcacgccccctggatctacgcgcagatcctgactgcgacgggggcgacctgcgagcggctgggccgtctcatctcgcacttcatcggtgtgttcgcccggcgtttcgggctcggtccgggctcgcgcctcggtcgcggtgcggaaccggacgacggcgcgccgcacaccgacgcgccgctgtactgggcccaccgcgccgacctgctggcgcgctggcaggggcgttggcccgatccctcgcgggtcgacgcgctgattgcccgccgcctgcgcagcaccgggcacagcgaagctgcaatcgccgccctcgtctccgcctgtgcgccgggagtgccgcgcatcggccgtcgggtctggaccggctatggccggcgcgcggcggcccatgccttccgcgacgaagccgacagctgctgggcgttcgaccgagcgacacccgcgatgtgggccgagctggaacaggccgtgaaggcacgcgagctgccggacaagccaaagccaataccctcgcctgtaccgccgttcgtcggaccggtgcctctctcaccgaggaacgaagccaagttgggtacgacacgcaggagatcgaggaacggccgtggtgatccggacggcccgggggagcggtga

SEQ ID NO: 8295 - DNA, 714 bp, Methylobacterium sp.
atgacgagcgctcaatccgccccccggcccgatcctgacccagccgggcaggcgccaccaccgggcgcctcggccttcctcaccgagcttcgggaccggatcggcaccgaggtcggtatctcggcctggatccttgtggatcaggcccggatcgaccgattcgccgaggcaacgggggaccgccagttcgtgcatgtcgatccgctgcgcgccgcggccgagacgcccttcggcggcacggtggcccacggctacctcaccctgtcgatgctcggcgggaccgtcggagaggtccttccggcgcatccgtccgtgcgggcagtgctgaacatggccgccgacaaggtgcgattccttgcccccgtacgggtggacacgcgcatccgctcggtcttcaccctcaccggggtgagcgcgctgccggagggtaaggcggcgctgcggctcggcgccgcggtgcaggccgagggcgatgcgggccggtcggtccttaccgccgagctgacgctgatgctccttctcgaagaggcggcgcgggaaacgcccggctcctctgaccggcctgccgtccccgaccggcctgttgccggtccggacgggaatctgcctgcgcctcaacgttcgccaattcggaaccaccagaccccggaatgccacaccgccagcgggtctcgagacggcgacccggagtcgatgccgcccctgcgtcgctga

SEQ ID NO: 8296 - DNA, 462 bp, Methylobacterium sp.
atgcagcgtttcgtcagggccaagctgcacggcatccgggtgacgggtgccgacctcaactatcacggctcgatcaccctcgacgccgacctctgccgagaggccgggctcgacccgctcgaattcgtcgagatctggaacaagatgtcgggtgcgcggatcagcacctacgtgctgtacggcccggccggttccggctgctgcgtgctgaacggggcggccgcgcgcacctgccaggtcggcgacgaggtgatcatcgcctccgccagctacggcagcgtggacgacgtgatcggccacaagccgcgggtgctgatcttcggcgagggcaaccgggtggtggaccgggtggtctacgacgtgttccgcgacgaccagggccgcctcgacatgcggatcatcgaggcggagaccggtgcggaggagccgccgcgggtagcgacgcagatccgggtggtctaa

SEQ ID NO: 8297 - DNA, 1551 bp, Methylobacterium sp.
atggcacatagctggaagcgtgaccgggcggccgaacacatcgccgccaagatcaaggatgtgaagaaggtcgagatcgtcgacttcaagcgcgagatgtcgctcggaaacatccccacggcgaaggcctatcggatggaggccgtgcatatctacgcggacatcctgaacctcgacgacatgctgaactgcacgtcgagcgagggggagacgtgccacaagcgaacgctccgattccttgacctgcacggtcgaagcgtgcgccgcatcctcaacaggacggatgcgctgcgcgtcgatttccataaccagcggctgcacgccgtcgtccacaagccctacgacagcgacgacgaggacggcagcgccgaggctcggaggctgcatcgcgctgtggccatcgcccagctcgtcatcgacgtctgcgcagccaccggcgacgacgacgagtacgtgcccgccgccagggtcagggttgggatcgacagcggtctcgccctcgtcgtgaacaacggccgcaatggtggtcgtgagcccctgttcctgggggatccggcgaaccatgccgcgaagttctcggcggcggggtccgcggtcggcatatatctgacgaacaatgcccggcgcgcgataggcctgccggaggtcaaggagccgtccaagaccaagttgaccgccagcgaggtcgctctatcgcaggccgacgccgagctcggcctcgacgtcgaggacctcgcggaggaatggcgcgccgacctcgccaagaacccgctctccaactacggcttctcgcgccacacgccgccgttgcgaaccattgatatcagcgtcctgacgccctccaactcgcggcgccaggaggccgtctccgtctatgccgacatcgatggcttcacggcctatgtggcccgccacctggaagcgggaacgtcggaggatgtcgtgcgcgccctgcacgtcattcgcgccgaactcgaccgggtgctgggcgtcgacttcgagggccgccgggtccgtttcatcggcgactgcgtccacggcctactgtgcgaaggaacggcgcagacgaccgacgacgaggagaccgtgagcacggccgtactgtgcgccgggggccttcggagcagcttcgagctcgccctggagaagctcgacgaggagggggtcgacgtggaaaagctcgggcttgcgataggcatcgagttcggcccgatgaccctgacgcggctcggcgcccatggggaccgcttgcgatgctcggtgagccgcggcgtactggcgtcggaggccgaacagaagcgttgcacgggcacgcagacggcaatcgggcaggtcgcatacgacaccgggacgcaagccgtcagggacctgttcggcccgtcccggcgcttcgacggcctcgattacaacgaggcggtggagggacttgcggccgacggcgaccagaccgccaaggccatcaaggccgaggcgttcgccgccgccgcgccggcggtcaaaagggcttcggatcaagtggtcacaccctacgtcgaggttggtggggaatga

SEQ ID NO: 8298 - DNA, 510 bp, Methylobacterium sp.
atgaatatgatcatcaagggcaccgtcatcggcatcgggtcgaccgtcctcggggacgtccgaacgaacccctcggggcgtgagatctgggtcggggtgcggatcaggaccgaggacggcaagtcccgtttcctcaagggcatgctcgtcgaggcggaagccgcgctcatcatcaacgaggcggtggaccgcggcgagtcggtcgaactctggctgagcggcaagcccgagcgggcatatccctacgcggtcaggaccgcgcgggagggctggtactacgacgggtacagcgactacctgcgcgggcaggggcttaagacgttgggcatcggcatcctgatgctcccgctcctcggcatcggcatactgatgatgatcggttccatcgggtacttcatcgcgtcgaaccagttcgctgcccagcgttcccgggcggcgttcgagcgcggttacgaggctgcggtttcctcatccggctcgaacgaaggcggccgcctccaggcagcttag

SEQ ID NO: 8299 - DNA, 651 bp, Methylobacterium sp.
gtgaaacttcttctggtcgacgaccacgctctgttccgggatgccgtccgacgggtcctgcaggccggctttcccgaagccctgatcgaggatgcggactcgatcgaggccgctaccgccgcgctcggccataggcccggtacggatctcgtcatcctcgacttgtcgatggatggaatccgcgggttcgagggcttcatggcaatccgggcccgattcccgcggatcccgatcctgatctgttctgggctgcaggaggcccctatcatccgcgaggcgctggcgctcggggcggccggcttcgtaccgaagacgtcgaaccgtgccgcttatctcgaagcggtcgcgcgcgcactggaaggcgagatcttcgtccccgacagcgtggctgccgcccccagcgctggtccgagatcggcctctgcggcctccgcccggatgtttaccctgtcccacgcgcagatgaacgtgctgatcctgatcaaacagggcctcagtaacaaggagatcgcgctctgcctcggcatcggcatgtcgatggtgaagacgcacgcaaccgagattatgaggaagctcggcgtccgcagccggacccaggcagtcatcttcgcatccgccctcgacttcgagcgcatcggcacgggcggatga

SEQ ID NO: 8300 - DNA, 213 bp, Methylobacterium sp.
atgtcctgccgccatcagcccgacgcacccaggcccggctccctgcaggacgcgccctccttcgcgcgcaaatggcgccgcttccccagcgcgctgcccccggcctgcaacgacaatcatcggcccggccggctgcgcgcggcgctgctcgccggatccggcatcgccggcctgctggtcggtctggtggccgtcgcggcggccctgatctga

SEQ ID NO: 8301 - DNA, 1050 bp, Methylobacterium sp.
gtgctcgcggccaagctcgcggcggtgcgccaccatcagggtcgcctgctcggccggatggaggcgctcggcctcgcgctggagagcgaggcggtcttccaaaccctggtgaaggacgcgctcaagacgagcgagatcgagggtgagatcctcgatcaggcgcaggtgcgctcatcgctcgcccggcgcctcgggctcgaccgcgccgggatggtgcccgtcgagcgaccggtcgatggcttggtggcgatgctcctcgacgcgaccacgggtttcgccgcgccgctgaccgaggaacggctgttccgctggcacgccggcctgtttccggacggtggccacggccgccgcgagttcaccgtcggcggctggcgcaccgacaggctgggcgccatggaggtcgtctcggggccgctcgggcgggagcgcgtccattttcgcgcgccacccgccgagcgggtgcccggtgagatcgcggctttcctggcgtggttcgagacggacgatcccggcctcgaccccgtcctcaaggccgcggtcgcgcatatctggttcgtgacgatccacccgttcgacgacggcaacgggcgcatcgcccgcgccatcgccgatctggcgctcgcccgctccgagggcacgggccggcgcttctacagcatgtcggcgcggctgcgggtggagcgggcgcagtactacgagacgctggagaccacgcagaagggcgatctcgacgtcacgacgcggctcgcatggttcctcgacgtgctcgacgccgccctcaccgatgcggagacgacgctctctgccgtgatccgcaacgcgaagacctgggaaacgctgacgacgcgggcgctcaacgagcgccagacccggatggtcaaccgtctgctcgacggcttcgagggcaagctgacatcctcgaaatgggccaagatcgcgaagtgctcgcaggacacggcgctgcgcgacatcgaggcgctcatcgccgccggcattctcgtcaaggagccgggcggcggacggagcacgagctacgcgctcgcgctctga

SEQ ID NO: 8302 - DNA, 774 bp, Methylobacterium sp.
atgagcggccaggttcactacaccgtcgagaacggcgtcggcgcggtcgtgttcgaccggcccgaggcgcgcaacgccatgacctgggccatgtacgacgcgctcgggcagatctgcgagcgcatcgcccgtgaaggcaatgtccgggtcgtcaccttccgcggcgcggggggcgaggccttcgtggccggcaccgacatcgagcagttccgcggcttcgagaccggacaggacgggctggactacgaggcggtgatcgaccggcgcatcggccagatcgagcgcctgcccgtgccgaccgtcgccgtcgtggacgggtgggcgatcggcggcggcttggccatcacggcggcctgcgatttccgcatcgccacgccctcggccaagttcggcatcccgatcgcgcgcacgctcggcaactgcctgtcgatcgccaacgtcgcccgcatcgtcgccgccatcggcgtcgcgcgcgccaagcgcatgctgatgctcgccgaggtgctgagcgcggaggaggcgaaggcggcgggtttcgtcgccgagatcgccgagccggacgtgctggacgagcgcgtcggcgtgatggtctccaagctcctcgccaacgcgcccgtcacgatgcgcgtcgtcaaggagggcatccggcgcgtggtcggcgagggcctgccggacggcgacgatctcgtcgcggaatgctacggcagccgcgacttcaggatcggggtcgaggcgttcctctccaagcagaagcccttgtggacgggttcctga

SEQ ID NO: 8303 - DNA, 933 bp, Methylobacterium sp.
atgaccgaaaccctggtcttcgcgagcgccgtcgacccggtcgagccctggcgcgaggcattggaggggctcctgccggacatccgcgtccgcacgcccgaggagatcggaccgcaggacgatgtccgctacgcgctggtctggaaaccgcccaccggcttcttcgcccgtcatccgggcctgcggctcgtcaccatcctgggcgcgggcgccgacgcgctcgtggggcgtgacgacctgccggcggtgccggtggcgcgcctgtccgaccccgagatggcgcggatgatgacacactacgtgctgttcgcagtgctgcgctacgcgcgcaacatcccggccttcgaggcggcccagcgggccggccgctggcactacgtccatccccgcgaggcccgggagatccgggtgggcgtgctgggcctgggcgaactcggcagcgcggcggcgctcgaactcgcgcgtcaggggttctccgtcgccggctggtcgcgcacaccgaaagcgcttccggggatcgactgccaggcaggtccggacgcgctgatcccgtttctcgcccggagcgagatcctggtggtgatgctgccgctgacgccccagacccggcgcctgattggggcggccgagatcgccgcgctgccgcggggcgccgcgctcatcaacgtctcgcgcggggcggtcatcgacgaagcggcccttgtggcggccctgcgatccggccacctcggtggcgccacgctcgacgtgttcgagactgagccgctcgcggaggggcacgccctgtgggggatggagaacgttctcgtcacgccgcacttggcctcggtggcgattcccgcctccgctgcccggcagatcgccgagaacatccaccgggtgcggacaggacacgcaccggagcaccgcgtggatctgagccggggatactga

SEQ ID NO: 8304 - DNA, 456 bp, Methylobacterium sp.
atgaccgctccgatcccgatcctcttcctgaacggcccgaacgccaacctgtacgggctcgacccgagcggcacctacgggacggagagcttcccggtgctgaaggcgcggtgcgagcggcacgccgagaccgtccgcgtagccctcgacttccggcagtcgaaccacgagggtgtcctcgtcgactggatccaggaggcccgggggacggccgcgggcctcgccatcaacgcggccgggctcacctacacctccgtggcgatcctcgacgcgctgctggcctttccgggacccatcgtcgaggtgcacatgagcaacatctggaaacgggagcccttccggcaccattcctacgtctcgcgggcggcgaccggcgtcgtcgccggtctcggtggcctcggctacgaactcgcggtcacggccctcgcgaggctcgtgcgggagacccggccatga

SEQ ID NO: 8305 - DNA, 1125 bp, Methylobacterium sp.
atgaacgcgcaaacctccgtccccggctcctcctcgcccctcggcccgggagacctgttcccgcaggtcgcgccccgcacgcaagggcgtccgagcttcgccatcgacaccctggcgggccgctacatcgtgctctgcttcttcggctccgccgccgatccgcagggggccgcagccctcgggacggccctgcgggagcgcgcgcgcttcgacgattcccgcgcgagcttcttcggcgtcagcatcgaccccgcggacgaggccgagggccgggtccgggacctgatgccgggcttccggatcgtgctcgacttcgacggcgcgctgagccggcgctgcggcgtgacgagcgagggcgagggcccccggccctaccggcgatgctggatggtggtcgatccgaccctccacgtggccgcgaccttcccgctcggcgaggcgggcgaggcggctctgttcggctatctcgacgccctgccggagcccgcggcttacgcgggcttcgagatccccgctcccgtgctcgtcctgcccaacgtcttcgagccggcgctctgccgccacctcgtcgggctctacgatgccgacggcggctcggaatcgggcgtccaccgcgcgggcgcgggcgtgatggaccacagcttcaagcggcgccgggactgcacgatcgaggatccggccctgatccggcagatccagcagacgatccaccgccgggtggtgccggagatcgagcgactgttcttcatgcgcatcacccgcatggagcgctacatcgtcggctgctacgcggccgaggacggcggccatttccgcgcgcaccgggacaacggccaggggctcaccgcgcaccgccgcttcgccgtctcgatcaacctcacgggcgacttcgagggcggcgcggtgagcttccccgagtacaacccgcgcgggatcaaggcacccccgggctgggcggtggtgttcccgaccaacatcctgcacaaggtcagccaggtgacccgcgggcggcgctacgccttcctgcccttcgtgtacgacgagacgggcgcgcagatccgccagcgggaactcgccaggcaggccgaggctgcggtccgggccgaggtcgcggccgaggcctga

SEQ ID NO: 8306 - DNA, 1137 bp, Methylobacterium sp.
ttgagggcgttcgttcgacaggcaggcgcggcggggcaaggcgtatcggagccgtcttcgagccgggtttcggagcaggcctcggagaccgcccagtcgcgcggctcgcgccggctctggctgcacgccgtcgcctacggcctgatcctctgcatcttcgccgccgacgtggtgacgccgcccgacaacgtctcgatctgcttcgcctacacggtgccgatcctgctcggcgtctatacgggcccgcgcgcggccttcgggctggcgctcgcgaccaccgcctcctcgctgctgggctccttcatccggcccccgagcggcggcatcgcgctgagcttcgtggccaaccgcctgatcgccaccgcggcgcagtggctcgtcgccttcctgatcgagcagcgcaagcgcggccgggcgatcgtgcaggcccatctggcggacgagcgccgcaaggcggagaccggccagcgcttcgtgcgcatcctcacccacgagatcgcgagcgcgctcaccgcgatcggcggccagagcgcgcgcctcgccaagctcgcccccgggatcgagcccgccgagatcgtggcgcgcaccgacaagatcggtcaggcggtcgcgcgcctcgacgccctcgtcggccgcatccagctcgccgccgaggtcgatggcggcgagatcgcgctggcgcccgagcacacgccctgcatggagttcctcaggccgctgcacaccgagtacgaggcgggccccgagctcagcctcaccctcgtgtgcggcgcggagacgatctacggcgaccgcggcctgctctaccaggccgtctcgaacctcgtctccaacgccatcaagtactcgcacgcgcccgccgcggtgacggtgagcgtcgcgtcctcggacgtgacggcgggcccgatgatcacggtctcggaccgcggcatcggcatcgacgcggacgaggtcgagcgggtgttcgagccctattaccgggcgcgcaacagcacgggcatccggggcctgggcgtcggcctgcacatcgtccgccacttcgtggaggcgcatggcggcgagatccggatcgcgagccggccgggccagggcaccagcgtgagcctccacctgccgcccgagaaggttgccgcgtga

SEQ ID NO: 8307 - DNA, 1368 bp, Methylobacterium sp.
atgcacaagctcgtcgcaacgatccggcgctcggccctgtcaggcccgttcgccaccgccttcgtcacgcgcttcggaagcgcggtcctcggcttcctcacgctgctcgcggcgagccggctgctcagcacctacgagtacggcgtctacgtcttcctgttctcgatcggcagcggcgtcggcctcgtcgccgtgctcggacagcagaatctcctgctgaagcactaccgcatggacggcgcgtcggcggccgccaacggcgtgctcgtgcgccacaacctcgcctggctcggcctcgcgctggcgctcctcctggggacgggctcggtgctcgtcctggcggaacggaacctgcccgagccctacgaccggctccatctcgccctcgcgttcgcggccgtgttcgcggtcagcgagtacctgcagaacttcttccgcatccatcgccgcttcgccctggcgctgctgcctcgggagatcgtctggcggggcggctgcgcggtgatgctctatctcggctccctcgcgggcgtcctctacggcgcgacggaggcgatggaactggtcctcgccctcttcgtcgccgcaaccgccttccaggtcgtccacctcgtgcgcctgcacggcgccgacatgcggccgggccgggcgggcgccgcgccgtccgagcagggtgccgagcgggcggcctggcgctcccagagcctgttcttcaccgccaacaacggcctgcacgcgctctcgctctacctggagaccgtgatcgtcggggcggtgctcggcatggaggaggcggccttctacttcgtcgccctgcgctacgcgacgctgctgctgctgccggtcgcggccatcgacacggtcggcctgccgatgatcgcggcacggatccaggccgcggactggccgggggtgcagcgcctcgtcgcgcgcctctcgtttgccagcttcctgatctccgtcgcgggcgcgctcgccatgctggtggtcgggccctacgcgctggcgctgttcaagccggatttcgtcgcgcatatcgacgtgctctcggtgctctgcctctcctcggtcgtgggggccttcttcggcccgggggtgtcgctgctgatgatcggcggcggggagcgcttcctgctcgtcagcaacgccgtcctgttcggcgtctacggcctcctgctctgcggcctcgccgatgtcctgggcatgctcggggtcgcggtcgcgagcctcgtcgtgaccctgagctacaacctgctggtggtcttctgggtgcggcagcactggggcgtcgacaacatggcgaccgccatcctgcggccgtcgaccggagcggccggaggactggtgccccgtcatgcggcgggctga

SEQ ID NO: 8308 - DNA, 438 bp, Methylobacterium sp.
atgctgaggccgcgcgacgccgaggccgcgtcggcggccctgaagaccttcgacttcgcggagcgccatcccgagtgggtcttcctgcgcgtcgaggcaggttgcagggccggacgctgcatgacgatcatcgctcgggccgacgagacgagcatgacgcccgaactgctgctgaacgtcggctcctccgtcctcttcaacgactactcgttcggcctctcgggactgaacgcgtggtcggacatcgtgttcgatggagctggaagctccgcggtcaccgtcacccgccggggcgatcactgggtcgtcggcgcctgctccgattgcaacagctgggccggcgtgaaggagccggagccttccctgccggaaccttcaccacccaagcccgagcgcttcgaggacttccaccggttcatagatggcgagaggggctga

SEQ ID NO: 8309 - DNA, 354 bp, Methylobacterium sp.
gtggcctacctctacgcccgcggcgggaacatcggtctgcgttccttcggggcccatgaggagggatccggcgccgtcgccaccgtgaagggtcaccgggtcacgattgccggcggcttcacacggtcgggcaaggcgcccagccgacacctcgtgcggaagctcggcggacaggtgttcgtcaacaccaagggcaagaagtggcgcggccacatgaccaaggtgaagtcgggggtctacatcccgtccgagatgacgagcggttcgaccctagcggccttcgagcgggtcgccgcggcagagctacccgccgaggcagcgaaggccctggcggccctcctgccgggcaagtga

SEQ ID NO: 8310 - DNA, 441 bp, Methylobacterium sp.
atgcccctcgtctgcgtcacgcgcctgcgcgtccgcgccctgcgcttcctgccggccttcgcgctccacgcggtccgcacggcccggcaggtgcgggcggcgccgggcttccggggtggggcgatcctgcgcgatcgggactgggcgtggtggacgctcaccgcctgggacaggcccgaggacctgcggagctacatgcaggccggcgcccaccgggccgcgatgccgcatctcgcgcactggtgcgacgagtcctgcaccgtgcactgggacgcggcggagctgcccggctgggccgaggcggacaagcggatgcgcgacgagggccgcgcctcccgcctgcgccatccgagcccgcgccacgagaccctgagctaccggccgccgcgcctctcggcctccgcgccgctccgcccgagcccgcgggccgccgggatgtga

SEQ ID NO: 8311 - DNA, 1359 bp, Methylobacterium sp.
gtggcagcgggcggcagtctcacgatcaacggcactggtgtagagactggcagcaccgcacggcaggggggcaccactggcgccagaccgggcttcggtgcgggcatcttcttcgagggcggtccaaccagtggaacggccgccacgctcaccttcggggctggcaaccagtccttcgcctcgcagatcgccgacctgaacggagcagcaggcaacacgacaaccggcaacggtctcggcggaaccggcggtgtaacggcgctcgccaaagtcggcaccggcacgctcacgctcggcgccgccaacacctatacgggcgggacgcgcctcgatgccggtgcgatcagcctcggcaggctgacgtccgccggttcgggcgccatcactttcgggagcggggcccagaccctacgggtcgaagcaagtgggacgctcggcaacacgctgacgaacttcggctcggacggtgacacactcgacttggccacgatcaacccgaatggggccacctacacgctgagtggaacgaccctcacggtccgggaggcggcggccaatgggctcgacagcaacaccttcacgctcaacgccgtgccatcaggtttccagttcgtcctcgcgtcggacggtcaggctcaagccggcacgacggtacggctccaggcaatcccgaccccgccgccggatccgggtcccgcaggcccgacctcgggcgacgacaacctcgtgggcacgtccggcccggacacgatcagcctcgggctcggcaacgacacctacgcgggcggggccggcaacgacctcgtctacggcaacccgggcaacgacctgatctacggcaaccaggacgccgacaccctctacggcggccagggcgacgaccgcgcgtacggcggccagggcgacgaccgcgcgtacggcggccagggcgacgaccgcctgttcggcaacctcggcaacgacgtgctgttgggcaacctcggcaacgacatcgtctacggaaaccaaggtgccgacatcgtctacggcaaccagggcgcggacgtgctctacggcggccagggcaacgacgtgctctacggcgggcaggacaacgacacgctggtgggcggcatcggcgacgatacgctggtcggcgggctcggggcggacctctaccgcttcgatccgaattccggccgcgacctgatcctgggcttcaaccagggcgagggggaccggatcgcgctgggcgggcagacctacacggtctcctcggcgcagaacggggacgcggtgctcctgctctcgggcggtggcgtggtcgatctggtcggcatccgggccgatcaggtcaacgccgcttacttcgcggcttga

SEQ ID NO: 8312 - DNA, 486 bp, Methylobacterium sp.
atgcacgcgaagcaccccgcccggtccggccggatcccgtccggtcgccgcttcgggctggccgtgctgctcgggcacgccgccggggcctacgccttctgcgcgagcggcatcctgttcgccgccctctcggaccttgcgaccgccgaggggcgcgccgcgctcgccccggtgaactggggccgcctgatcgaggggatctgcgtcttccccctggtcaccgtcgtccttgccctgtgggcggccgtcctgatggtcccgctgaccctgctgatcctgcccatcgcgtggctggcggcccgacggctcgacgcggatgcggcgcccacggccgcgctcggcgccctggcaagcctcctgcccgccgtcatcgccttccggggggcgcccgtcctggacctgcgcccgtacggctcggccgcggtcgcgggagcggccttcgcgggcatcgtctggctgctctgcatcaggccgcgccggggatag

SEQ ID NO: 8313 - DNA, 342 bp, Methylobacterium sp.
gtggatccgaccgccctcgccgggctcctcagggactatggtccctggggcatgctcgccctgtcgctgctcgccaaccgcatgcttctcggctggtggcgggactgcatgcacgcccgaatcgacgagcgaggaacggccgccgcggcgctagagcggcaggccaccgccaacgctgcgactgccgccgccctcgacgaggtccgcgaggggcagatggaggtcgccaagctcgtcaccggcgccatgcgcggcggcgagagcagcgacgagctgctgaaggagatcctgcgggacatcaagaaccgactcgacgcgctggcgcagaggggaggcagctga

SEQ ID NO: 8314 - DNA, 936 bp, Methylobacterium sp.
atgcactccgatcccgaaaccctcgcaccgccgcagctctccctgctggtctgcacccgcggccgctcggcccagctcgcccgcctgttcgcctcgctcgagagccagagcctgggtgatttcgaggtggtgctcgtcgaccagaacgagcccggcgtgctcgacgacatcgttgcgcgccaccgcgggcgcctgcggatcgaccatgtgcgctcgctgcccggcctgtcgcgcgcgcgcaacgtcgggctggcccggtgccgagcgcccctcgtcgccttcccggacgacgattgctggtaccgccccgcgctggtggaggaggtggtccggctcttcgcgcagcatcccgaggcggacgccctcacggggcgcacgatcgacgcgcagggacgcgaatcgctcggcgccttcctgaaatccgatcaggcgatcggccggcgcaacgtctggtcggccggaaactcgaacaccctgttcgtccggcgcgcggcggccgaggcggtgggcgggttcgacgagacgctcggcgtcggcgccgcgacgcggttccgctccggcgaggagaccgacttcctgctgcgcatcctgcggcaggatcgcgccgtcgtcttccggcacgccctcacggtgcatcacgatcaggtcgggaaccagggccgccacaagcgcgcctccgactacgcgcacggcttcggacgggttctgcgcctccatcgctacggcctgccctatctcgggctgcgcctggcacgcttcgcggcgagcggtgcgcgcgccctgctgcgcggcgatgcgcgcacggcgctcgacaaggccctctgggccgccgggaccgccgcgggcttcttcgcggcgctccccggatcggcgagccgcgtgccggacggcgcgccgtcctggcggttccgggccggcctgacgcggggcggctga

SEQ ID NO: 8315 - DNA, 714 bp, Methylobacterium sp.
atgtcctccagcacgctgatccgccagagcctgcacgagtcgctcgtcgcgccgctgcgcgagatgatcctctcgggcgagcttcgcgcgggcgagaaggtccccgaggagcagctctgcgagcgcttcggggtgtcgcgcacgccgatccgcgaggcgctgaaggtgctggcggcggagggcgtgctgcagatcatgccgcatcgcggcgccatcgtcgcccgcatcaccgaggatcaggtcaacgagctgttcccgatcatggcctcgctggagcggctggcgggcaagctcgcctgcgcggtggcgacggacgcggacatcgcccgcgtgcgtgccctgcacgacgagatgatgcgcctctacgctgtcggcgacgagccgaactatctcgccgccaaccgccgcatccacgacgcgttcttcgtcatcgccggcaacgcgacgctgcacgcctactaccagcaggtgctgacgcgcatccattcctgccgcttcgtgatgcgcaagacgcccgagcactggcgcgccgcggtgctggagcacgagcagatgatcgcggcactcgaggcacgcgacggcgagacgctgggctcgctgctggagcggcacgtgacgggaaccaccgtcggcatcgcccgcgactacatccggcagaaggcggaggagagcggcgcggacaagaccctcggcgcgcgccgggtctcggcctga

SEQ ID NO: 8316 - DNA, 1299 bp, Methylobacterium sp.
atgagcgagcctgacacgccggatgccggtcccgaccggtcctctgccgtcgcggccttccagaagcgccggcccggcgcgacgatccacctgcagcaggaccgcggcgcctcgtggatggcgtggttcttcggcgcgatcgtcgtcgccctggtggcgggcctgttcctcgggcgcttcgcgcgcagcgagtcggtgcggggctacgtctcggccgcctccggcctgacccgtctcgatgcgcgggccgccggcatcgtccaggccatcgacgtgaaacaaggcgaccgcgtcacccgcggccagcggctgatgcagatccaggtccgcgaccagaccacgggtggcgtctcgaccgtgacggccaacctccggagcctgcgcgagcgtaaggccaacctccagcgcgaccgcgagcggctgatcgcgttcctcgacgccaccaggggcgaccgcagcgagaccgagagcaacgtcgccagcgtcacccgcgccttcgacgagcaggagcgcgccctgaaggagggcctgcgccagcaggaggagatggtggcgcgcgtccagtcctacatgaaccagggctacgcgacgcgcgaatcgctcaacggccagcgccgcatcgccctcgactacgcccgccagatcgcggagctgcgcgcccgccgggccgagctgaagcagtccaccgccgagcgcctgaccggccagcgcaccaccgcgaccgagaaggccgcccagctcgccgccaccgagaacgagctgagcgcgatcgaggcgcagctcaccggctacagcgcgctggagcgcctcgacatcgtctcgcccgtcgacggccaggtggccggcctcttcgtcgagcccggcgcctcggtctccgccgaccagatcctcgcgatcgtgggtgatgccggggccgaaccggtgatcgtgctggaggtgccggcccgcgccatcggcctcgccaaggtcggccaggacgtggtgatcaagtacgacgcctttccgttcaagaccttcggcatcgcgcacggcacgatcacgcagatcgccggcacgccgctgcgcgcgcccgccgtggcgatggcggatgcgggcgaggcggtgttcgacccgacctcgctcacccgccagtcgacctaccggatcgacgtgcggccggattcgcgcacgatccgggcctacggcgtggacgagccgatccgcatcggctcgacgctctcggccgacatcgtcgtcgagaagcggcggctgatcgactggatgctcgacccgatccgcgcgatgcgcgggcgcggctga

SEQ ID NO: 8317 - DNA, 2151 bp, Methylobacterium sp.
atgagcgagtggctgagaggcttgacgggcggacggcggcgcgtgcgctccttggtgcagagcgagaccaacgagtgcgggctgacctgcctcgccatggtggcgaactaccaccggcacgacatcgacctcgcctacctgcgcgcgctgttcccgctctcgcgcaccggcatgtcgctggccgacatcgtggagctcgccgacacgctgggcctcgacgcgggcggctacgcgctctcgaacatcgacgagctgaagggcgtccagctgcccgcgatcctgcactggaagggcaaccacttcgtggtgctcgaatcggtccggggcgggcgctaccgggtgcacgatcccgaattcggcctgcgcctctacgagcgcgccgacatggagcagctcttctccggcgtggtgctggaattcgccccccggatggacctcaagcgggtccgggccgagaggaagctgaccttccgggaggtgttccgcgcgacgagcgggctcggcagcacggtctggcagatcagcctcgtcaccgtggcgatcgcgctgctcgggctcgccatgccggtgctgctgcagatcgccctcgacgtggtgatcccgcaggtcgatctcgacctgctccacgtgctggcgatcggcctcgtcctgctgatgggattcgaggcgatcgggcgctggctgcgggactacgtgaccctgcgggcctcgacgctgctccagctccagttcacccgcaatgtcgtgggccacgccttccggctgccgctgaactacttcgagctgcgccatcccggcgacttcgtggcccgggtcgactcgatcgagcacgtcaaggcgttcctcgtcggcggcctcgtcacggcgttcgccgacagcgcgacctcgatcctgatcatcgggctgatgctctactacgcccccgccatggcggtggtgacgatgctcaccctggtcgccgtgatcgggatgcgcttcctgaccttcccgaagctcaatcaggcgacgttcggctcgctcgaggcgcgctcggaggagcgggcgcggcttctcgacggcctgcgccgggtcgatagcctgaaggcgcataacggcaccgaactcttcgcgatgcgctggttcgagagcttctcgcgcttcgccaacctcgatttccgggcgcgcaaggccgggatcgacgccgagctgttcatgcacctcgtcatcgtgctgagcacggtcgcgacgctctacatgggcatcgtcggcgtgatcgcgaacacgctgacgatcggcacgctctacgcgttcttcgccctgcggaccgagttcttcgagcgcgtcaacatgctcaccagcaacctgatgcacctctcggcgatgcgcgtgcacttccagcgcctcgacgacgtgctcggccaggagccggaatcgggcctgcaggacgcgaccttccaccggacgctgaaccgcgaggtgcggctggagaacgtgacggtccagttcggccgggccgacgagccgatcctgcgcgacgtcaacctgcgcatcgacctcgcggcccacgagaccgtagcgatcgtgggcgtgtcgggctcgggcaagtcctcgctgatgaagatcctcgcgagcctgcacgagccggcggagggccgcgtgctggtggacggcagcccgctcgcccagttcggcaagcgcgagtaccgcagcaatctcggcgtggtcttcgccgacgacggcctgttcgccggcaccgtggccgacaacctcgcgctgttcgacccggccgtctcgcgggccgagatggaggcggcgctcgtctgcgtgggcctgcgcgacgagatcgagcgcctgccgcagggctacgccactctggtctcggaggagggcggcctgctctcgacgggccagcgccgccgcctgctcttggcccgcgcgctctgccgccgcccgcgcctgctgctgctggacgaggtgacggccaacctcgacccgacgaccgaggccgcgctcgtcgagagcctgaaggggatccgggccgccaaggtcttcatcacccacagcgagcgcatgctcgatcaggtcgaccgcgtcctgcgcatcgagggcggccgcctcgtggaggacgcgagggcaccgggcgccgggcggaggatcccggcgcgggcgtga

SEQ ID NO: 8318 - DNA, 240 bp, Methylobacterium sp.
atgcactggcctgccgcctacgccgcctacaacgtgttccgccgtcgccagtacccggccctgcgctgcgccgtgcgccaggatcgtccggtgccgggcttcatccacggggtgatctgggagtacgggggcacggtgatggaggagcgcccgccggaaggcttccagccggcggacgcgcaggccgcgaccgcgagcgccggctactacctgttccgggcgccccacggccgcgcctga

SEQ ID NO: 8319 - DNA, 1248 bp, Methylobacterium sp.
atggtgtcggtgaaggcgcgcttgagcgccatcatttcggttctgagcgtcttcgctctcttcacgagcggccgtgatctatccagtgcctacgagcgctggggacgggccgatctcgtctcccatcttgcggcagccaacctgatgctctcgcgcggcatgtcggacgtgcgcttcgagcgcggcgccgccgcctcggcgctcgccctcgaccccgcccagatgggcgcgaacctgcaggacatcgccgcgcgccgcagaaccgtcgacggcgggctgcctcaggggctcgcgatcctggcggccgacagcgtcggacgggacgcgccggaggcgcgggaactcgccgagcgctacgcggcgtggcagcgcacgcgcgtggaggtcgatgccaacctgaccaagcccgtcggagcacgcgacccggccctgcccaagcggctcgccgacgaggcgggcgccctgacggcggcggccgaggcgctcgtcggcgcgatggagaaccagatccgccgcagggatgccggcctgtccaacctgctgcgggtgcgcgagctgacctgggccgcgcgcaccttcgcgggcaacgctcacctcatcgtcaacgacgcgctggcgcagaagcgcgtcctcacggcgaaggagaccctggatttccatgttctcgatcgcgaggcggccttcgccttcggcatcgcccagaagatcgtcgagagcctgtcgggcatggagccgctgaagcgcgccgtcctgggagcccgggacgggtacttccaggggcccttccaggcccgcacccgggcgctgctgccggcgctggcggatctctccctgccgcggccgacgctcgccgagtcgcgcggccagtccacccccgccctctcctcgatcatgaccgtcgcgctcaccgccgtcaccgaactcgacggcgccgcgtccgggatcgccgcggaggcgcggcgggacgtcatggtccagggcatcgtgatggccctcgccctggtgctgggcctcggcggcatggtctgggtggtgcgcggcgtgtcgcggccgatcgagcggatgacctcggcgatgcagcgtctcgccgacggggacacggcctccgagatcccctatggcgaacgccgggacgagatcggcgcgatgtccggcgccgtgcaggtgttccgccagaacctcgtgcgcacccgcgagctcgaggcggagacggcgctggcgcgggcctcggcggaggagcagcgcaag

SEQ ID NO: 8320 - DNA, 837 bp, Methylobacterium sp.
atggatctccgcggactgcacgccttccggatcgtcgccgaatcgtcgtcgatgacggcggcagcggagcggctcggcaccgtccaatcggccctctcggcgcgcatcggccagttcgaggccgcgatcgggacccgcctgttcgaacgcctaccccgtggcgtccgcctgaccgcggcgggcgcacggctgctgccctacgcggagcggatggagatcctcgccgcggaagccgtgcaggccgcccggggaaccgggacgatcggtccgttccggctgggcgccatcacggtggtggccgccaccctgcttccccccgtcctcgcccggttgctggcggaccatgaccggctcgatctgcaggtcgcgacgggcgtgtcgcgcgacctcgatgcggcgctggcggatggaacgctcgatgcggccattctgggccatcgctcggcccgtgcggggatcgtctcccgtccgctcgacagcatcccgctcgccctgctgcgtcccaccggcgtcccgatcgaggcggtcggccaagccttcaccttcgccgcgggctgcgtctgccgcgagcggttggaccggttgctgcgggaacgcaggatcggcgcccggatcgtcgaactcggctcggtggaagggatcctcggttgcgtcgcggcgggcctcggcgtggccttgctgcccgagatgctggcgcggcgggacggcctcgcggtggagcgcgtcggccgcctcgacctgttcatcggttcacgaccggaggcggagacccaggtgcgggccctgctctccgcctatcgagcctgccgggcggccttcgagcgggagatgccctga

SEQ ID NO: 8321 - DNA, 2427 bp, Methylobacterium sp.
gtgaccctcggcagcggcaacgacagcgtctcactctataccggcgtggtcggtgcctcggctgtcaccgttgccgaccagattctcggcggcgccaacacggtcaccctgcgggccgccggtgactatgccgccgccgttttcggcgcgatcaacctcggcgttgggaacaacaccctcagccttcgcggagccgggaccactgtcggtggcggcgcgggctcgaccggcgctgctggctcgctggacctgtcatcggtcaccggtgcgacggccatcacgaagtccgacattggtacctggacgctgaccaagagcggcaccaacaccaacgccggcacgctcaacgtccatgcgggtacgctagcgctcggcacggcaaatgcgctcgcagccggatccagcgtggcggtaagcggcggtaacctctcgctcggcgccaacaatcagtccgtcaacggcgtacaagtgacgggcggcacggtcggcggatcggcgacactcaccagtgccacggccatcgacctgcaggccggcaccgtcagcgccgccctggccggctcgtcaactgtgatcggtctgacgaagagcacctcaggaacggcaactctcacaggcgccaacacctacgcgggtgcaacaacgatcaacgacggtacccttgcggtctccggcggttctgcgatcgccgacaccggcgcggtcgtggtcaacacgggtggtacgcttgcggtcaatgcggccgagacgatcggctcgttggccggaaccggctcaactgctgcggtcaacctcaccagcgacctgaccgtcgccacagccaacggcgtcagcacggcctacgcgggcggtctgaccggtgcgggcagcctgcggaagaccggcacgggcacccagacgctgaccggcagcatcgcgaacgccgggatcgatgtcgcggctggcgcgctggtgatcggcgacggcgctacagcggccaacagcgccaccctgctcgtcagctcgacgaacagcacactgcgcatcgaccgcactcaagcgatcatgctggccaacatcgtgtccggctctggccggctcgagaaggccggctcgggcacgaccacgctcacgggcaataacacggccttcaccggcacagccgccgtcactgcgggcacgctcgcggtcaacggcacgcttggcgacacgaccaaccaggccgcgaccatcaccgtcggcgacggcaccaacgcgaataccggtacgctcggcggatcgggcacgatcgccggcagcgtgagcattcgaaacggcggcacgatctcggccggcaactcgccgggaacgctcagcaccggcaacctcacgctggccaccggcgcgacgctgatggaggagatcaccggaacgacggcgggcagctatgaccgggtcaacgtcaccggttcggtcagcctcgccggaacgctcgacctgcgcgtgaccggcactttcgccgatacggtcgggcagaatctcgtcttcatcaacaacgacctcacggacacggtcaccggccgcttcgacgcgctacgcctcaacggcgcgagcgtcgccctgtcgaacagcaacaccttctctgtcgatggccgcagctatcaactcagctaccaagcgggcgacggcaacgatgtggcgatccgcgacgtcacacccgcgccattcgatccaggtcccgggccggcgccgaacactccgacgcccggtgatgatctgatccgtggaaccggcggagacgacaggctcgtcctgggccttggcaacgacaccttcatgggggcggctggcaacgagatcgcctacggcaatcagggccgtgacagcctcttcggtgatgccggaaatgacagcctgtatggtggccaagacgacgacgatgtccggggtgggctggacaacgacgtcgtctacggcaacctcggcgcggacatcgtctacggcaaccagggtcaggatacactttacggtggtcagggcaacgacacggcgttcggcggccagggtgacgaccgcctgtccggcaatctcggcgacgacattgtctacggcaatctcggcaacgacatcgtgtacggcaatgccggcgctgatgtgctctatggcggccagggcgacgacgtcctgttcggtggtcagggtgacgacgtgctgcttggcggccttggcaacgatacgctggtgggtggagtcggcgccgaccgctatgcgttcgcggcaaaccctggtgggctcgatctgatccttggcttcaaccaggccgagggtgatcgcatcagcctcggcggccagacttacacgctcagctcagctcagaacggcgacgcgctgctgaccctgtcaggcggtggcaccgttgatctcgctggcatccgggcccagcaggtggatgcgaccttcttcgcctga

SEQ ID NO: 8322 - DNA, 225 bp, Methylobacterium sp.
atgcaggctgtccagtgcaagatggcgcgaacggcgctcggtctgggcgttcgcgatctggccgctgccgctggtgtgtcggctgataccgtggcccgtttcgagcgaggagatgcgctcaaggagcgcacggtcaccgccctgcagagtgccctcgaagccgccggcgtcatcttcattgatgagaacggtgagggagcaggggttcggctgcggaagaagtaa

SEQ ID NO: 8323 - DNA, 246 bp, Methylobacterium sp.
atgccgctcgatctctcctccgattccatcgtgcttgccggcacctgccccgtcgaggaggccgagccgctgctcgaggcgctgcgcgccgatccggcccgcccggtcgatctcggccgcctggagcacgcccacacggcggtgctgcaggtgctgatggcctgcgccccgtgcctcatcggacggccggccgatccggtcaccgccgcctgcctcgccgggtgcgggcgggaggcgcggccgtga

SEQ ID NO: 8324 - DNA, 165 bp, Methylobacterium sp.
gaggacatcatcgagccctacctgatccagcagggcttcgtgcagcgcacgccccgcggacgcgtcctcaccccgcaggccttccgccacatgggcctggccgtgccaagcgccgacccgggccggcagcccgggctcttcccggacgacggcgccgatgcctga

SEQ ID NO: 8325 - DNA, 1266 bp, Methylobacterium sp.
atggaaaggcggggacgcgggctcggtccgctgcgcgtcctcggcgcgggggtcatcacgggggcggccgacgacgatccctcggcgatcggcacctacgccagcgcgggggcgaagttcgggctcggcttcctgtggatcgcccccgtgctcctgccgatgatggtcgtggtcgtctacctctcggcgaagatcggccgcgtctacggcaaggggctgttcgccgccgtgcgcgaccgttatccgcccgccctgctctatccggtcgcggcgggcgccttcgtcggcaacgtgatcgaggccgcggccaatctgggcggcatcggcgcggcgctcgggctggtcgtgcccctgccggtgcccgtcatcgtggcgggggcgggcctcctcgtcctggccttccagtttctcggctcctacgccctgctgcgccgcatcttccgctggctggcgctcgcgctgctggcctacccggtcgccgccatcctggcgcggccggatttcggcgcggtgctgcgggcgacattcgtgccgggcatgcgcttcgacgcggagttcctcgcgatgctggttgcctgcatcggcacctcgctctcggcctacgtctacacctggcagtcgaaccaggaggtcgaggagcaggtggccgagggcaagcggagccaccgccagcgccggggcgcgtccgaccgcgagctcgccgcgacgcgccgcgacgtggtgaccggcatgctgttctcgaacctgatcctgtactccatcatcctgtcgaccggcgccacgctccaccctgccggccagaccgagatcgagagcgccgcccaggcggccgccgcactggagccgctggcgggtgccggcgccaaatacctcttcgcggcgggcatcgtcggggtcgggttcctggcggtgccggtgatgacgacgggcgcggcctacgacctcgtccaggcgctcgaccgcccgggcagcctcaacgcgcgtccatccgaggcgcggctgttctacggcacgatcctcgtcgtgacgcttgtcgcggtcgggctcaacttcctcggtttcaatccgatgcgggcgctcgtctggtcgggcatcgtgcaggggttctcggtgcccccgctgctcctgctgatgatgctgatgacccgcgaccggcggatgatgggcgagcgggcgaacgggcgcctcaccgcattcctcggctggaccaccaccgccgtcaccgtcgcggcggccctctgtctcgtggcgacttggatcctgtga

SEQ ID NO: 8326 - DNA, 948 bp, Methylobacterium sp.
atgcggttcaccctgcgccaactcgaatacttcatcgccgccggtcagaccggcagcatcacgctagcctccgagcgcatccacatctcgcagccctcgatctcgacggccatcgcgcacctggagcgggaactctccgtgcagctcttcgtccgccaccacgcgcaggggctcacgctgacgccgatcggccgcgaggtgctgcgcgaggccaaggccctcgtggagcaggccgaggggctctacaccttggcctcggaggcgggcggacaggtgcggggccccctctcgctcggctgcatggtgacgctcgcgccgatgctcgtgcccgaactcgcccacgccttcaccaccgccttccccgccacgcagatccgctacgtggaaggcgaccaggaacagctgatcacgggcctgcgccgctccgagaccgaggtcgcgctgacctacgacctgcacgtgccggacgacatccacttcaccccgctggtcgacctgccgccgcacgtcctggtggcggaggggcacccgctcgcggaacacgccgcggtcgcgatgaccgatatcgtcgacgagccgatgatcctgctggacctgccgctgagccgcgaatacttcctcgccctcttcatggccgagggcctgcagccgaagatcgccgcgcgctccgcccaccaagaggtggtgcgcacgatggtggccaacggccacggctacaccctgttcaacgtgcgcccgcgctccgacctcgcgctcgacgggaagcggctgaggcgggtgcggctcgcgggcacgcaccgcccgatgcgcatcggcctcgcgcgcctgaagcagctcaaccgctcgcgcctggtggaagccttcgagacgcactgccgcgccttcatctccgacgcctacatccccggcatggtggcgcccgccatcgagcgacgtgtgccgcgctga

SEQ ID NO: 8327 - DNA, 1770 bp, Methylobacterium sp.
gtgaccgccctcgacgccctgctgcccggcctgcggcagcgccccgaccccgccccgaagagcgacgtgcgcgacccggaggccggatccgcgcgggaggccgggcgcgatctcggccgcgatctcggaaaggatcccggacgggatcgcgacacggcgttcggccgcgagctcggccgcctggaacggccgcaggggcgcggcgatcgcggcgggcgcacggctccggccgacgacgccccggccgaggccgaggcggaggaagcgaccgagcgcgcgccggtcgcggaggccgtcgccgacccgcaggcggcgctccgcgccctgttcggggcggcccgggagaccgccccgggcctcgcacaatcggtgccggatcagaccctcgcgcagggggccgcgcagggggccgcccaggccggtgcgcaggccgtcccggcccaggcggcagcgctgcccgggcaggttccgggcgccgcgaccgatctcgccgccctggccgaacgcgccgcgcgtcgcgccgccctggccgaggcgccggtcgagcggccgacgctcgccgtgctggcgcaggagacccatttcgcgccggtcgggccgtccggcctgcccgccggtccggccgccgcgccgctcgcggcaccgggcaccccctcgggcgccgcaccgggcgcgcgcgcggcggacggttcgtccgcgcagccccccggggcccgggcggagggcgcggcgctgcccggatccggatcggtggcgctccgggccgccgcgacggccggcccggcccaggagcccgcgccggccgggccggccgccgggcagggcgcgcccgccgcaccgctcgccgcgaccccggccgtgcccgccgcaccggccgtcccggcggccgccgcggtcgcggcggcgtccgctgcgagcaccgcacccacgcaggccgtcaccggaacccgggcggccccggcccgcgaggcggagcggccggcggccggtgcgcgtccgggcacgcacgaggcgccgcaggccgggtccgaggccgtggcgcccgcgggcgcgcgggccggcaccgcgccggacggggcgcggacgccgggccaggatgcgggcgcctcggaccggggcgcagcccccgatccggcgcccggcgagaccgaggaggccgccgcggtcccgggggcggcggggggacaggccgggctgccggccgcgaccctgcgccagctcgcccaggcgatcgccgccgaggcgccggccgccgcggccccggcccaggcggcacggcccggcccgctggccgagggcccgctgcgcctgctcacgatccagctccagccgggcgatctcggcacggtgacggtgcggatgcgcctgcaggagggccggctggagatcggcctggagaccggccggcgcgacacagccgagctgctccgccgcgacggcggcgccctgaccgagctgctgcgcggagcgggctaccagaccgacctcgtcgccatccaggcgggcggggcggagctgtcgggcggccagccggggtcgggccagggcgcgggtcagggtgcccaggccgcaccgggccgcggccagccgggcttcccggccgagggcggccaagccggcagccaagccggcagccagagtggcggccagggcggggaggggcgcaaccccgacccgagcacccgccgcgggagcgagggaccccggaccggggaggggggacatgacgcgtatcctgacgcgcgcgatcgccgcggcctgtatctttag

SEQ ID NO: 8328 - DNA, 315 bp, Methylobacterium sp.
gtgaagcgcttcacgctcgcggctcttgccgccctgacgctgggaacgaccctggccgccgcgccggcgaacgcgcagtactacgacgacggaccgcgccgttgggaccgcggctacgaggaccgctacgagcgccgccgccgggatgattattacgaggaccgctacgagcggcgccgggatttcggtcgccgcggcggcagcatctgcgtgacctcgcggggcaattgcccgacccgcccggcgccgttcaacgcgccctgcggctgcgagattccgggcttcggcttcaagcgcggcgcgatcggcggctga

SEQ ID NO: 8329 - DNA, 357 bp, Methylobacterium sp.
atgacggattatgaccgcttcgacgtcctgacggccctgtttcccttcatcgatgtccctgtccgcaagccccgaccggtcctcgtcctctcggcacgcagtttcaacgccctgcacggacacgtggtcgccgcgatgatcaccaccggcgccgggagccgctggccgagcgactgcgcgatcacggatctcaccgctgccggactcgggcatgcctccgtcgtccgcctgaaggtcttcaccctggcggaaacccagatcgggcgccgcatcgggcgcctgtccgaagcggacgaagtccgcttcgccgccgtgctcaaccctgccttgtgcggggcgaatctcacctctccctag

SEQ ID NO: 8330 - DNA, 348 bp, Methylobacterium sp.
atggcgacgacgatcatccgggacgacatcctgcacgcccggcacatcgagggtgatccggacctcgcgcggcgcatccgcgtcctgcccgacgatgggacgatcgtcctgcgcgtcgaggggcagccgatccggttccgcaaggtcccggacgaactcgctgatgccgtgcggccggatccggaggacgtgcccgtctggcgggcgttgcgggctcgttgcggcaccctgctcacggtcgagatggctgaaggcggggcggcgcccgacccttatcttctgtccatctcggcaaccctgaccgagtggaacagccccgaagacgcggcggcctatgacggattatga

SEQ ID NO: 8331 - DNA, 1116 bp, Methylobacterium sp.
gtgaccgaccgcctcgccatcctgcacgtcgtccgccagttcctgccgaaccgcggcgggctggaggatttcgtcgccaacctcgcgcgcgagcaggtgcgcctcggccacgacgtgcgggtgctgaccctcgaccgcctgttctcggagcccggcctgcggcttccctcggccgagcggatcgacgggatcgcggtcgagcgcatgcccttccgcggctcgtcccgctaccccctggcgccgggcttcctcggccggctgaagggcgccgacatcgtccacgtccacgcgatcgacttcttcttcgacgcgctcgccctgaccaagccgctgcaccgccggcccctcgtcgccaccacccacggcggcttcttccacacgcaggcccatgccgggctgaagcggctctggttccacgggccgacccggctctcggcccgcgcctacggcgccgtcgtcggctgcagcgacagcgacgcgcgccagttcgcggcgatcgtgccgcggggcgtgccggtgatcgagaacggcgtcgatctggccaagttcgcgggcgcggcgagtcctgtcccgcgccgcacgctgctgacgctgggccgcttctcgcacaacaagcgcctcgaccggctgatcgcgctgatgcgcgcgcttcgggcgcaggaatccggctggcagctccggatcgtcggcgtgccctcggacctcgccgtcgcggacctcgccgcgcagatcgaggccgcgggcctcggcgggacggtcagcgtccatgcgggtctcgacgccgccgaggttcgggctctgatcggcgaggccagcctgttcgtctcggcctccgagtacgagggcttcggcatcgcgctgatcgaggcgatgagcgccgggctggtgccggttgtccacccgaacgcctccttcacggacctcgcggcccgtcatcccggcatcgcgctctgcgatttcgccgacccggccgcggcggcgcgggccgtgcgggaggcccatgcgcggctcgccgcgcgggggcggccgcccgccgaggatctcgaacgctacgcctgggccggggtcgccgcccgctacctcgatgcctacgcgcaggtgcggcgtgccgcctga

SEQ ID NO: 8332 - DNA, 231 bp, Methylobacterium sp.
atgaccgaagccgaccggaacactaccctggtgcgcctcatccgggcctatcccgccctgcgcgaggagctcctcgaccactggtgcgagatcgtcctcatggagctccgggccgccgcctacccggagccggactgcccgccggttgacgagggcgtcactgcccgggcgctggagcggttccgggcgttggaggtggaggtcctggcgcggtcgccgcaacggttttga

SEQ ID NO: 8333 - DNA, 228 bp, Methylobacterium sp.
atggcgcggacccgcattttccagtccggcaacagccaagctgttcggatcccacgggaattccgcttgaaagggagcgaggtcgagatctttcgacgggacggcgaactcgtcctgcgggaagtagaggatcggggactcgccgccgccttcacgctgctgaccgaactcccaccggagatcgaccaccgggacgacatgccaccgcaggagcgcgagggcctgtga

SEQ ID NO: 8334 - DNA, 708 bp, Methylobacterium sp.
atgctgaagacggcggcggcgttgcgccatgtggcgtttgaggatctcggcagcttcgcggcggtgctcgccgccgccggctacgcggtcgagatctacgacatcggcgtccacgacctgcgggcgctggatccggtgacgaccgatctggtgatcgtgctcggcggtccggtcggcgtgtacgagacgggagcctatccggtgcttgccggggaactggacctcctgcgcacccggctcgccgccgatcggccgacgttcggcatctgcctcggcgcccagctcatcgccgcggcgctcggcgcggaagtcgggccgagcggcacgaaggaaatcggtttctcgccgctgactctgacggcggcgggcgaggccggcgccctgcgccatctcgcgggtgtgccggtgctgcactggcacggcgataccttcgcgatccccgagggcgccgagcgccttgcggagacaggagcctgcgtgaaccaggccttcgcccgaggccgcaccgtcatgggcgtgcagttccacccggaggtggacgcgaccgccggctttgagcgctggctgatcgggcacgccaacgagctggcagccgtgggcctcgatccgcgcgatctgcgcgccgacgccgagcggcacggcccgcgcctgcgcgaggcgggccgagcgatgttcgcggactggctcgggggcctggaagcatcatga

SEQ ID NO: 8335 - DNA, 216 bp, Methylobacterium sp.
atgccgcgcgctctgcccaaccggcgcgggccgcgccaccacctgctgccgcaccggcccgcccgccaccacgcgcacggtcgtcgtgcgcacggcgccgaggccaagacgctgcgcacctcggacctcgtgctggcgctcctcggcgtggtgctcctcggcggcctcgccctgctggcggccgtcgccctgaccgcgggcgcgcccgccccctga

SEQ ID NO: 8336 - DNA, 237 bp, Methylobacterium sp.
atgccgcacttcttcttcgacattcacgaccacgagctctcgcaccgggacgaggagggtagcgagtggccggacaccgcctcggcccaggatcagggcaggcgcctgctggccgacatcgcgcgcgacgaggtcttccggcacgatccactccacctctcggtgagcatccgcgatgaccagcgccgggtggtcgcgacctgcgccctctcgctggcgagtacgccggtcgtctga

SEQ ID NO: 8337 - DNA, 222 bp, Methylobacterium sp.
gtgctcctcgtgcacctgctcgaccgcttcggcaaaggttggcaccgtcgcctcagcctttcggcgctcggcgaacggatctccaccgtcacgggccaccttgcgataggacagcgccttctcacgagcctcagccagcgagacgaggcttgcgcccccgagcccgatatcacggcgtcggccctgtacgacggttcgcaggagccaacgcttcgagcctga

SEQ ID NO: 8338 - DNA, 801 bp, Methylobacterium sp.
atgcccgcgccgaatcccgccgcatcgcccgtcccccgctcggcgggccggcctgtgccgaacgccagcaccacgcgcgatcccctcgattcgccgctctggccgagcatggccgagcgctatctcggcggcctcccggcgatcttcgacgaccgcgtcgccgtcgccctgcccccggtcaccgaggaccagacacaggtgcccttgacggtcgacgcacgggcgatcgggccggtcgaggaactgctcgtcatcgccgacctcaacccgttcccactcaccctgcggctcgttcccaaagccgcgcaggccttcgtggccttccggatgaagatcgagcagggcacgccgatccgggccgccgcgcgccgggacgggctctggcatgtcggcggccgctacctcgacgcggccggaggcggctgctccgtcccgcccgtggtcgagaagaaggtcgactggccgaatctcggccgcatgcgcggccgggtctggcgcgaggcggacgacctgcgtcttcgcctgcgcatgacgcacccgatggacaacggcatgatcgccaacgtgccgctcttcatcgtggagaccctgactgtctcggacgcgtcgggccgtcagctcgccagcctcaccctgtcggaggcgatcgccgacgacccgaccctgacgctgctggtcgcagggcccgagaccgaggcactgaccgtcacggcacgcaacaccgccggcaacgatttccgcgcccgggccgcggtgccgcccgcggatgcccaatcggccgagatgcaggggaggccgtga

SEQ ID NO: 8339 - DNA, 270 bp, Methylobacterium sp.
atgcgcgaggccgtgaccgggtggctgtcgcgcctcggacacgagcacatggcggcagccgccttcctgacgggtggcccgcgcggcgggcaggtcccgccgatgccgaccttcacgacctttcgcaagatcggctgcgtcccggccgagccgaagcccggacacacctgcgagttcgagatcgcggtcgacggcaagcccgccgccaaggaccgggcacgcttctacaaggcaccgaacggctctctggaagcggacgccgcgcgatga

SEQ ID NO: 8340 - DNA, 264 bp, Methylobacterium sp.
atgggcctgtccgcgaaacccgtccgcgtggccaaacaggctccggccgatgccgtcgaggcgttcatctccaagggcggcagcgtcccgacaggggccccggacgcggcccccaagggggcgcagcacccgctaaagttcccgcccgacagcgacctgttcgagcgcctggaacgcgcccgggcggccagcgcggtcaagctgccgcgcaacacctggatcctccaggccatcgccgagaagctggagcgggaccggacttga

SEQ ID NO: 8341 - DNA, 930 bp, Methylobacterium sp.
atgctgcaggacgcctcaccgagccagagcggcgggatccgcctgatcatcgtcggcgcgggcgccagcgcgctgaccctcgcctcgcacctgctccggcaggacgcgcgggcgcaggtcgtgctgatcgaggcccgagccgaggtctgcgcggcgctgcggcgcggcgcctacgcgacgatcctgcgcgcaggcctcgccgatgcgcaggcgtggctgccgccagaggcggaagccgcgacgcacccgctgcgcctcgtgcgcgaactcgtcgcacaccgcgaccggctgcacgtcgtgcaggcgcgctgtaccggcgtcgcgccgacgagccaggggatcgcggtcgccacggaggcgggcgcgacctggctcggccacgcggcggcttgggcaccgcccctgtcggccgtccggtgcgttccggccggacgccgcctccgggcggtgccggcctcacgggcacgcgggcgggcgctgcggctcgacgctacggacatccctctcggcaccggaatcgcctatctcacccgttggctgcgggcgacggtgcgggcggcggaccggcgcggcattccctggaccgaggtgctcgacggcctgcgcctgcacgggccggaggtctggcgccacctgacgccgcggagccgggcgaccttcctccggcacggcttcgcggcctggaaccagctcaccaccggcctcccggacgaggcccgccgcgcatcggcggccggcccggagcgcggcggccacgtattcgccctgcacccggtcgacctgatgccctacgccgcgcagacgaacctgctcgacctcgacatcgcctgcgcgagcctcgccgggcgcgtcctgcgccgctccaccggcgcggatcatccgggcgcgctccggcgcggtgcccagccccgccttcgcgcctcgtcctga

SEQ ID NO: 8342 - DNA, 468 bp, Methylobacterium sp.
atgcggcctaggcaccccgcgcggctcgcagtcccggtcgcctggctgctcgccgcgatggggggagcgctcgcggcggacacggcgccggcaaccgacctgcccgatctctcggccgcgcgcgcccggatctacgcgggcgactacggcaccgcggctgccgaactcggcgccctgaccgcgaccgtgcggcacgcggacctctacaatctgctgggcttcagcctgcgcaagctgaggcgcttcgaggaggcggcccgatggtatcgggaagccctgttctacgacccgacccaccggccggcactcgcataccagggcgagctcttcgtcgagatggccgacctcgccaaagcacgcaacaatctcaagcttctgcggctgctgtgccacccggccggctgcgaggaggcgcgtcggttggaggccgttctggcggccgccgatccatcgggcacgctccggtga

SEQ ID NO: 8343 - DNA, 1644 bp, Methylobacterium sp.
atgaccggcaccatcgtcctgctcgacctcgccggctgggtggcactgctgctctggggcatccacatgatccgcaccggcgtgcagcgcgcctacggggccgacctgcagcaggtgctgggcgcgagcctcggccacccgctcaaggcgctgctcgcggggctcggcgtgaccctggttctgcagagcagcaccgcgaccggcctgatggccacgagcttcgcggcgggcgggctcgtcgagctcgggccggcccttgccgtgatgctcggcgccaatgtcggcacggcgctgatcgtcaaggcgctgtccttcgacgtggcgaaggccgccccggttctggtgctggtcggggccgtcgccttccgccgcgcgggcggaccgaagggccgggcactcggtcggatcgcgatcggtctcggcctcgtgcttctcgccctgatccagctcgtcgcgacgctggagccgttcacctccgcgcccggcctgcaggcggtgctcagggccgtctcggcggatgcggtgatcgcgcttctgctcggcgcgatcctcgcctgggccgcccattcgagcgtggcggtggtcctgctcgtcgcagccgtcgcgcagcagggcatcgtcccggtcgaaaccgcgctcgccctcgtcctcggagccaatctcggcagctcgctcaacccgcttctcgcgagccgggaagccgccggccggcgcgtggcgctgggcaacctgctcgtacgcctcgtcggctgcgcggccgctctgccgatcctatcctggtcggcggcgagcctgacaccagtggccggtgcgagccgggacgcggtcgccgatttccacgtcctgttcaacctcgccctcgcggcggtcggcctgccgcttctgcgtcccctgtccgtccttgtcgttcagctccttcccgaccggacggccgccccgacggagccgccgctccacctcgatgagggtcttgcggaacccccctcgatcgccctgggcctcgccgcgcgccacgcgctgcgcatggcggaccgccttgaggtcatgctcaccgactccacccgcctgctgtccggggaggaaggctctcaggagcgcattcggcttgcggagcgggacatcgacacgcgcggggccgagatccagcgctttctcgccaagctcgatcccgaagccttgagcggcgccgagcagcgccggctcgccgccctggtgagcttcacggttcagatcggccatgcagcggacgtgctcgctcgcaacgtcgccgcgcagatcagccgcagacacaagcaggcgggtcgcccgcagttccgcgccgatggggatctgacgaccatgctcgatcgtctgtcgacgaacctccgcacggcagcctcactcctcgtgaccgaagacgaggtgctggcgcgccggctggccgatgagaaacagggcttccggagcctggaagagacgcgtatcgcatcccacgtcgcatcgttgcgggacgtggcaagcttcgagcctctcaatcgggttgcggatctcgatctcgttcgagacataaagcgtataaacgatcatcttgttgcctcttcagcctatcctatactcatgaaaagaggagagcttttagaaagtcgattgaagtatgcggattga

SEQ ID NO: 8344 - DNA, 1002 bp, Methylobacterium sp.
atggatcgctctctgcttgggcaggctgtcatcgaggccgaagtcgatcgcttgcagcggcacgcccagttccgcaaatcgcctaagctcgccgccctgctcgtctacctcgtccacgagagccttgtcggacgcggcaaacgcctgaaagcctacacgatcgccacggaggcgctcggccgccccgacgacttcgatcccatcaccaactccatcgtacgggtcgagatgcgccgccttcgcggcaccttgcagcggatctatgccgaagccgagccgcatcaggtcgttgttgagctcccggtcggccgttatgaacctgtcttccgtcatcctaggacgaacggctccgccgacgcggccggcaagcctgatgcgcacctgtccgcagcactgcacgagagcgaggagcgctacgccgcgctcgtcaaggcgagcgcggtcatcgagtggcgtgcggagccgaacgggcacatcacgcggagcctcggctggagcgagcggacgggacaggaggaggaggtctatcgcggtatgggatggctgcaggcgctgcatcctcatgatcgggggcgtacggcacgaagctgggttgcgctctgccgggcaggggcggcattcgcgctgagcttccgggtccgacagcaggacggccactatcagcccatgctcgtacgggccgtaccgctggagcaagcaggtgggacctgtcgcggttggatcggcacgatggtcgagcaaatattcccggccagcgggccgacaaaggctgatcgaggggacttgcagcaagtcctacaccgggaatccgagatggccagacgcgtcctcaaggtggcgcagcaaacggttctggatatcgatcggaaagagatcggacgcgcccgagcgatcatcgaactcaacacgcgccttcgcggtacgggcgtcaccatcggcgaggcggatcgcgcagccgcggcgtcgaccggcacgtccacacccgagatccgtcctcgatag

SEQ ID NO: 8345 - DNA, 1002 bp, Methylobacterium sp.
atgatatccccgatcgctacgcccgccgcctcgcccctgaaggaggcgggtcgcggcggccgcctcaccggcaacgcggccatcgccgccgcctgcctcgccctggcgctgctcccggtgctcctcggcgccagcaactacctgctcgggctcctcatctcggccctgatcctctccggcgtgtcgctggcttgggcgctgctcggcaatctcggcggcatggtctcgttcgggcatgccgccttcttcggcgtcggcggctacacctcggccctgctcgcggccaaactcggcctgccggtcctgctcgcggtgccggcgggcggggtcgtcgccgtggtggcctcgcttgccatgctgccggccctgcggctgtcgggaccctacttcgcgctcgctatcctcgcctacgcgcagatcttccgcatcctggccacggaggccgcctggctgaccggcggtgcggccggcttccagcgctatccgggcctgccgaccgtgttcggcttcgatctcgcgagccgcaccggcagctacctgctgctcgtcggcatcgtggcgctctgcgcgctggcctatctcgcggtgcggcgcagccatgtcggcctggcgctgcgcgccatcgccgacagcgaggacgcgacgcgggtggtcggcgtcaacagcacattcctgaaatccctgatgctgctgctctcggccttcatcaccggcgtgttcggggcgttgaacgcccacatcatcggcttcctggagccggactatgccttctcaggcatctggagcctgatgccgatcatcgcggcgatcttcggcggctaccgcacgatcctcggtccgatcggcggcgcgctgatcatctacctgttcgatcaggtggtggcgaaggggctgatcgcggtgggccaccagatcatcctgggcttcgtcctcgtcgtgatggtgctggccgcgccgaacgggctgctgggcctcgtcaagaagggaggccgcgatgcttga

SEQ ID NO: 8346 - DNA, 1572 bp, Methylobacterium sp.
atgcacaaaggaaccgcgttcacgcaagaggagcgtgagtcccttggcctcgaaggcctgctgcccacggccatcgagacgctggatcggcaggtcgagcgcgtgatcggccatctcggtgccaagccgaacgatatcgagcgcttcatctatcttcaggaactcagcaacagcaaccagacgctgttcttcgcgacggtgatgtcggatcccgcgcgcttcgtgccgatcgtctacgatccgaccatcgccgaggcctgcctcacctacgggcatatctatcgccggccgcagggcatgtacctcacccggtacatgaaggcgcgcttcgagaaggtcctgcgcaactggccggtcaaggaggtgcgcttcatctgcgtctcctccggcgggcgcatcctcggcctcggtgacatcggcgccaacggcgcgccgatcccgatcggcaagctccagctctacaccgcctgcgccggcgtaccgcccgaaagcctgctgccgatccatctcgacctcggcaccaccaacgcggcgctccgcgccgacgcgctctacactgggctgcgcgaggaaccgccggagcccggcgaggtggacgcgatcgtcgacgccttcatggaggcggccaacgcggtgttcccgggcgtctgtgtgcacttcgaggactggaagggcgacgacgccattcggctgctgaagcgctacaaggacaggtatctcgtctacaacgatgacatccagggcacggcgagcgtcgcgctggcgggcatcgtcaccgccctgcagatcaagggcgaggcgctcgccgaccagcgcatcctgttcgctggcgcgggctcggccggcaccggcatcgccgacatgatcgtcgaggcgatgcggggcgagggcctgagtgaggccgaggcgcgcgggcgcatcgccctgttcgacatcggcggcttgatcgagaacggccgcaaggacctcaatgcgtcgcagaagccgtatgcgcgcgactggaaaccgacggaggatctcaccgaggcggtgaagcagatccgcccgacgatcctgatcggggtctcgacggtcggcgggctcttcaccgaagcggtggtgaaggccgtggcgaagacctgcgagcggccggtgatcttcccgctctcgaaccccaccgacaaggccgagtgcacgcctgagcaggcctatcaatggacacagggcaaggcgctcgtcgcatgcggcgtgcagttccccgacgtgacgctggacggcaggaccttccatcccggacaggccaacaacttctacatctttcccgcgatcgggctggcggtctacgccacgaagccgaagcggatcgacgacgcgatgttcatcgaggcggcgcgggccacggccgatcaggtgagccgggccgaccgcgacaacggcatgctgttcccgcgccagaacaacatcctcgagacggagcggacgacagcgacgcgcgtggccgaatccatcttcgagcgcggtctcgccaccgtgaagcgccctgcggacatccgggccttcgtcgagtccctgagttacacgccggaatactga

SEQ ID NO: 8347 - DNA, 453 bp, Methylobacterium sp.
ttgttccgtctgatctacaagagcgcggcacgccacgaggcggaggagatgttccggccgtccaacctgccggcgatcctggcggcctcgcgccgacgaaacggcgagcacggcctctcgggcgtcctcgtctatacgggggccgggttcctgcaggtgctggagggggacagggccgaagtcctcggcgtgttcgagcgcctgctcgtcgaccggcggcaccgcagcgtctcggtgatcgagatgggcgagaccgagcggcacctgttcggaggctggtcgatgggctttctgggagcctcgccggagatcgatgcgcggctcgaggccgcgatcggaccggtctcgggtctcgagcgtgatcccgcgcggcgggtcgagctcctgcgcgccaccctgctcctgctcgtggacgctccgatcagcctgctctggcgcgagggcctgacctga

SEQ ID NO: 8348 - DNA, 354 bp, Methylobacterium sp.
atgaatttccagagtacccgccacaccgacgagcctcaggggcaggcgacgttcggcatggccaatctgcggtcccagagaaccggcctgcccttcatcgtcttcatctcgcagcgcgacggcgcccagcacgacgtgcgcgtgaaggtctcgcccaacccgaaggtgcgcaacgcccagatgggatcctacgcgctccggccctaccggttcgtggacgggcatcgcctgagcccgggcgaggagcgggccctggaagcctgggtcgagaagaacctggacgtcctcgtccgctactggaacggggacatcgagtacaccgaggacgcgctggatctgctcgaagcgatctga

SEQ ID NO: 8349 - DNA, 330 bp, Methylobacterium sp.
ttggacgacaccccggaaatccgcgagcagctgtcccaggcgtggcgctcgaccctcgacgccgcggtcgcgaacggcgcgccgccccaggcggtgatcgagacgatggtcgaggtggcgcatgcctgcttcgccgaggcgttcggcgcgacggcggccgcgagctacctccagctcctggccgagcagctgcgggcgggcgagcgctgcgagaccgacgagctggtgcgcggcgcgcccgacgagcgcccgtcgcgcagcttcatgcccgccgatgccgaggcgctgatcgacccggactggctgacccggaaagacctgttcggctga

SEQ ID NO: 8350 - DNA, 795 bp, Methylobacterium sp.
atggacatctggcagcgcatcgagaacgaccacgcgaacatcgcgcagctgatccacgagacgccgaacgccctgaacggtccgggcgtggtccgcagccgcgagcggctgctcggcgacctgatcgacgaactcgaccggcacggcgcggcgctcgccgccagcctctacccgccgctgcgacgggacccgagcaccgcccggctcgtggacgagctcgcgcacgaacagaccgcgttcatgcgcgacctccgggcgctcgcgcggcgcggcggcggggcgggctggctcaaccgcttcgaggacgtgacctacgccgtcgaccagtgcctgcaccgccacgtgcacgaactggtgcccgcggcgcgcgagcggctctccggcgacgcagccgagcgggccggccacgcctatgtccgggcgaagatcgaggcgttgcgcgggcggggcgacctgctggcgggtgcgggcctcgtcggcggcaccgccgcggccggggcggcgatcgccgccgtcgccggcctcgccctgctggcttggcgcctcgccgcgcggccacggcagacgtcgaaccgcgcatcggaccatcgctccgagcgggcgttcggcggcgcgcccggccgctccggccccagtcgctggcagccgctctccgaccgggctgcggatgcggctccgggcgagcgacgcgacggcgaggacatgcgggcgcgccaggagcggttgctcgacgagtcgctcgaggaaacctttccggcgagcgatccgatcgcgccgaagcggatcacccgctag

SEQ ID NO: 8351 - DNA, 1545 bp, Methylobacterium sp.
atgccgggtcggatcgtcacagcacgggtcggggggcgggcgctgctcgcggggctcgccgccgccctcatcgcggggccggccggcgcccagacgctcgatcaggccgccgccgcggcgctggagaacagcttcgtcctgcgcgccgaccgggcgcgccaggacggcgccgaggcgcgcgagcgcggcgccttcgacgccttcatgcccaccgtgtcgctgctcggcgacaagccgctctccagccgcttcacctacggcccgcgcatcgagccgacgcagatcggcatcgattccacgccccgttcggcgccccgccagtacggcatctccgccgacctgccgctcttcgacggcttccagcgcctgcacaccctgcgctcggcccaggcgctcaccgatgcgggccgcttcatcaccctgagccagcgccagcaggtgctgctcgacgcggcggtcgcctatatcgcggtcctgcgcgacgtgcggatcctcgccgcccgcgaggcccagatcggggcgatcatgcgcatccgcgacgcgacagcccgccagttcgaggtcaatgacgccactcgcacggacgtggcgctgacccagtcccgcgtgcaggaggccgaggccgcccgcgatcgggcgcgggcggaactcgccgccgcgcgcctcgccttcaagcgcgtgacgcagatcgagcccgagcggatggtgccgccgcgcttccccgaccggatcccgcgcgacgagctggcctacgccgagctcgtccgcgccgccaatccggggctcgccgccgcccgcctcgacgcgaagtccgctgccttccaggcgagcgcgacggtgagcgcggtgctgccgcaggtgaacctccaggtcacccacgcctcgaccttcggctacagcccgacgctcgaccgcatcaccgacacgaccgcccgggtgatcgcgcgcgtgccgatctaccagccgggcgccttcccgaagatcgacgaggcctccgcgctcgcccgccagcggggctacgaggtgcaggaccaggaactggccacgatcaccgcggcccggaccgccttcgccaagcgggtggcgatcgccgaccagctgcggcgcctgaccgagcggctgaccttcctgcgcgcgacgatccggggtttcgaggtggagcggggtgcgggcttccgcaccgtgctggacgagctgaacctgcgggccgaactcgccgacgcggaggtcgccgccgccgccgtcctgaccgagcgcgacgcgctgagcctccagctctcggcggccgcgaatctcctcgacgtcggccagagcgtgccggcggaccggcgcttcgagacgctcgccgcggtgcgcgacccgctgacgaccgccgccctgcggcgcggcggcgcggcggcatcggtgaagctcgcgagccgcgccgggggagaccgcccggagcccgcagcacccgccctgcgcggccggatcgacgagccggcgcaggcgcgcttcgggctcgtgccctacggccgcaccggctgggtcgccctgacgccgtga

SEQ ID NO: 8352 - DNA, 954 bp, Methylobacterium sp.
atgacggagatcgacacgcgcatcggttttctcgcgcgccggatcgccggcctgccgctccggatgcggcgccgggtgctcagagcgaccttcaccctctcgggcctgatgcgcggcttcgagaagtccggccatgcccgcctgttccagcgcgtcctgcgccagtcgagccgcgaggcgcgccgcctggagcgcgaggtgaacctgcacaacctgcagaccgaggccgagtggctggcgctcctcgtgcgcagcgtgcccgcgctcctgcgcgacacgcggcatgtcgcggtctcggatccggccgcgctggagcgggtcgccgcgaccgggcgccccgtgatcctgacgccgctccacatgggcgcctacgtgttctcgctcgccagcctgatggtgcgcttcttccccggccggccgctcctcgttctgcgccagcgcgacgacatgcccctggagaccgcggtgatcgagcggatccgcgaggtcggcgtcgcgatgcgcttccatcaggtcaccgaccggatgggcttcctcgaggccgtgcgcttcgcccgcaacggcgcggtcatcgtgaacttctgcgatctcgatcccgcctacggcgcgcccgccccgatgccggtgctgggcctcgacacccgcttcgccttcggcaccgacacgctggcccggctcaccaacgcgctcgtcgtgccgctggcctgcacgatggagccggaaggcgacctcgtgcgggtcggccccaccttcgaggtccacgcgagcgccccgcaggagcgcgcccgcgtcgccgccctggtgcgcacccatatcgaggcgagcctcagggcgcggcccgagcagtggcacctctggtcggcgcttcaagactatttaccggtcaccgatacagtcacggacgccgccgcccggaccggggaggcggatgaacagatccggactgccgcgtga

SEQ ID NO: 8353 - DNA, 1230 bp, Methylobacterium sp.
atgacagacagggtcgcccccgcgccgcgcgtcaccaagcgctacgccgccaagcggcaggccatcctcgacgcggcggtcggccacttcaacgcgcgcggcgtgcgcgggaccgccctcaccgacgtggcggccagcgtcggcctcgtgaccaacagcatcacctactactaccgccggaaggaggatctcgcggcggcctgctacctgcgcggcctggaatggcataccgccctgctcgacgcagcccaggactgcgaagcggcgaccgacccggcagcgcggctgcgcgccttcctcgccgcctacttccgcgatctggccgcgatcgaggcgggcacacagccgccgcaggtccgcctcggcgacctgatggccctgccgagcccgcagagcgacgccgtgttcgccgcctacaacgacctgttccggcgcgcccgcgccctcttcgtgcccgagcgcgccgatctcggccgggcggagcgcggcgcccggacccatctcgtgctctcggtggtgcacacggcgcgcctgtggatcgaccgctacgagccgcaggattacgggcgcgtcgccgagcggatcgccgacatcctgctcggcggcctcgccggcccggacagccggtggtccgcggcggggccgccgctcgtgcgcgcgccgggcgggccgaccgagccgttcctgcgcgcggccaccgtgctgatcaacgaggagggctaccgcggcgcctccgtcgagaagatctcggcgcggctcagcgtgacgaaggggtccttctaccatcacaacgacaacaaggacgacctcgtcgccgactgcttcgagcgcaccttcgcgatcctgcgcgccgagcaggcggcggccgaggcgcggggcggtccgggctgggaccggctcaccgcctgcgcccgcgcgctggtgcgtcatcagttcgacccggggggcccgctcctgcgctgcgccgcggtcggggcgctgccggatgggctgcggagcgaggtgccggcgcggctccgccgcctgtgggaacggctcgcctttccgatcggcgacggcgtcgccgacggctcgatccggcccgtcgatccgacgatcgccgcccaggtggtgagcagcgcgatcgacgcggcctgcgatctcgggcgctggtgcccctcggccggcccggacaacgccccggacctgttcgtacgcccgctcttcctgggcatcctgacggcggggtga

SEQ ID NO: 8354 - DNA, 1269 bp, Methylobacterium sp.
gtgaccgcgctggacgcgcgcgcgccctaccagtcgcgcgccgcgcactgcgcgctgatgggcgcgctcctgttcaacgccgccctctgcttcctcaacacgatcggtctgcccgtgaccggcggcacggtcgccggagcggaggcctgcatcgtgatgctggcgctggccttcgcgctcgacgcgcgcgccggcccctggctggtcctcgcggttctggcggcctacgcgatcctgatcctcgtcctgcgcggctcgagcgacccgaagatggtgcgcgacctgctcatcccggtcgccttctacaatctcggcctgcgcgcgcccgacatccgcgacgccgaccgcgcggcgctcgccgcgggcctcgtcgtggtggcgatgggggtgttcgagtacgcggcccttccggtctacgagcagctcttcaacgtcgtgcgctactacatcgcccgcggcaccatgacggcggcggagatcaacgggctcaccggctcgctcttcgtcagcggcgtgcggccggacgcgcgcacgatcctgcccttcctggggccgcaccgggtctcctcggtcttcctcgaaccggtctcggcgggcaatttcggcgcgatcctgttcgcctgggggctctaccggccgggcatgcgcggccgggcgctgctcttcggctgcgcggccgtcaccatcatcctggcggatgcccgcttcggcgccgtggcctgcgcggcggtcgccgccgcgctgctggcggcccaccggctgccgcgcctgctctggttcgcgctcccttgcgcgatcctgctggcgctcgcgatctgcggcttcgagagcaccgcatcggaccggaccaacaacttcgtcgggcgcctgctggtggccgccgacatcatcaccgggctgcccgtcgagggcgtgctcgggatcagccccgagaaggtgttcgtctcggatgcgggctacgcctacgtgctgctccagatcgggctcgtcggcgggctggcggcgtggctgctcttcgtgctgatgccggtgggcagcgcggatgcgtggcggctgcgctgcgctgcggcgacctacatctgcctgctgctcgtcatcagcgactcgcccttctcgatcaagaccgcggccctgctctggttcctgctgggcgccgccgacggggcgggcgaagatcccggctgctccgaagaggaggtagcggcatcggccccctgtgcgggggctctcgtgagcccgtggccgggactttcggggatcgcgcggtag

SEQ ID NO: 8355 - DNA, 633 bp, Methylobacterium sp.
atgatcggagaattctacgtgttggcaccgtcaaggcagcgttatttggacctcctgccggactttggcaaaacgccagagcgcaagacgacggctgatagcgccggcatcatcggctacatcattgaagctgccaagactgccgtccactggattgcggaaagctggaccggagaaaccctgtcagagaacccggatccgaccaccgcctcgaatgaaagcagtctggtgcagatggcggtaatcgataaccgacaacttgtcctcaccggtgatgtcgggccagatgggcttcacgaggccgccacgtacgccgaggctctggtgggggtgctgtcaccgacgttcatgcaggtgccgcaccacggcagccggcgcaacgtgacgccatcggccctcaaccgctggcttggcccaatcaagccgcagggcagcgccactatcggctcagccttctgctcggccgcccgtctggatgaggatcacccgcgccagaaggttgttaacgccttcacccggcgcggctatggcgtgcacaaaactaagggccgccacatctacaaccatcacggcacccagcgtctaggcgattcgttggcgcccgaaccgttttctgatcgggtcgaagagtga

SEQ ID NO: 8356 - DNA, 741 bp, Methylobacterium sp.
atgagacttgcgccgggcctcgtactcggtgcgctgctcgcgccgctgccggtcgcggctgaggaggttgcggtggatgcgggcgtctggccctacgcggcggtgggcaagctcaacgtcgtgctcggggccaatcgccgtgccttctgcagcgccacgctgatcgctccacgtctcgtgctgagcgccgcccactgcctctgggacgggccccgtgcgcgctgggtcggcccgcagagcgtgcatttcgtcgccggctggcggcagggcacctacaacgcgcacgcggtcgcctcgagctaccgcaccggccccggctacgccttcggtacgacgccggcggatctcgcgcgggactgggccctgatcgtgctgtccgagccggtggacatccgcccggttcccctggctcccgcgcatatcgacgacacgccggagaacggccgccaggagatccgccgggccggctacagccatgcccgggccgagcgcatgagcgcgcagggccagtgcgcggtcgagaaccagagcgaaccgcctttgctgctgcacgattgccgcgccatcccgggcgagtccggctcggctcttctgcgaatgggggagggcggtcccacggtgatcggcgtgctggtcgcgcgccgtccggaagggacgggcgcccgctcgctcgcggttccggtccgcagtttccgggaggaggcggaccgcatgcgcgcagagctgtccccggtccgttaa

SEQ ID NO: 8357 - DNA, 804 bp, Methylobacterium sp.
atgcgcgcgcgctccggtctgcgcggcggtgcccgcctcggccatcgcggcgcggtcgacagcctgttccgcgacggcctggaggacgcctacgagccggggcgcctgatgggcagcttcggcgaccggatcgcggcggagtacggcttcacccgcgcggatcaggacgccttcgcgctggagagcctgcgccgggcgctggccgcacaggcggagcacgccttcgcgcgcgagctggtcggcgtgccgtccggcgcggctcaggttgagcaggacgagcagcccggaaaggccaagcccgagaagattccgaccctgcgcccggccttctccccggacgggaccgtgacggcggccaatgccagttcgatctcggacggggccgccgccctcgtcctggccgatgcggccggcgcggaagcagcggggctgacgccactggcccgcttcgtcggcacggcctcccatgctgggccgcccgcccgcttcgcctgcgccccggtccccgccatccgagccctgctggatcaggtggggtggggcgtcggcgaggtcgacttgttcgagatcaacgaggccttcgcgctggtgccgatgatcgcgatgcgggaactcggcatcccgcacgcgcggctcaacgtccatggcggcgcctgcgcgctcggccatccgctcggggccagcggcgcccgcatcgtcgcaacgctcctcggtgccctgaaggcccgtgggttgaggcgcggcgtcgccagcctctgcatcggcggcggcgaagcgacggctctcgccctggagatcacttga

SEQ ID NO: 8358 - DNA, 393 bp, Methylobacterium sp.
atgcgcgttctgctcgtgggctatgagccggaggtggtcgatttctcggatccggccttgccgcccggcctcgacgccgggaagatccgtcacgggatccgggtggctctggaggagatgcgcggtcgcggctggacggccgaggactgcctcatccggcccgacgatcaggccggtcccgcactgaaggcgaagctctcctccggcgccttcgactgcctcgtgatcggtgcgggtatccggggctggccgcgccatctgtccgtgttcgagcgcgtcctcaacgcggcccgggaagctgcgccgacggtcccgatcgccttcaacacgcgtcccgaggacagcgcggaggccgtcgagcgcgtctgcggcgggcagccgaccgccggatga

SEQ ID NO: 8359 - DNA, 189 bp, Methylobacterium sp.
gtggccccacctcagaccgtcgagttcggccgcgggctcagtccgcgcgatccgaccggcatcctgcgcggtcagggaatcagcagccgccacggtggcatcggcaacatgggcggcggctccggccgaagcgcgaacacgggcgtcgggctcggcggcatcggcgccaatcagggcgcccggttctga

SEQ ID NO: 8360 - DNA, 1002 bp, Methylobacterium sp.
atgcaacgccgcagtttcctcatcggcgccggagcagcgctgggcctcgggcggacggcccgcgccgacgtcgtgaaggtccgcatcggcgtcggcggcaagcccctgctctactacctgccgctgacgatcgccgagcggaagggcttcttcaaggaggaaggcatcgacgccgagatcaacgatttcggcggcggcgcgcgctcgctccaggcgctgatcggcggctcggtcgatgtggtcacgggcgcctacgagcacacgctgcgcatgcaggccaaggggcaggacgtgcgggcggtctgcgagctcggccggttgcccgccatcgtcatcggcgtgcgcaaggacctcgccggccaggtgaagagcgtggccgacctgaagggccgcaagatcggcgtgacggcgccgggctcctcgaccgcgctgaccgcgcagttcgcgatgatcaaggccggcctgaaggccaccgacgcgccgctgatcggcatcggcggcggggccggcgccatcgcggcgatgaagaagggcgagatcgacgcggtttcccacctcgatccggtgatcgcgaagctggaggcggacggcgacatcaaggtgctggtcgatacccgcaccgacgagggcacgcgcctgctgttcggcggcccgaacccggcggcggtcgtctataccaagcaggactggatcgagcgccacgcgatgggcacccagaaggtggtcaacgccttcgccaaggcgctgaaatggctcgccgccgcgagccccgaggagatcgccgacctcgtgccgccggcctaccatttcggcgaccgggcgctctacgtgcaggcggtgaagaactcgctcgcgacctactcgcgcaccggcattccgagccgcgacggcatgaacagcgtgctggaactggtccgcaccctcgacccggaactgcagggcgcgcagatcgacctgggcaggaccttcgaggaccgcttcgtgaagcgcgccatggagtag

SEQ ID NO: 8361 - DNA, 849 bp, Methylobacterium sp.
atggacggcagccggcacggctcggccgagaggatcgacgcgcgggtgccgcaggacgcggccgtggcgctgcgcgacgtcaccatcgccttcacgctcaagggcggcaagcgatacgtcgccgtggagggcatcgatctcgcggtgcggccgggcgagttcgtcgccgtcgtcggcccgacgggctcgggcaagtccacgatcctcaacgccgccgcgggcctgctgaagcccgcctcgggccgggtcgacatcttcgggcaaccgctcggcggcctcaacggacgggccggctacctcttccaggccgacgcgctgatgccgtggaagaccgcgctcgacaacgtcgcggtggccctcgaaccccagggcgtgcgccgggccgaggcgctggagcgggcgcgcgcctggctcggccgagtcgggctcgcgaccttcacggaccgctacccgcacatgctctcgggcggccagcgcaagcgcgtggccctcgcccagatgctgatccgcgaccccgagatcctgctgatggacgagcccttcgggccgctcgacgcgcagacccggcagatcatgggcaacctgctgctcgacctctgggcgcagaaccgcaaggcggtgatcttcgtgacccacgacctggaggaggcgatcgcgctctccgaccgggtgatcgtgctctcggcgggccccgccgcgcgcatcgtgggcgacttccccgtgccgctcgcccggccccgcgacatcagcgagatccgcctggagccccgcttccacgacctctaccgcgagatctggtcctgcctgcgcgtcgaggtcacgcgcgcctatgccgacggcccggcctga

SEQ ID NO: 8362 - DNA, 213 bp, Methylobacterium sp.
atggccaacaccatgaacgcccagtgccagagctgccgctacttcgacacgcacaaggccacgcagtcggccggccagagcggcgacgagggtctgtgccgcttcaacccgccggtgacgcagccggggccgcaggagcacggtctctggcccgtcgtgtcggcgtccgactggtgcggccactactcgcccgagatgatggccggcgagtaa

SEQ ID NO: 8363 - DNA, 1263 bp, Methylobacterium sp.
gtgtcggcgctcgccctggcggggctcgcctccgcggccgtggcgcaggaggcgccgcctcttccgcgggcggaccccgccgcgatgggcttctcgcccgagcgcctcgcccgcatcggcacggtgctgaaccgcgaggtggcggagggccggatgcccggcgccgtcctgatcatcgcccgcgagggcaaggtcgtgttccacgaggcctacggcttccgcgacaaggccgcgggcgcgccgatgccgcgggacgccctgttcaacatcgcctcgatgacgaagccgatgaccgcggtggcggtgctggggctcgtcgagcgcggcgacctcgtcctcgacgatcccgtgagcgccgccctgccgggccgcttcgccgagcagcgggtcgcgagcctcgacctcgcgggcaagctcgccggcaccgtgccggccgcgcggccggtctcgctgcgcgacctcctcacccataccggcggcctcgtctacggcgggcgcggcaccacggaggtgcaccggatgctccccgcgggcagcgtcgcggcggccaaggagctcgacggcgagaaattcctcgacgcgctccaggcggcgccgctgctgcaccagcccggcacggtctgggattacggcttcggtctcgacgtcgccggcctcgtggtcgagcggcagaccgggcggccgctcgacgcccatctcgccgagaccgtgttcggcccgctcggcatgcgcgacaccggcttcgtgatcccgcccggatccgtggaccgctacgcccgggcgctccccgcggatccggcgaccggcaagccgcaggtgctggagcccgacgccacccggccgacgaagttcgcctgcggcggcggctgcgccgtgtcgagcgcggaggattacctgcgcttcgccctggcgctgatgaacgagggcgagctcggcgggcgccgggtgctgagccccgtcttcacccgcgccatgctcaccgaccagctcggtcccggcgtgcgcaacctcatcggcaacgccgacccgacccgggccgattacggcttcgggctcgggctcgcggtgcgcacccggcccggcgtggtgcggctcctcggctcggtcggcgacttctcctggccgggctccagcggcacgaactggtgggtcgacccgggccgcaagctcgccgtggtcttcatggcccacacgccgggcgccgcccgctggcgctaccgctacctgatcaacagcctcgtctatcaggccctggagcggtag

SEQ ID NO: 8364 - DNA, 264 bp, Methylobacterium sp.
atgatccgcatcgtgaagcacgtcatcgtggagacgaccgaggagcgcgatcgacaggtcgagcaggtcgaggcagcgatccgggcgcggtttcccgatgccacgacggaggtcgtgcagggactgctggacgaggacagggtggtcgaggcgcggctgcccctgcggcagctcgccgagtggcatgtgcggcgcccgcaactgctcgccgaagcgttggagaccgacacggatcacgccgccgacatcgaccggcaggattga

SEQ ID NO: 8365 - DNA, 393 bp, Methylobacterium sp.
atgaagcgcttcagaccgatcgtgatggcgggcaccatcctgggtgccgtcctgggcaccgtcctgggcctcgggccgatcgagagagggacgaccggctccgccgtggcgctggccgcgcagggctgcggccccggcttccaccgcaacgcctacgggtcttgccggccgaatgcctacggggtgccgggcacctaccggccctacggcgcctacggctatcgcggcggctacgcctatcgcggcgcctatggacggcgggtctacggcggccgcgtctacggcggccgcgcttacggcgcacgcgcctatggcgggcgcgtctcgggcggccgggtccgcgccgggcgcgcctacggcggctatcacgggggcttgcgcggccggcgatag

SEQ ID NO: 8366 - DNA, 249 bp, Methylobacterium sp.
atgcgataccgcccgctgccgcggcagaccctcgtcctcgccggcgccctcaccggcctcgtcgtggccctgccgagacccgcggaggccgtcgtctgcgcgggcggcgtctaccgggccggctgcgtcggcccccgcggcggggtcgccgtacggcgcggcgtctacggcccgcggcgcgtcgtcgtgcggggcggcgcctatcggccgcggaccgtcgtctatcggcgcggcgtccgccgctggtga

SEQ ID NO: 8367 - DNA, 828 bp, Methylobacterium sp.
atgtccgagtccccgaccgatccgggcgcgcgcgcctggtcctgcgaccgcttcgagatcgacgcggtcgcggtctgcgacatgccgctcaccgccgtgttcgagcacctgcgcggcgccatggacgacgggcggcaggtcgcgctcggcttctgcaacgccaacatgctgctgaaggcgctctgctcggcgagctacgcggcggcgctgaagaagctcgtgctcctcaacgacggcgtggggctcgacctgtgctcgctcctgttccgcgggcgcttcttccgcgagaacctgaacggcacggacctcgtcccggccctgctcgggggcgagacgcgggagcggaccctgttcctcctcggcgccaggccgggcgtcgccgaggcggcggcgcgcaacatcgccctgcgctatccccagcaccgggtcgtcggcacccggcacggctacttcgcgcccggcgaggtcgaggcggtgatcgccgagatcaacgcggtcgccccggacatcctgctggtcgccctgggcaacccggaccaggaaaccttcatcgccgagaacgcgcaccgcatcgacgcgcggatcctgatgggcgtgggcgcgctcatcgactacacggccggcatcgccgtgcgggcgcccgcccccgtccggctcctgcggctcgagtggctctaccgcctgatgcgggagccgcgccgcctcgggcgccgctacacggtcgagctcgcgctgttcctcggcctgatcgtccggctccggatcgcggcgctggtacggggccggacggtcgtcgcggcaggcggggccacctcctccgccccgtga

SEQ ID NO: 8368 - DNA, 1044 bp, Methylobacterium sp.
atgcggcgggctgaggcggtgccgcgcgccgccgcgctccgcctcgccctcgccctcgccggagcggccggcgttccggcccgggccgcggagcccgcctgcctgcgcggggtcaacctgagcgggcccgaattcggcaccgtgccgggccgccacggcaccgactacgcctatccctcaacgcggacgattgcccgcttcggcgccctcggtctcacgggcgtgcggctgccggtgcgctgggagcggctgcagccccggctcggcgcgcccctcgacgcggcggagctgctgcgcctcgacgcggcggtggtcgcggccaagctcgccggcatgcgcacggtgatcgacctccacaacttcgcctattacggggcggaccgcatcggcaccggcgcggcgactgctgccgccttcgcggatgtctggcgccgcctcgccacgcatttccgcagcgagcccttcgtcgccttcgggctgatgaacgagccccacgatatcccggccgcggactggctgcccgcggcgaatgccgcggtcgcggcgatccgcgagtccggcgcgcctcagctcgtgctggtgccgggcacgatctggacgggtgcgcatagctgggagtccgacacgccgctcggcaacaacgcccgcacgatgctgggcctcgtcgatccgggggagaacgtcgcctacgacgtgcaccagtacctcgacgccgacttctcgggcacgtccggaacctgcccgcgcggcgccgacgctctcggcgccgtagagcggctgaccggctggctcgcgcagaatcgccgccgggcctatctcggcgagatcggcgcctcgatgcaggccggctgcccggaccagctcgccgccatcctggcgcacgtgaacgcccatccccagcagtgggtcggctgggccgcctggggcgcgggcgactggtggccgccggcctaccatttcaggctggagccgggcacgggcccggtcaccgcggtgatccaggccgccgcccgtgcggcgccgcgctgcggggggcgcccgtga

SEQ ID NO: 8369 - DNA, 1161 bp, Methylobacterium sp.
atgcaggtggatccggtcgtcgtcgccagtgcggcacgcacgccgatgggcgcgttccagggagagctgaaggccctctcggctccggaactcggcgccgccgcgatccgcgccgcggtcgaacgcgccggcctctccagggagggcgtctcggaggtcgtgatgggctgcgtgctcccggcgggcctcggccaagcgccggcgcgccaggcggcgctgggggcgggcctgcccgagggcacgccctgcgccaccctcaacaaggtctgcggctcgggcatgaaggcggtcatgctcggccacgacatgatcgcggccggctccgccgacgtggtggtggccggcggcatggagtcgatgtcgaacgccccctacctcctcgacaaggcgcgcggaggccatcgcctcggccacgggcgcgtcctcgaccacatgttcctcgacgggctcgaggatgcctacgaccgcggccggctgatgggcaccttcgccgaggacacggcgcagcactatcaattcacccgcgaggcccaggacgcctacgcgctggagtcgcttgcccgcgccaagcgcgccgcggaggcgggcgccttcgacgcggagatcgtccctgtctcggacctggcatcggacgagggtccgcggaaggcccggcccgacaagatcccgacgctcaagcccgccttccgcccggacggcaccgtgacggcggccaacgcctcgtcgatctcggacggcgcggcggcgctcgtgctgatgcggcagtcggcggccgagcgcggcggccacaccccggtcgcggtgatccgcggacacgccagccacgcggcggcccccgcctggttctcgacggccccgatcggcgccatgtccaagctctcccggaaggtcggctgggccctggacgatgtggacctgttcgagatcaacgaggccttcgcggtcgtcgccatggcggcgatgcgcgatctcggcctgccccacgacagggtcaacgtccacgggggcgcctgcgccctcggacacccgatcggtgcgtcgggcgcgcgcatcgtcgtgaccctgctctccgccctcgcgcgcaccggcgggcggcgcggcatcgccgcgctctgcatcggcggcggcgaggccacggcgctcgcggtcgagcggctctga

SEQ ID NO: 8370 - DNA, 885 bp, Methylobacterium sp.
atgacgaagttcgtcctgaccgtgacctgccgatcgacccggggcatcgtcgcggcgatctccggcttcctggcggagcagggctgcaacatcgtcgacgcctcgcagttcgacgatcttggcagcgggcgcttcttcatgcgcatcgggttcctgtcggaggaggggaggggggcggaggccctcgccgcgggtctcgcgccgatcgcggcgcgcttcggcatggagacggcgatccacgatgaggcccagcgcatgaaggtgctgctgatggtctcgcgcttcgggcactgcctcaacgatctgctctatcgctggaagatcggcgcgctgccgatcgacatcgtgggcgtcgtctcgaaccacttcgactaccagaaactcgtggtgaaccacgacatcccattccaccctgtggccgtcacgaaggcgaacaagccggaggcggaggcgcggatcatggagatcgtgcgcggcaccggggccgagctgatcgtgctcgcccgctacatgcaggtgctgtccgacgcgatgtgcgcggcgatgtcggggcggatcatcaacatccaccactcgttcctgccgagcttcaagggagccaacccctacaagcaggcctatggccggggcgtgaagctgatcggcgcgaccgctcattacgtcacggcggacctcgatgagggaccgatcatcgagcaggacacggtgcgcattacccacgcgcagagcgcggaggactacgtctcgctcggtcgcgacgtagaggcacaggtgctggcccgagccatccacgcccacatccaccatcgcgtcttcctgaatggcaaccgcacggtggtcttccctccgagcccgggaagcttcgcgtccgagcggatgggctga

SEQ ID NO: 8371 - DNA, 363 bp, Methylobacterium sp.
ttgaacggcgagcgcctctcggaggtctcgcggctcgcaggtgtcctggcggatcaggtgctgctcgagcccgtggacggcgacacgtcgctggcgaagctcaccgcgctcggcaaggcggcgctgctgctgcaggattacgaccgcccgattccggatcgggtcgtggacgtgctcggtcgagcgcttcgcgggacggaagaggacggtgccgcggcaggcgggacgcctgggaccgacgccgcggccggtgccgaggagggaggcggagaggtcgccacgatgccggcggcggaggacgacgggggcccgcggcgcctgttcccgcgcctgatccagtccctgcgcccgttgcgcgggtag

SEQ ID NO: 8372 - DNA, 741 bp, Methylobacterium sp.
atgctgaacgcgcgttgcctgcaccggcccgagctaaccgccacgctcgccagcggcgaccgcaagctcgacaacctgaccgccccccatccgcgcaccttcgcggcgggcacaacgatcgtcccgcagggtacggagcacggctacgtctaccgcctgcgtaccggctgggtcggccgcgtgcgcgcgctgccggacggacgcgcgcagtacctgatggtgttcctgcccggcgacctcttcgccatcaagagcgtcttcgtcgcggcccacccggacgcggtcgtggcgctgtcggacgtgacggtcgagcgcctcgagcagcatcgcctgcgcgatgccttcgataccgatcccgagatcgccctgcgctgcacgtggcagatcgtcgaggaggagcggcgactgcacaattgggtggtcagcctcggccagggcagcgcggaggagcgcatcgcccacgtgctgctggaattcagcgtccggctcggagccgccaccgggacggcgcgcgccctccagtacgggattccgctgacgcaggaccagctcggcaacgtgctcgggctgacctccgtccacgtcaaccgggttctgcggcgcctgcgggaggacgggctcgtcagcatccgcaaccgggtggtgagcatccacgacgcgccagccctggagcgcatggccgagccgcttcgggacgccacccttcaggccacggcacgtcccgaagtcgcggccggctga

SEQ ID NO: 8373 - DNA, 912 bp, Methylobacterium sp.
atgttcgccccgggccgcctgacagttggtgttttctttcccatcgaggccttccagcgcgaccagccaaccatgcgcgaccaagagcgtctggcggttcgggcggaggagctcggctacgcggcgctctggatccgcgatgtgcccttgcgggatcctgatttcggcgacgttggtcaggtctacgacccatgggtctggctcggctggatcgccgcgcaaacgcgcgagatagcccttgcgaccgggtcgatcgtcctcccgcttcgccacccgctccataccgccaaggccgccgcctccgtggaccggctgtcgagaggccggttcattatgggagtggcctcgggagacaggccgatcgaattcccggccttcggcgtgcttgccgacgagcgcgacgttctgttccgcgaaagcatcgccgtcatccggaaggtcctcggagaggagttcccggccctgcattcgcgcttcggagaaatgctcggccacgtcgatctcgtaccgaagccgatcggacggctaccgatcctcgtcaccggatcgagccggcagagcctggaatggatcgccgaacatgcggacggctggatcacctacccgcgcccgctcgagcgccaggccgaactcgcggcccggtggcgggcgaccgccgcgggtctggcgccgggtacgttcaagccgttcgcccaatccctctacatcgatctacatgccgacccgcattatccgccgcaacccattcaccttgggttccgcagcggtcgcaaagccctgctcgactttctggtcgcgctccgctcgatcgacgttcaccacgttgtcctgaacctcaagtacggttcccgcagcgcgggcgaagtgctcgaagagatcggcctcgaggttttaccgcatctgaatgcatag

SEQ ID NO: 8374 - DNA, 216 bp, Methylobacterium sp.
atgcgtgccctccccatccgtccgccggccctgcagctccgccacgctcggcaggaccatgccgtctgcctgcgcctcgcggcctcctaccggacgcgtctgctgtgcggcgaacccgatctggccgagcggcacgccgaggtcatcgagcatgcccgccggctgcgccgccggttcgccggcctgagcctcgaggcccgggcctcgccggcctga

SEQ ID NO: 8375 - DNA, 2127 bp, Methylobacterium sp.
atgccgtcctgcccgcgcctggcctcctgcgtacccgcctcggaagcgatcgagccgctctcgttcgagaccatgctggaggtgctgccggtcggcgcgatgacctgcgacctgcgcaccttcacgatcgattacgcgaatacctgctcgatccgcctgctgcactccatccgcgacagcctgggcatcgatccggaccggatcgtcggcacctcgatcgacgtgttccacaagcagcccggctaccagcgcggcctgctctcggacccggcgcgcctgccccacaaggcgcgcatccgcttcggcgacgagtggctcgacctgcacatccacgcgctgccggattcgcggggccgcgtcgtgcgcgcgctcctggtctgggcgatcgcgaccgcggaggtggccaaggagaacgaggagtacaagctcctgcgcatgatcgacgacatgccggtggcggtgatgacggtcgatccgacgagcttcgcgatcacctacctgaacgagacctcgaagcgcacgctctcgcagatcgagaccctgctgccggccaggcccgaggcgctgctgggcgcgtcgatcgacatcttccaccgcaacccggagcaccagcgccggctgctcgcctccccggagaacctgccccaccgcgcccggatcaagctcgggccggaggtgctggacctgcaggtctcggcggtcacgggaacggcgggcgactatatcggcccgatgctgacatggtcggtgatcacccagcaggtggccgccgaggcgcgcatccatcagctcgcccactacgacacgctcacggggctcgccaaccgggcgaccttccgcgagcacctcgaggccgccctggaccgggcgcagccccgcctgggcctgctcttcatcgacctcgacgggttcaagctcgtcaacgacgccaacggccacctcgtcggcgacgccctgctcaagcgggtcgccgagcgcctgcgcgaccgctgcggcgccccgggcgtgatggtggcgcggctcggcggcgacgagttcgcgatcctgatccaggacggcgacgacgcggccgcgacccggctcgcgggcgacctcgtcgaggccctggtggagccgttccacgtcgcggacgagcggcgcctgcaggtgggggcgagcatcggcgtcgcggtggcgccgctgcacgggagcgattccgagacgctgctgtcgcgggccgacatggcgctctacgccgccaaggccgccggcaagaacaccttccggctgttcgagcccgagatggagcggcggatgacccagcgcgtgcgcctggaggcgaagctgcgccgggcgctggagcgcgaggacgagctgttcctgttctaccagccgatcaccgacatccgcaccggccgggtcacggcgcgcgaggggctgatccgctggcaccatccggcacgcgggtggatcccgcccggcgatttcatcccgatcgccgaggagagcgggctgatcgagaagctgggcgcctgggtcctgcagcgggcctgcgcggacgcgatgggctgggaggacggggcgcgggtcgccgtgaacgtctccccgcgccagctcggcagcggccggctgacccagtccgtcctctccgccctggtggcgagcggcctgccgccgcagcgcctggagctggaggtgacggagagcgcgctgctcagcgagcacgtcgactgcctgggcgagctgcgccggatccgcggcttcggcgtgcgcatcgcgctcgacgatttcggcaccggcttctcgtcgctggcgcatctgcgcgcctttccgttcgacaagatcaagatcgacgggtccttcgtgcgcgacgcgacgagccggccggactgcgcggcgatcgtcggcgtggtcgccgatctcggccgccgcctcggcgtgaccacggtcgccgagggcgtcgagacggaggcgcacctcgccctcgtcaccgcggagggctgcagcgaggtccagggctacctgctcggccgcccccagccgcacccgcgcgacgcggagcgggtggcgcggctctcggcgcgagacgctgcggaacgccccgccgcgccgccggccgacgacgagagcgccagtgccgcggcctga

SEQ ID NO: 8376 - DNA, 279 bp, Methylobacterium sp.
atgcgcaatccctacgacgtgctgggcgttcccaagaacgcgagcgaggccgacatcaagaaggcctatcgcaagctggcgaaggcctaccaccccgaccgcaacaaggacgacgccaaggcgaaggaccgcttcgccgaggcgaacagcgcctacgagatcatcggcgacgccgagaagcgcaagcagttcgaccgcggcgagatcgacgccgacggcaagccgcgcgcgaccgggttcgaggggttcgggggcggcttcggcggcgggcgcggcttg

SEQ ID NO: 8377 - DNA, 1476 bp, Methylobacterium sp.
gtggctgaatttacgggcggaactggcagcgatacattcgcgggtacgtcggccgacgatatcatccgggggcttgccggcaacgacacgcttacgggcaatggcggcaacgacctgatctacgggaaccagggcgacgacgtcatcctgttcggtactgcgaccggcagcgcgctcgccggcaatagcaccctctacggcggtcagggcgacgattcgatcgactacaccggctcgacgggccgcaacctgatctacggcaacctcggcgacgacacgctgacgggcggcaccggcaacgatacgctcttcggcggccagggcgacgacgtgctgaacgccggcggcggcaacaacctgctgttcggtggcctgggcaacgacacgctcaccggcggtgacggcaacgacaccctcaccggcggcgacggcgacgacagcatcgtagcgggcagcggcgacaacctgatctacggcaaccagggcgatgacacgatcgtcggcggcaacggtgccgcggcatccgacaccgtcttcggtggccagggcgacgatctggtcgattactcgaccgcggccggtgcgaacgccatctacggcaacctcggcaacgatacgctgatcgccggcagtggcggcgacagcctgttcggcggtcagggggacgacagcctcgtcggcggtgccggcaacgacctgctggtcggcggccagggcaacgacacgatcgtcaccggccagggcggctcggatgtcgtctacggcaaccagggtgacgattcgatcacttacggcacaccggccgggactgcaggcgtcgacactgtttacggtggacagggtaacgacgttgttgattacagcctcaacaccgcgggcggcaacgtcgtctacggcaacctgggtgatgacacgatcacgggcggtgaaggtttcgacttcctttacggcggccagggtaacgacgttatctccggctacggctacctgagcggcggccagggtaacgacagcatcactgctgttggcgaggcgggctcctacctcctcggcggccagggtgtggacaccctcacgggtagcctcgcgggcaacgacaccttcgcctttgcggccggcgattcgggcatcaccgcgtcgacatccgacctgatcacgggcttcggcagcggcgacagcatccaggtgcaggtcgtgggtggcgtcgttcgtgccgagaaccgcgcggctgccggacggagcttcgatcagcagcgcgagctcgccaacgaagccttcgcgaatggtcaggccaacgcgatcttcatcacgggtgcaccggctgcggacggatccacggctgcctcgggcggctacctcttcgtcgacaccgatggcagcggaacggccgatatgtcgatccgcctgacgaacggcacgctcggcgatggcgatggcgtcgttcagcgctacaccgctccgacgcccgacgcctga

SEQ ID NO: 8378 - DNA, 120 bp, Methylobacterium sp.
atgacgaagctcgacgcgaagaccctgaaggccgtcaccggcggcaccgcctgccctccggccaaggacccctgcgccccggcctgcaaggacaacggcggcaagtccaagaagtgctga

SEQ ID NO: 8379 - DNA, 120 bp, Methylobacterium sp.; identical to SEQ ID NO: 8378

SEQ ID NO: 8380 - DNA, 174 bp, Methylobacterium sp.
atgcggacctgcctgctcctcgccctcgcgaccggcctcctgggtctcggcctgcgcctcgtcctgccggtgattccggccgacgccgccttccgcgaggtggtgcgttactacggcgcggaccggcccccgggcgaatccggcaatatgcgcgaaacgtcggcgccgtactga

SEQ ID NO: 8381 - DNA, 174 bp, Methylobacterium sp.; identical to SEQ ID NO: 8380

SEQ ID NO: 8382 - DNA, 105 bp, Methylobacterium sp.
atgcagaagacgatgaaggcgttctcctacggcatgatcggcgcgttcgtggccggtctcggcctgaccctctggggctcggccagcctgctcgcgggcctctga

SEQ ID NO: 8383 - DNA, 201 bp, Methylobacterium sp.
atgtctcagagaatcaagcccgaccgcccgatctggccgtcgctgccggagaccgaggtcagagccgtgccgtcgtccgggccggccgaggcaccccgcgccgcgccgctgcagggcggaagcggaccgggggcggccggaccgcaggcgcagcgggtggcgaccgccacggtggaggccttcggatcgctcgccggctag

SEQ ID NO: 8384 - DNA, 489 bp, Methylobacterium sp.
atgagcgatttcgccggttcctatctcggagagctgcgccggctggtcggctcgcggctgctgctggtgcccggcacccgcgtcgtggtgagcgatgcgggcggccggatcctcctcgagcagcgctccgacttccgcctctggggactgcccggcggggtgccggacgcgggcgaggacatcaccgcctgcgccgtgcgcgaggtcttcgaggagaccggcctgcggatccgcgatccggtgccgttcggcttcgcctccgcgccggagcacgaggtctggacctacccgaacggggatcgctgccactacttcacgttgctctacgcggcccgcgccgagccgggcccgctccggcgggcgggcggcgagaacctggagctcggctggttcgagccggagagcccgcccgacctgatgccgaccatggcccgcaccctggacgcgtaccggcgctggggcggaagcggaaccttccagatgctctga

SEQ ID NO: 8385 - DNA, 1110 bp, Methylobacterium sp.
atggaacagaccctgaccgacggcgtgccggcctctacggccggcggggctgatctctttcacgtcgcctacccgcgcgtgctaccggagcggaagccgcccggccacaagccggcggcgccgcgctacaccctgcgctggcacaagcccgtcggcacgatggtgagccagtatcacgcggtccagaggacggacctagacctagagcagcgccgcgccttcttcgacctgatgatcggaagcttcgcggagcccgacgggccgtgcgcgcacgagatgatgacattcgtcgacgagcaaggcgagaccaacgcggtcgtggcctcctactggctcgacgcgacggcgcacgcgcgatggagcgtccgcgccacagcctcccgctggttcgcggacccggagcgacagaccggcccgaccgggtgctggcgcgagaccatcgcggtcccctacgatcggcacgagacgatctactcggagccgcattaccggatcgggctggcacgcaccgcggatgcagcgatcgtgccgatgacgaccaacgggtacttcggggccgcacgggaccggctgccgatagcggcgatcgaccccctcgacagcccgctggcgagtgatccgccgcgagcgcgcacgctcgagagccgcgggtgccacctgctcgcctcgacgccacacaacatgactgcactgcgctccggacagttctggcaagcggcgcaagcggcacaactagaggattacgttgagaatatggagcccaagttgatgcgagggatggattatctctcgcacaacaagaccgagagtggaacgctgtcgcttcgtgtgatgaccaatctggatgatgacggtcgcgagaaggccgagacgtcggtccttgcctacttcctatcgatggaacagctcgagggctgggccaagtcgcacgatactcatctcgacatctatcggcacgcgatcgcgatgaaccgcaagtttaaggcgagccgtgaagtcgtgacgtggcacgagctgttcgtgatgccggcgtgcagcgcgttcgagtacgtcaactgccatccgaagaccggggttctcccgttcgttgccgcgtatcgcgtggcgtga

SEQ ID NO: 8386 - DNA, 387 bp, Methylobacterium sp.
gtggcggccgatgagcttcgacagttcattgagcgcatcgagcgcctggaggaggagaaggctggcgtcgcgggcgacatcaaagatgtgttcgccgagctgaagggtcggggcttcgatgccaaggccgttcgccaaatcctgcgcatccgcaagaaggatcacgccgagcgccaggaagaggaagcgatcctcgaactgtacatgggcgcgctcggcatgcttgccgacacgccgctgggccgcgccgcgatgagccgcgagttccaggatgcccggatcacgatcagcgggaacggcatcgacacgatcgagaccacgggcgccggaatcgcgcaggcgacggctcgcatggagctccaggcctcggtcggcgggagacgctga

SEQ ID NO: 8387 - DNA, 927 bp, Methylobacterium sp.
gtgggcttcgtcgaactcggccgccagagccttccggccgcggagcaccggcgcgcggagctcggggcgcgtctcttcggtgaccggcgcctcgacgcggacggacgcctcgcctgcaccggctgccacgaccccgcgcagggctggaccgtgcgaacgcctgcagcgccgggccagcgcggcagggccgggcgccgcaatccgccgggcctgcgctccgccgcggccgcgacggcatggggctgggacgggcggcaccgcacactcgccgcgcaggtgctcgcccccctgaccgaccccggcgagatggccaatcccgggctcgcgcccgtcctcgcccggatcggcgccgatccgggctacgcggcggcctttgcggcggccttcccgggtgcgggtctcacggcgggcacgctcgcggacgcgctcgtcgcctacctcgccgggctcgatgcgccgacccggttcgaccggttcgcctccggggacggcgcggccctgagcgaccgggaggttgcgggcctgcacctgttccgcacccgggccggctgcgccaactgtcaccacgggccgctcctcagcgacggtcgcttccacaacctgcgcctgtcggccttcggcgagccggcccaggatctcggccgccacgcggtgacgggcgcggccgaggatgccgggcgcttccggacaccgggcctgcgccacctgcgcgagaccgcgccctacggccatgccgggctcttcgaaacgctcgcgggcgtggtcaacctctacgaccggggcggcggcgagatctgggcccgcaatgccgccgaggccgcccgcccgctccacgcaccggcggcgcggctctcgccgcacatccggccgctcgggctgacggatgcggagaaggcgagcctcgtcgcctttctcgagacgctctga

SEQ ID NO: 8388 - DNA, 516 bp, Methylobacterium sp.
atgagcgacgcccttccggcgcctctggcgcccccgcagcctgcccgccccgagcggccccgcctgcgtaccctgaccatcgtggagaacggcgagccggtgcagaacgccgccttctgcccctggtgcgaggacctgcacttccacggcctgccgccgggccaacgcggcgcgcactgcgtccgtgaggactccccctaccgctgcaccggctacgtcctcgacgtgcaggggacggtcccctctgccggggccgcggtcccggacgcgccccggccccgcggccggtatctgcaccagagcctcgaccaagcctcggcgtcgctgcgccgggtcgtgctgcgccacgtcctcggccgcaagttcgcgggcacctggggcgagggcaaggtcggccgtgccgtggtgagcgtgtgctgcgaccactggaccccggccaccgtgccggaatgggtcggaggggaaggggtttttagaaggaagcggtgccccgcagtgggatcgggagccgtgtaa

SEQ ID NO: 8389 - DNA, 312 bp, Methylobacterium sp.
atgagcgcatcgaagccgcgcccgaccctcgacagcctcgccagccgcttcgctcggaaggatccgcccgcaggtgcgccggcggcgtcagcccagcccgaggctgcggaagtggccgcgcccgccccgtcgacggccgaggcctcgccgccggccagcaagccggagaaggacaagcgggtccagatcctcacgcgcatcgacgcaccgacccggaagcggctgcgcctgatcgcggtggagcaggaccgcaccgtgcaggagatctgcgagcaggccattcgggacttcgtcgcgcggcacagccggtag

SEQ ID NO: 8390 - DNA, 1035 bp, Methylobacterium sp.
gtgatccgccttctgaccccgctcttcgccgcctccgtcctggccgcatcgatcctcccagggcaggcagccgagaagctcgtcgtcagcacgtggggcggcagcttccgagacctgatcgacgaggccatcgcctcgaagttcaaggccgagaccggcgccgaggtcgagtacatcaccggcggcaccatcgatcggttgaacaaggccaaactcgccaaggacgcccccgagagcgacgtgaccttcaccaccgcccatgtcggctggctctacgtcaacgacggcctcttcgagacgctcgacctcgcgaagatcccgaattcgaagaacctcgtcgaccaggccaggatcagccccgcgcatatcggcacatggggctacgtctacacgatcggctaccgcgcggaccttgcgccaaagggcatgaccttcggctcgtgggcggatctctgggatccgaagctcaagaacagcctcgccgcgcccgatttcgatccgagccatatcatcgcggtctcggcgatcctcgcgggcggcgacccggccacctgggagaaggggcaggccaagctcgaggcgctgaagcccaatttccgggccttctacaccaacgacgccaacagccagcaactcatcgccaccggtgagacgcccgtgcaggtcgtgctgaccatgaacgcctattacatgaagggtcaggacgtgccgatcacggtggtgatcccgaaggagggcggagtgctcggcatcgacacggtggcgatcaacaagggctcgaagaaggccgagctcgcctacaagttcatcaacatcgccctcgacccgcaggtccaggcgaagatcgccgagctcaagaagggcagccccaccgtcacaaacgccaaggtcgaccccgagaccgcgaagctgccgggcgtgttcaccacggccgagcagtggaagacccaggccatcaacatcgacccgaagctgagggccgagaagacagcgctctggcgcaagtggttcgccgagaacatcatggcgcgctga

SEQ ID NO: 8391 - DNA, 159 bp, Methylobacterium sp.
atgcaggacgagaagaagaccgccgcctttcaggtgcgcatgcgcccgacggtaaaggccgcagctgagaaggccgcagccgacgagagccggtcgctcgcctcgctcatggaatacctgctgatcgagcacctcaaggccaagggctatctgaagtga

SEQ ID NO: 8392 - DNA, 246 bp, Methylobacterium sp.
atggccgatcagaagaccacgggcgagctgcgcaaggccgccatcgtcaccgacgacgagatcaacgccgcggtcgaggcgctgctcgcgaagccgaagacaggctcctacccgatcggcggcggctacctgctcgacctcggcgtggccgcggaggcttaccttttctcgagaggcgctccccacgccggatcgcgcgcgccagccaaagcagcgcacacagaacatgggatggcgtctcgctaa

SEQ ID NO: 8393 - DNA, 483 bp, Methylobacterium sp.
atgagcatcacggtcagcgtcgagcgccccggcgtcgtcacggtggcctcgccgggggagaggatgcgcatcgtcgcggagccagagcagatcgccacagccgccggacagcgtgtcgcggatctcgtggacgaggcattgaggctgctcgatggcgctccggacgtgccgcccgagcccggagatgagatcccagccgcatgggaggctggagcctgtctggccctgccggtcacgagcctgacggaggagcaggtcgcccggatactggcatcggtcccagacgatggcagcgagccggagtggtggtggatcgagcgtgacggacgtatcgaggtcgcccgcgtaacgtttggtgatgcgcatgccgggctaaaggacccgccgcagccgtggcatgcggaggtcgtcggttccgagcgcatcgtatggccgatggaggctcgcctggtggtggcggtgattccgctcacccgcccgtga

SEQ ID NO: 8394 - DNA, 246 bp, Methylobacterium sp.
atgtcccagaccgacgatcccgggggcgaaccccggaccccctccccggctgcacctccggccccccgccggaaccagaccctctccctcgcggagcgccgcatcgtggaggccggcgaggccggcccgcacgcgcccggccatccggatccccgacccgacccggggcccgagaccggcggctacgacgaccattccccgagccgcgcgccggacaacgcgaagggcggctacggggccgggtga

SEQ ID NO: 8395 - DNA, 243 bp, Methylobacterium sp.
gtgcgcagcatgaagatcatcccagcgctgctgggcctcttctacggaaagaagcaaaggactggaatcagcagtctgccgtactccgtccgccaccgcctcggcttgccgggcggtatggccatagccgctatgatagacgatcgcgacgcggataccgctttccgtccgcgcctcataccgaccgtgtctttcgctgatgtgcattatgccctcatgctcgaacgcattcggaaggcatga

SEQ ID NO: 8396 - DNA, 834 bp, Methylobacterium sp.
atgagcgacacagccaacacgatcgcgggcgcgggcttcgcggcgacgaccgcgcaggcgccccgcgcgcgacggcgtccgcgcgtcaacctgacgggtctcgtcctgccgctcgcgatcctcgtgctgtgggaggcctccgccaccttcggctggatcgacccggtcttcctgccggcgccccggaaggtcgcgaccgccttctggaagatgctcaccgtgcagaacctcgcgcaggatttcctggcgagcatcaccatcgtggggcaggccttcctgtacggctcgaccgccgccatcctgatcgggatcgccgccggcctgtcccggcgggtcgaggccttcttcggcccgaccttcgacaccattcgccacatcccgggtatcgcgtggctgccgctcatcgtgctgtggctcggcatcggcgcgcccgccaaggtgctggtgatcgccaagtcggtgttcttcccggtcttcctcaacacgctgcagggcatccgcaacgtcgaccgcaaccatatcgagctcgcccggacactgaccctcacgcgctggcaactggtgcgccgcgtggttctgccctcggcgctgccgagcatcctcgtctcgctgcgctacgccgccggtctcgcctgggcgctcgtggtggtggccgagggcctgagcgggctcgaagggctcggcttcctgatcttccgggcccagggtctgctgctgaccgaccagctcatggtctgcatggtgctgatcgggctgatcggcttcgccatcgaccgctcgatggccctcgtgcagcgacggctgctgcgctggaagcagggcttcgagggctga

SEQ ID NO: 8397 - DNA, 732 bp, Methylobacterium sp.
atggcaacaagcgcactcaaacccgtcgtcaaactctccgcggaaacgcagacgctcgaaaacctgcggaactatctcctttccggtgccgtgaagccaggcgctcggctcaccgagatgagcttagcggagcaactaggtgtagcccgggccacgctgcgtgcgagtctcaaccgcttggtgacggagggcatcgtcgttctcaccccctatacgggctggcgcgtggcagccctcaccgagggcgacgcctgggaactttggacgttgcgcgcaagtctggaaggtctcgcggccaagcttgcggcggagtcgatgtcgccggatcgccgcacccggatcgagcaggcgatggcttcccttgtcgtcgcctgcggcgatggggacgtccgttcggccagcgatgcggactttgcgctccatcgtacgatcgtcgaatcaatcggacacagcaggctggagcgacagtatcttcaggtcgagcagcagatacgtctctacatcatgaccagcaatgcgctcgtcggcgatctgggtcagatcgtttcccagcacgagccgctcgtcgaggccctgctgcgcgccgatccggaactggccgctcgcgaggcgtggattcataacgagaccgagggccgaaaactcgcgaactggcttcacgagcaggaaaccgatcgtttccgagcgcccgttaagagagcgatgaagccgaaaggcaggcacatggcctga

SEQ ID NO: 8398 - DNA, 927 bp, Methylobacterium sp.
gagacgtcgagatcaccggcgctgcggcgctcgcgggagatctccatgacgctcgccaccctgtccctcgtcgtcctcgcatccttcctgcatgccggctggaacctgctggccaagcgcgccgcccatatcggcccgctcttcgtcttcgcctacaacctcgtcgcctgcatcgcctacgcgccgtgggtgctctggcgcctctcgcagggcgtcgccggcggcatgacctggacctgggcggcggtcggcatcgtcggcctgagcgggctcatccatctcgcctacagcctctgcctccagcgcggctatcagacggcggatctctcggtcgtctatccggtggcgcggggcacgggaccgatgctgtcgagcctcggtgcggttctccttctgggcgagatgccctcgggccgggcgctggccgggctgggattggtggtcgccggtatcggcctcatcgcgacgcagggccgcctcgcggccttccgcaagcccggcggcgtggccggcgtgcagtggggcacggcgacgggcggcctgatcgcctcctacaccgtggtcgacgcctatgcggtgaaggctctcggcatcgcgccggtcgttctcgactggtgcaacaacctgctgcgcttcgtgctgctggcgccgatcgtcgccgccgacccgcgcggtgcctgggaggcgctgcgcggcttccggctggtggcgctcggcgtcgggctgctgtcgccgctctcctacatcctggtcctggcagcgctcgacggcggcgcgccgctcagcctcgtcgcgccgatgcgcgagatgtcgatgatggttggcgccctgctgggcatgatcgtcctgggcgagaccgccggcccgtggcgcctcgtcgggtgcgcggtgctgatcggcggggtggtgctgctgtcctccgcctga

SEQ ID NO: 8399 - DNA, 1167 bp, Methylobacterium sp.
atgtacatgccgccgagcttcgtctccggcctcgccttcgttaccgtgccggcgcagatgcgggagagcgggcattccctcgccctgatcggcttccagaccatcgtgatgctgccgtggctggccaagatcgtgtgggcgccgtacgtcgagcgctatcgtctgccggccctcgggcgtcatcgcacccccgccatcgcggcggccggggtagccgtcgtcatcgctatgatggcgacgatgacggtcctcggcgaccgctacccggtcgccctgctggcctgcctgctggtcgcggcgacggcggcagcgaccgtcaacatcgcctgcgacggcttcaccatcgatgcctgcccggcggagcagcgcagctgggcgaacaccgcgcaggtgagcggcgcctatctcggcatcgcgctcagcggcggcctgttcctgatcgttgcggcgcgggccggctggaccgcgaccctgtgcggcctcatggtcctggcgatcgtcctgcctctgccgttcctacttctgtcgaggcgggtcgacctcgggtccgtgcgcccgcaccggcccgacctgcgcagcgccctcgcgaacccgaaggtccgcatcgggctcgtgatcgtcctcgcctgcagcgcggggtctcggttgagccagagcatgatcgtcccgctcctcgtcgatcgtggcttcacgctctcgatggtcgggctgatcgacggtgtcggcggcgtcctcgccggtctgttcggcaccctgtgcgccggcttcaccgtccgccgtatcgggacgcgacgatcgctcgtctgggcccttgcggtgcaagtcgcgtgtctcgcgacgctggcacaggccggctacaccggtaccatgcccgcctggcttctcggcggcgcggtcatgctgatgttcggggcgctctcgttcgcgagcgtggcgctctacgcggaactgatgggatacacctcgtcccgccagcccggcgtcgatttcgcggtgtttcaatgctcggatgccggactgggcatgctcgcgggtcccgtgagcggtttcctcgcgacgcatctcggttacgtcggttgcttctccatcgcggcaggcgcgtcggccctggcggccggctcggcaccctggctcgtcagccgctgtagatccattcccgctcgataa

SEQ ID NO: 8400 - DNA, 417 bp, Methylobacterium sp.
gtgacgccccactacatgctcgacaccaacatctgcatccacatccggcgagcgcgccctcccgcggccatgcgccggttcgcagaggctgtacccggcaccgttgtgatgtcggtgatcacctacggtgaactcgcctacggcgtcgccaggagccaggatcccgacgaggcccgccgtcgcctgaccgccctcgtgcgcctcatcccggtccttccgatcgaggatcgggtcggtgcgctctacggcaagctgcgcggggatcttgcggcagccggccgtctcatcggcggcaacgatctctggatcgccgcgcacgcacgtgtggcgaacctgatcctggtgaccaacaacgtcggagagttcgagcgggtcgacggcctcaggatcgaggattggacgatcgacacggcgtga

SEQ ID NO: 8401 - DNA, 681 bp, Methylobacterium sp.
atgcaggcttcccccgcccgcgcgctggtcctgtccggcctgatcctcgccggcacggccctgtccggcgccgcggcccagaccgtgatcgtcaaccgcgaggagcggcccgatccctggatcatcaacggctgcaccatcgctcccaacgccgcctgccccggcgcggacctgcgccacgccgatctcaggaacgccgatctcggcggggccgacctcaccggtgccaacctcgcccgtgccgacctgcgcggcgccaacctgcgcggcgccctgctcgaccgggccaatctcggcggcgccaagctgcagattgccttcttgcagggcctgaaggcccggggtgcctcgttcgtgggcgccaatctcgaccatgcccgcgccgcgggtgccgatttcagcggcgccgatttcacggtcgctgacctggagatggtgcaggccaagcgcgcccagttcgtgggtgcccgcttcgtcaacaccgacttgcaggagaccaagttctacgaggccaacctcgccgacgcggtgatggagggggccaagatccgcttcgcgatcttccaggacgcctggatgaagggctgccggggctgccccgagacctggcagcagggcaagccggtctgggacgtctacccggaggcgggcccgccgcccgcgaccgggtcggatccgtga

SEQ ID NO: 8402 - DNA, 345 bp, Methylobacterium sp.
atgaaccgttacgacacgagctcaacatcgcccgcggagatgcgggcgcacatcgagactgcgaaggccaaccgcgagcacatcgaagaaagccccgaccccgaggccgagcttaggggcatggtccgtggctgcgacctggtctggggcgtctggccggaccgcggccccggcacgcgcctcggccacggcctgtgcatcgtcaagggcaccctgatgatggaggccgtcattgagggcgacttgcgagcgcaggtcgccataacgacgctatggtttccgacgtttgaggcggccaggttcgcgttcgaccgggacggtgacggattgctgctggccgcgtag

SEQ ID NO: 8403 - DNA, 1017 bp, Methylobacterium sp.
atgaggatcatggtgatcggcggcaacggattcgtcggccggccgctgacgcggatgctggcggacgggcacgaggtctgcgtgctcgacgccctgcgctacgggcccccgcgcttccccccggaggagctcgcccgcctcgtcatggtccctgccgacatcaccgatcccgcacaggtcgcggcggcgatgcgcagcttctcgccggaggcggtgatccacttggcggcgattcactacatcccggaatgcgagcaggatccggtgctggccgcgcgcaccaacgtcgccggcacggtgagcctgctcgccgcctgcccgccgggctgccgcttcgtcttcgccagcagcggcgccgtctacgcgccggaggcccggccccaccgggaggattcctcgccggtcgcccccagcgacatctacggcttcaccaagctgcacggcgagcactacgtgcgccacatggcgcgccagcgcggcctcgcggcggtggtggtgcggctgttcaacgtgatcgggccgggcgagacgaacccgcacctcctgcccgagatcctggcgcagctcatcgccggccaccggcggatcagcctgggcaacctcacggcgcggcgggactacatccacgtggacgacgccgcccgcggcttccgcgcggcggcgctcgcgggcgcggtggcgccgggcgactgcgtcacggtcaatctcggcacgggcgaggcctacgcggtcggcgagatcctgtcgcgcctgcgccgcatcgggggggcggacttcaccgtcgagaccgatccggcccggctgcgcgccgtcgaccggccggtgctcgccgccgacatcgcgcgcatccgcgagctgttcggctggagcccccggcacacgatcgacaccgcgctcgccgacctctgggagcggcccgacctgccgccgcacctgacggcgaagtaccggcccgcgccggccgtccgcccggccgcgcgcgcgccgctcgccgagctgctgacgcccgcctcctga

SEQ ID NO: 8404 - DNA, 918 bp, Methylobacterium sp.
gtgccggttcctgagcgcgcggacaggagcgatgcggacgatccggcgccggtgccgggcggcgatgaccggccgttccgcctgatcgcggatccgcgggtcgcggccgccatgcggttcgccgaggcgcggctcgacgcccccatgaccaccgccgcgctcgccgccgcggtcggcctgtcgcagttccacttcctccggctgttccaggcccagaccggcgagacggtgagcgattacagccggcgcatccgcctcgacgccgcggcccgcacgctgcggacctcgccggaaacgatcgtctcgatcgcgctctcggtggggtacggcagtcaggccgccttcacgcgcgccttcaccgcgcggttcggccgctcgccggcgaactacaggcgcggcacccgccgcgcggtcgcgatcgatgcggcacgccagcgcccggtaccgatccgcagcgtcgggaccatccactgcctcggtcgacgctatctcggcctgcggccgggcgaagccgagccgtggcacgacttcctcagcgcgcttccgcccggctccgccgcccggcgcgaccgccgtctcctccgggtcgtccacgacgatccgcgcgtcaccccgccggagcagatccggatcgattgctgcctcgtcggcacggagcgcgcgggcgaggaccgggatctcgccgcgcgcggcttcctgcccttcgagatcgtcgcgggcacctacgcggcggtcggcggcacggagagcggcatcggcggcgccggggacgatcttctcgacatctggctcgcccggcagggacgataccggctgcgcggcggcgccggccgcctggagttccgcgacgccgccgcgcagccggacgccggcgagaccctcgtgccgatccgcgccctcggcacggacgcgacctga

SEQ ID NO: 8405 - DNA, 393 bp, Methylobacterium sp.
atgaccgatccgatcgagcgcatcgctaccgccgccgtgccgacgccggccgggcactactcccaggggaccgcgtggcgcgacctcgtcttcgtctcgggccagctcgggccgcgacccgacggcacgcacaccgccgacgagcccttcgagacgcaggtgcggcaggcgctcgcgaacctcctcgccatcctgaaggaggcgggctgcggcccggagcgggtgctgcgcgtcaccgcctatctggtcggcgtcgagaactggccgcacttcaaccggatctacgccgaggtcttcggcgaggcgaagcccgcccgcaccgtggtgccggtgccggaactcaaccgcgggtatctcgtggagatcgaggcgatcgcggcccggcccgagtga

SEQ ID NO: 8406 - DNA, 699 bp, Methylobacterium sp.
ttggcgtgggccttggagcaggtcacacaaagggacgatgctgccgaagtcatgacgcgaatcgttgaagccgcagcaaacccagctgactttcaggatccagagcaccaccagcgtgtagttgactacctcaacgtacggctcgccgcagacggcatggtgctcacgaagcttgacggccggatgcgttgcctcccgataagccagggctcgcacgttacgtctcacctctcgctagcagcgtcggtgttccggttcgacaccgtgcaggcagacctgaagcgcgccatcgacagcgccgatcaggatccagaggatgcggtcactgcggcgtcatcactgctggagagcctctgcaggtcgattctcatagagatgggccgtccgctgccggaccgaaaggacatcgccactctctataaagccgtccgcgagccgctcggtctgagcgcagcgagggacgatatgccgccagaaatctccgacgacgtgcgcagcatcctgggtgcactgaacacgatcgtccaatctgtaggcgccctgcggactcacgctggcgatgcgcatgggcgggagcgaggctttaagcgaatagacggtcgaatcgcacgactcgccatctacaccgctagcgccgcagccctgttcctcctggaaacgtgggaaaggcagactggccgggctctcagggttcattga

SEQ ID NO: 8407 - DNA, 585 bp, Methylobacterium sp.
gtggccaagaaggggcacgacgacctcctcgacgccctggcggcgctgccggccagtctccactggcatctgaccctgatcggcggcggcgagatgcgggccgcgaccgaggcgcgggcggccgcgctcggcctcggccggcgggtcgcgttccggggggcgctggcccagcccgccgtgatcaccgcgatgcgcgaggccgacctcttcgtgctgccgaccaagccggcgccgggcggcgaccgggacgggctgccgaacgtgctgatggaggcggcgagccaggacctgccgatcctcgccaccgccttcgccggcacgccggaattcatcgcctccggcacgcacgggctcctcgtgcccccgggcgacccggcggcgctggccgcggcactggcgcatctcgcccgcgacccggatctgcgccgccgcttggccggggccgcgcgggcgcgcctcgtcgccgatttcgccctcgatccgggcatcgacctgatcgcggcgcggcttgccgccagcgccgggctcgcccccttgccggaggttgcctcccaccccgccagggcttgcgcatgcgcgtcctga

SEQ ID NO: 8408 - DNA, 2382 bp, Methylobacterium sp.
atgttccgcaccgcgcacaagctggtcatcctggcgccgctgctcctgcccgccgcgggctgcctcagcatcgcgggcgacgcctgcaccgacccggacaccacggccggcatcgccgtcgtgaacgagaaggacgtcacgccccgcaactgcgacggcaagttcctctcggcgcgcaaccagcgcagcgtgctgtacacgggcgaggatcggccgcggctctggaccggcgaggcgccccgcgaggggcgggacatcgatgtgcgccgggtcaacgccccgccgctcggctacgaccgtgccggctcggtcaccggctatctcggcaccctgaagctcaactacgcggccgccgacgaggcggtggaggccgacgtcgccgcgctccagaactcgctcgggcgccgcttcgacccggaccagaaggtcgccgtcgatttccgcaaggccaccctcgactacgtcctcaagcagatgctcgggggcgcgctcgggctgaactacatcgcgccggaggatctcggcggctcggtcaccttccgcaccgaggagccggtgccgaaggcccaggtcctgcagatcgtgcgcgacatcctggcccgcaacgggctggagatgcgcagcatcaacggcgtgttccacatcggcaagccggagctgatcggctccatcgaggcgaccgggcaggccgggcgcgtcggcgagcgcaccacgcggatcctgcgcctgcgcaagggcgcgggcagcgacctgctggcgctcgcccggcagatcatcccgccgagcatcgagctcgttcccaccaacaacccggacacgatcctgatccgcgcgaccgcggccgagatcgatcaggccgagaagctgatcaaggggctggtccagaccgggctgaccgaggaccgcgtcgccgtgatcccgctgcgccagagcgcgccggagaagatcgccgggcagctcaccgagttcttccgcagccgcaacgccgatccggtcagcatcgtgccgctcgacgggcagcaggcgctcctggtctcctccaaggcgccgggcatgatcgacggcgtccggcggctcgccgaggcgatggacacggaggtccgggacgaggtctcgctccgggtcatcccgctgcagcacctcgtcgcggacgagatcgcccagcgcctcgccgtcatcttcgggaccggccagggcagcggcggcgggcggccgggcacgctggctccccccggcgcacgcgtcggcgaggccctccgcgaccccgctcccctgccccgcgtctcgccggcctccatcgaggacggcgtcgcgcccccgccctacccctacgccaacggcccgggcaacggcgggccccggggggcgctgcccggcgaggccgcgccgggcccatccggcggcggcatcgggaccggccagcaggccacccgcatcgtcgccgacaagaccagcaacgccctgctcgtctactcgaactacagcctgttcaagaaggtgcgcgaggtgctgcgcgccctcgacgtaccgcccgcgcaggtggtgatcgaggccaccgtggtcgaggtcgagctgaccgatcagctccagaccggcgtgcaggtcttccttcagggcgcgggcttcgtcgtcggctccggcaacatcgccgatatcggcatcgacggccggaccgcggcgaccggctcgaacaccggcggcggcaccagcggcgtcggcagcaccggcagcatcggcggtggggggagcaacggcttcggcggcgtcgcggcgatcggtgcgcgcatcggcaacgcgctccgggtcgacgcggtgctgcgcgcgctccagggcgtgaccaaggtgaaggtgatctcctcgccctacctcacggtgctcaacggcaagcaggcgcggctcgtcatcggcgatcagatccccttcgcgcagcgctcgcagacggcgaacaacctcggcaacaccaccgtcacgtcggaagtcgtgatcaaggacaccggcatcatcctcgacatcacgccgcagatccacgcgaacaactcggtggcgctgaaggtcaatcagtcggtgagcacgccggtgcagtccgccctcggcggcgccctgacgccggtcatctcgacccgcagcgtcgagtccgacatcctgctgcaatcgggccgcacggtgctgctggccggcctgatccaggaccgcctggagcagcaggaggacggggtgccggtgctcaagaccgtgccggtggtgggcgacctgttcaagcagaaggtcgacaacgtccggcgggtcgagctgatcctgctgctgaccccgcgcgtgacccgcaacgcctcgcagatcgaggacctcgcccgcctgctgcaggagcaggtccacacccgctga

SEQ ID NO: 8409 - DNA, 453 bp, Methylobacterium sp.
atgctgaccaacaaggggaagtacggcctgaaagccatgctgtacctcgccgggattcccgagggcacgcgggtcggggtggcggagatcgccgaggccaacaacatccccaagaagtttctcgacgcgatcctggcggagttgcgcaatgccggcttcgtccacagcaagaaggggccgggcggcggctacaccctggcccggtcggcgcaggagatccggatcggccacgtggtgcgggtgctcgacgggccgctggcccccttcccctgcgccagccgcagccgttaccagcgctgcgacgattgcgcggacgaggcgcgctgcgccgtacggctgaccatgctggaggtgcgcgacggcatcgccgccgtgctcgacccgctgacgctcgccgcgatgcgcggtctctccggggccgccgacgacgcgagcttcttctaccagatctga

SEQ ID NO: 8410 - DNA, 810 bp, Methylobacterium sp.
atgacacgcggtacgcgcctcctcgcagcgctcctggccagcgtcgccctcagtggcctcgccgcttccggtcatgcgcccgccggggagccggcaccacccgccgatgccccgctgccggagcacttcaccctcgccgtgcccgacctgcccgcggcgggcgcgccggacgggcggatctacctggatgaggggttcgaaggcgacctcgccgccctgctcggcgagggactcgggcggccgctgcacctcgcagtgccgacgacgggcgcgccggtgcccggtcggttcgacggagtgctcctgcggctgcggccggatgatccgctcctcgcctccggcgcggccgtgccgctcggctaccggtcgggcctcagcgtcgccatgcgctccgacaccgccatccggcgctgggaggacctcgccggccgcacggtctgcgcctccgcggcgaaccgggacgggcagcgaatcgcccgcgcctacggcgccgcggtggttacggtacgcgcgccggcggtcgccctgatgcgcctgcgcacgggcacgtgcgacgcctcgatccacgaccgggcgctgctcgacgccctcttcacctcgcgcgcctgggccaagttctccgcgaccctgccgccggtcgagcccacgctgctcgccctcgtgccggccgcgaccgggccgggcgccgccctacgtcgcgcggcggcggcgctcgacgatccgctggcctggcgccagcgccgggcgcgatggggctcgaccgtggccttcgaggtctatcgcgaccaagtcggtggcgactgccactga

SEQ ID NO: 8411 - DNA, 1050 bp, Methylobacterium sp.
gtgaggctcgccgccctcggcgccgtcacgctcggtttcctcggtatggtgccgtcctcgcgggccgagacgttgccggcgatcaacctccagttgacgccctggacggtggtcgcgcgtcagaaggggttcttcaaggaggcgttcgagccgatcggcacgcggcaggtgaacctgatcgcctccggcgcggcggagctgctcggggccgaggccgcggcggtcggcggcggcgccatcgcgatcgcccagcgcatgatctatccggcaaccgtgcaccgcgcgaacggcctcgacggcgtcgtgatctgggcctccgagccctcgaaccgctaccgtgccccgatcctggcccgcgccgacaacgacgcgatcaagacggtcgccgacctcgacggcaagaagttcggctcgagccggatcagctgctactggtcctcgcccttcgagatcctggaaaaggccggcctccctctcgattcccgcgagaagcagggccgtgtgcgctacacctccatcgacaactcggcggtggcgatctcctcggtgctctcgggcgcgaccgacgccaccacggcgcatctcgcggccggggccttcaccggcgcgtggctctccggacgcctcaaggtggtcggacgctcgcccgacgacggcgtctacgtcaacaatgccggccgggtgacctacttcgcccgccgcgacttcgccaacaagtacccggaggtggtcaaggccttcctggccgcccgcgagcgcacccgcgagtggaccttcgaccacgtggacgaggcggccgagatcgtcgcccgcgagacccgcgtgccgctggaggtcgccaagttccagatcacccatgccggggaatgggagttcatggccggcgagccgaacgcggaccgggcgcgcaacgccatcaggacgttccaggcctggtacatcgagcacggcgacgacatcctcgccgagcgcaagctcaccgaccagcagatcgacgccttcatcgacggccgcttcttcgcgggcgggcagtactcgatctacaactga

SEQ ID NO: 8412 - DNA, 777 bp, Methylobacterium sp.
atggccgccggccgcctcgacatccgcgacgtctcgaagtcctacccgcaggagggccgaccgccgctcaccgtcctctcgcatatcggtttcgcggtggagcccggctccttcgtctccctcgtcggcccctccggctgcggcaagtccaccctgctgcgcctgattctcgggctcgatccggactacacgggcgacatcctggtggacggggtgcgcgtgtcgggccctgcactgagccgtggcgtggtctttcaggaccatcgcctcctgccctggctgacgctggagcagaacgttgcgctgagcctcgagaacgcgcgctggccggcatccgagaaggcgcgcgccgtgcgcgagcacatcgcgctcgtgggcctgcgcggcttcgagaaggccttcccgcaccagctctcgggaggcatggcgcagcgggcggcgatcgcgcgggggctggccaatcggccggagatcctgctcctcgacgagccgctgggcgccctcgacgcgctcacccgtgtgcggctccaggccgagctgcagcggatctggcgggccgagggcgtcaccatgatcctcgtcacccacgacgtggacgaggcgatctttctcagcgacacggtgatcgtgatgggcgccgggcccggacgcgtcgtcgagcgggtgacggtcgacctcgcgggcgagcgcgaccgctcgggaaccgacttcctcgcccatcggcgccggatcctgcgggccatggacgacgcgttcggccaccgccatgcggcctag

SEQ ID NO: 8413 - DNA, 597 bp, Methylobacterium sp.
atgagaacggaatacctcgggcacggcatgccgaaccgcgttccgctcacgctgggcacggcgatcatctgcctgctgctctgctgcaccgtgatcgggatcctgatgataccgtccgccctgctggccacgttgagtgggcgtgccgcaggggtcaatcgccgctgggatcgcgaagcgaggcgccggttcgtcgggttcatcggcgccgatccccactacatcgacagcgccgtgttcaagtacgaggacggcttcagggggaccggcatcgcctaccatgacggcaaggtcttcatgatgcaggccgggcacgcggtcgaggtggagtggcgcgatgtcaggcgctggtcctattccgtcgaggcgcccgacctgctgacgacatcgagcaacgatagccaggtgttgacgcacgtgaccagcgacaacctcgcctgcgcctaccgggctgccaagaacagcgggtttaccctgcaggtcgcctccatcgatcgcccgacttggaagttcacgacctccgacgtttccgtttgtgagcgctggatggagatcctgtctcaggtcgacgaacgcggcggacggctcacggcctga

SEQ ID NO: 8414 - DNA, 210 bp, Methylobacterium sp.
atgctcgaatccctgaagcgccggcttcgcgcctgggcctgtcccggatgcgatcaggactgcgaacggctcgcgcgcgccgagcgccttcacgccatctcggtcgatgccgtgaaggccgcccgggtgaagcaagctcggcggacgagcgacgtgcgcgtggtggtccaggccgccctgcgccggatggatcatcagggagaggattga

SEQ ID NO: 8415 - DNA, 627 bp, Methylobacterium sp.
atgacggcgcggcagcctcatgccaacgcgctgcgagtcatcgtgtcgcgggttctatcccacgtcaccttgggttgctacatgtgccgcccctccagcgcgggactggagcgaatcagcagggcgacaatggaaggccgggtgaagcactcacctctggcactggccaacaccttcatcgcgcggcatgccggcggaaccggcatcacgcacatgaaggtgcaaaagctctgctactacgtccacggctggtggctcgcttttgaccccgagcccttcctgaccgagggcccggaggtctggaagttcggcccggtgttcgcttcgctctatgcggcgctctcgcaccacggttcgcgccccatcatactgccggaaaaggcccggttcgacgccgcggctcccacggtgacggagcagggctacctcgacctcgttgactgggtttggaaccggtatggccagcattcggccatgacgctctccgacatgacccacgcgcccgggacgccgtggcggcaggtggcggagcgtcaccagttcaaggtgccgatgcactatcggctgcccgacgacgttgtggccgcgcacttcaaggccgaggccgaggcgcttcagcctgcatga

SEQ ID NO: 8416 - DNA, 402 bp, Methylobacterium sp.
atggcccttctacatgccgaactcatctcccccgaacgcacgatcttcgtgggcgaagtccgttccatggtcttgccgagcgtcgagggcgacatgacggtgctgcctgggcacgcccctgtcgtgactgcactgcatgcaggtgtgatcttcgccaccgatgcagagggaaccggacgccgcgccttcatccgcggcggcttcgctgacatcatgccgacgcaagtgacgatcctggccgagcgtgtccggccgatcgaggaactcacccgcgatcaactcgacgaggaaatctttcaccttcaactggaacgcgacggctcctcgaatccggagctgcgggccgagcacgatgtctccatctcgcggcttgagtccttcaaggccagcctcaacctctga

SEQ ID NO: 8417 - DNA, 1038 bp, Methylobacterium sp.
atgtctggcagtgaaaagtcctgtgaccccctcaacgaggtcccgctgaaaacggaggccatgcacaaggacgaccgagagcaccccgttgccaaggtcgcggtcaccttcccgccgccgggcatgggccgtccgaccgccggcctgcgcaagaagctcctccgggcgtcctgcggcctcatcttcgtcggtctcacccagatgcttttccagcgcgccgtgcgggagggccgcgcgaaggagcggccgcgcgaggtcgttctgagggagattgagaagcagatcctgcatgaactcccagtgcattgggccggcccaaccctgacggacgcggccgagaagttcgccgccgagctgtcaccttaccccactttcaaggccttcaaggacgcccatcgtgagcggggacgccgtcatgcggccggcgaggaggagcaggaggcggacaaggcctggatcaccgaacagaagcggatcctgcgtctgctcggggtcgccgcccttcaggacgagtgcatcaccgccgagcaacacaagctcggtgacgaggtgcggagccacgaagacgcgtggtgggagggcaaggagagccgactggaagagcggctgctgctcgacgccaagcgccaggagacttggcgcctgagcctgccccaaatggtcgaggttgctatccacgggcatgtccatcccgccgacctgtggcacacctacgagctgtcgacccccatgttcgatgccgctctctgcgccggctggtgccggatcgggaaggatggcccaatcaccctgaacggtgcctcctggctggctcactacctccgcggcaggctgagcttggacagcaccaaccagggcgagatcgaggattacctgcgcagcagggacctgatcatgggggccttcaacgagcaggcccggaccgacctttatctgctccagttcaatctgttgcgcgaggtgatggctggggtgatgcagcgccgcccgttcatgatccgcgtgccggtcgagatggcgaggccgcgagcagcatga

SEQ ID NO: 8418 - DNA, 711 bp, Methylobacterium sp.
atgcttgagctcgacgccgtcaccgtccgcttcggcgggctggtggccctgcgcgacgtcaccttcacggtggcgccgggcgagatcctgggcctagtgggcccgaacggggccggcaagaccaccctgttcaacggcatctcggggctgacccgggtgcgcgggcgcatcctgttcgagggccgcgacgtcacgaagctgccgttgcaccgccgagcccgcctcgggatcggccgcaccttccagatcccgcagccgatgcagcacctcaccgtgcgggagaacctcgcggtcgcacaggtcttcggtgcgggccgccacgaccccgcgcggatcgaggagatcctcgccgtcatggagcttcaggcccagggcgaccgtccggcggagagcgcgctggcgctgcaggaactgaagcggctggagatcgccaaggcgcttgccaccgagccgcgcctgctcctcctcgacgaggtactggccgggctggagagccaggccaagcgccagttcgcggccaagctccgcgagttgcaccgccgcttcgacctgaccatcgtcatcgtcgagcacgacatcgagacgatctcgggactgtgctcgcgcgccgtggtgctgaacttcggcgagatcatcgccgacggcacccccgcccaggtcttccgcgacccgcgcgtgatcgagagctacaccgggacggcccatgcttga

SEQ ID NO: 8419 - DNA, 669 bp, Methylobacterium sp.
gtggcctgggagctgtggagcgagcgccgcttcgccgagatggcacggcgcgggaccggcctgctctacgcgacccgcctcacgctcgggctgcagcgcgaccttgccgctccctgtccgaccccgaccgccaagattccgatcgaggtccgacccctgcgagagacggacctgccccacctcttccccgaggaccggggcgctctgagccgcaaggagcgggtggagctggcggcccgccgcttccacctgcgggccgggatcccgacctgctacgtcgcgctcgacaggcgcacggacacaccctgctacatgcagtggctgatgggcgcgagccacaaccggatgatccaggataccttcccgccgcgctggtttccggaactggcgcccgacgaggcgctcctcgagaacgcctacacgcccgccgcgtatcgcggtcagggcatcatgtcctgtgccatggcgctcatcgccgagcgcgccgtcgagatcggcgcgcgccgcgtgatcactttcgttgagaacaccaacgttccctccctgcgcggctgcaccagggccggattcgagccccacctcgcccgtatcgagcggcgggccctgctcgatacgatccgcctgcgccgcttcgagccctacgacccggcgcggcacgcgcatcggtga

SEQ ID NO: 8420 - DNA, 300 bp, Methylobacterium sp.
atgctgcgggcagcgctcgtcctactcacggttctcgctccggcgggcgcgatccgcgcggaggggatcaaggagtaccagatccggcgtctcctcatgctgaagacggagtgcaccgtcagtggtctgcaggtcgaggagctggagggtggtgcaagccgctttcgcgccggctgcgagaatgtcagccactatccggacggcgtcgagatccagtgcccgaacacggaggacgaccgcgagtgccgcatcctgacggcgaggcgcgagttcccacacctgcgcgctctgcaacgatga

SEQ ID NO: 8421 - DNA, 429 bp, Methylobacterium sp.
gtgagatggtcgccgatcctcgcgaccgggcttgccctgccggtcggcgcggcggctgcgcccgcgccggaggcggccttgcgcccggccttcgcgcagtgccgcgccctgagccaggagggcgagcgcctgcgctgctacgaccgcctcgccgcgatcctcgcgccgccccgcttccagggccgtctgacgatgcagaccgagcccttcgcgatcacggcccccaccgtgctccgctacgagagcgacggcccgatcttcgtcctcgccctcaaggatgcgcggggcgaagtcgtccagaacctgcacatcggcggcggcggcagcgcgacgcacaccatcgcggtgccgggcacctacgccctgcaggtcagcggctccgagtcctggcgcatctggctcgaccccgtccgcgaccccaccccctga

SEQ ID NO: 8422 - DNA, 690 bp, Methylobacterium sp.
ttgaaggtcagcctgcgcgatccggtcgccgaggaatggtacgaccacgaccaggggagtctggcggagatcgcgttcttcgcggatgccggcgccctgcgggagggggccgtcgtgttcgatctcggcgcacaccaagccgtcgtcgcgctccagctcgcggtccgcgtcggcgcctccggccgggtcgtcgcgcttgaggccaacccgcacaacgcgcaggtggcgggtgagaacatcctgctgaacggcgctcgcaacctcacgctcgtgcacgcggccgcggcggcgaaggacggcgagatcgagttcaacgaaagcctgaacggtcaggtcgatggtggagcgggcacgcacggcgtcatccgcgtaccgagccggtccatcgacagcctgatggcggagttcggcatcccggacatcatctacatcgatgtcgagggattcgagtgcgcggtgctcgagggcgcgggcggcgcgctcgagcaggtgaagcactggttcgtcgaggtccacggcggcgtcggcctggagaagttcggcggctccgtcgacaagctactcgcccatttcgacgcgggccggttcgagcgccatttctgccggacggatgcggggccgttcacgccgctcgaagacgcccggtccctcgacgggacccggtggttcttcatcgccacccggacctga

SEQ ID NO: 8423 - DNA, 162 bp, Methylobacterium sp.
atgcagctgatcacccgcttcctgaaggaccgcgacggcgcgaccgccattgagtacggcatgatcgcggcgctcatcgccgtggtgatcatcggcacgcttcagatcatcggcacccagctcaacgccaagttctccagcatctcggcccagctgaactga

SEQ ID NO: 8424 - DNA, 1056 bp, Methylobacterium sp.
atgacacgccgcacccgaacgcgttcgaccagcccgcggctgcgggcgcccctcgcccttctgctcgccgcgctcgccgccggcaccgcgcgggccgaggaggcgcgcccgcccgggatcagcctgcacctcccgctcgcctgcgagccgggccgcacctgcttcgtccagcactacgtcgaccgcgacccgggcccgggcgcgcgcgactacgcctgcggcagccgcacctacgacaagcacaacggcacggatttccgcgtgcgcaccggggccgaggcccggggcgaggccggccgcgtcctcgccgtggcggcgggccgggtcctgcgcacccgcgccgacatggcggacgggcgcgtgcgcggcagcgacgcggccgagatcaagggcgcggagtgcggcaacgggctcgtcgtcgcccacgcggacggctgggagagccagtactgccacatggcccgggacagcctcgtggtgcgccccggcgacacggtcgcggccggccagccgctcggccaggtcggcctctcggggatgacggagttcccccacctccacctcacgctgcggcacggcgggcaggtggtcgatcccttcgcgcccgcaaccccgccggattcctgcgatcccgccgcgccgggccgcggcggcaccctgtgggagccgaaggcggccgccgccctcggctaccaggcgggcagcgtgctcaacgcgggcttcgccgacgcgccggtgagcatggaaagcgtcgaggccggcgcgccgcgggtgccgggcgcggaatcgggggccctcgtcgcctacgtgcgggcgatcgggctggagacgggcgacgtgcagagcctcgtcctcaccgatccggccggcacggtcgtcgcgcagagcgtccagcccgccctggagcgcccgcgggcgcagtcgctgctcttcgtcgggcgcaggcgccccgccgagggctggcccgccggggcctacacggcccgcttccgcgtcgagcggggcggccgcgtcgccctggagaagaccttcggcctcgcgccgcgcgcgccgtga

SEQ ID NO: 8425 - DNA, 1353 bp, Methylobacterium sp.
atgatccgcgtcctctcggcgatcgtggtgccgccccacatgtccgtcagcggcggggcgcgggcgggggagatgctgagcgcggcgctgtgcgcgcattgccgggtcgacgtcgccagcatgatggggagcccggaggatcccggcccctgcgggcgcctgccggtccgcacgcacctgccgccgggcctgccctggtcgcgcctgccgaaccgctaccgctcgctgttctaccgctcggacattcccgggcgggtcgccgggtacgacctcgtgcacctgcacaacccgatgccggccctggagatggcccggatcgcccgcgcggcccgggcggccggcgtgccctacgtgatctcgacccacggcttcaacgaggtcgccaacggcggcagcatctacgggttcgggccggtgcgccgcgcggtgtggcgcggcctcgtccacgcgccggtggccgcggccgtccggggggcggccgggatcctcgccctgtcgccggccgatttcgacatcgtgcgcgccatgggttttcgcgacggacccaaggatgggcccatgagcggacccatgagcggactcacgagcggactcgcgagcgggctcttggaggtggtgccgaacggggtcgccgtccccgaacccgacgatcccgccgcggatgccgccctcctcgcccgcttcgcgctgccggagcccgacccggacggccccctgaccctgatgttcctggccaaccacacccccaacaagggtctgccggtgctcctcaggagcctgcgggcgctgcgccgccccgtccatctcgtcgtcgggggcgagcggcggcccgagatcgactatgcgggcctcgtcggcgggttgcccgccgaccagcgcgtcgtggtgacgggccggctctccgacgcggaggtcggggcgctgatgcgccgggcggacctcttcgtcttcccgacgctcgccgacaccctgccgctcgtcgtgttcgaggcgatggcgcagggcgtgccggtgctggcgtccgcggtcgggggcatcccctatcagatcgacccgcgctgcgggcagctcgtcccgccgaacgatccggccgccctcgccgcggcgatcgagcgcctcgcacaggaccgcccgaggctgcgcgcgatgggtcgccacgcccgcgcgcgcgtcgccgagggcttcacctgggcggcggcggcggccaaggcctacgacgcctatgggcgcgtcctcgcggcggccgatacggcggcggccgacgcggccgcggcggccggatcggccgggcgccgcgggattccggccgccgcggcgcacggcccggcgcggcggcccgcggccggccgctga

SEQ ID NO: 8426 - DNA, 1647 bp, Methylobacterium sp.
atggtggctggcgcggcaatccccgaacaggtcttcgacgcgatgtccggcacggacaggttcgagcggaccgccatcctcgttctggggatgcaccggagcggaacctccgccgtgacgcgggtgctgagcctgctgggcgccaccttgcccgagcgcctgatgcccagggcggaaggcaacccggtcggctacttcgagccgatggagatcgtgtccatccatgagcggctgctggcgtcggccgataccgagtggtcggactggggcgcctttccgcaggactggtaccggtcggggagccgcgaggctttcctgggggaactcaccgaggccgtgatccgcaattacggagacgacggcctcttcctggtcaaggacccgcggctgctgcgcttcgtccccctgtggcgcgacctcctgacggggttgcgggtgcggccggccgccgtcctgccgttccgcaacccgatcgaggtggccctctcgctgaagcgccgtgacggcttcccgcaggagcacggcttcctgctctggctgcgccacgtgctcgacgcggagttccatagccgggacctcgtccgcgcgttcgtgtcctacgatcgactcctcgaccagaagcggatggccacctacgggctgatcgagagcctgcccttcgattggccgcgcaagacgtccgccgccttcgacgagatcgcgcaattcctcgacggcaagctcaggcgcaacacggcctcgcgcgacgatctctcccttctggccggcatccccgagccggtgcgcgccgcgttccgggcttacgaggcgctcgagcgcgacccgtacgaccgcgtcgcgatgacggccctcgatgcggtgcgcgcggagttcgaccgcaccaccggcatcatggccgacaccttcaaggctctgcgccgccagttcgaggcggatcagagcgaggcgctcgcgatgcgctcggaggtggccacctacgagaagcgggtcgaggcgcgcgcccgcgaactgctcgaggaggtcacagcgctcaagcagcaacatgccgaggtcgccgccctgcacgccgagctgcagcaccgcctcgccgacatcgacagcctccacggcacggtgcacgcgatgcaggtcgaggccgcccgccagaacgacgcgatccgcatcaccgccgaccagcggcacgaggcgctgcagatcgaggcagcccgccatcgcgatgagatcagcgcggcgcgggccgcctcgggcgcgctggaacggtcggtcggcgacctgcaggaagatctgctgcggctgcgcggcgcggcggcctacgcggactatcgccgtgagcaggagcgccggcaccgctggtggcgccgcgagaaggccgatccggagcgcgcggcgctctgtgccctcgtcctgcgctccggcctcttcgatcccgattggtaccgggcacgctacctggcggatgagcccgatcgcgatccgatcgatcactacctcgatcacggacgcgcgcagcgcctcagcccgggcccgaacttcgacgcccaatggtacgccgagaccaatcccgacgtggccgcttccggccacgacctctttctccactacctgcagcacggccgcgaagagggcagacctccgcagcgccgctga

SEQ ID NO: 8427 - DNA, 468 bp, Methylobacterium sp.
atgagtgacaccgtgctggaccgcctggcggccctcggactggtccttccgcccgttccgccccctcggggagccttcaaaccctacgcgcgcgccggcaacatcatctatctcgcggggcagatctgcgagtgggacggcgaggtccgcttctcgggacccgtcggcgaggtgtacgatctcaaggtcggccaggaggccgcgcaactctgcgcgctcaatctgctggcctccctctcccttgccctcgagggggatctggatcgggtcgtggcctgccaccggctcggcggtttcgtctacgccaagcccggctatccggacgtgcccaaggtcatcaacggtgcctcggacctgatgttcgcgctcttcggcgaggcgggccgccatgctcgcacagccgtgggcgtcgcgactctcccggcaggcgcgagcgtcgaggtggacggcatcttcgaggtatcctga

SEQ ID NO: 8428 - DNA, 492 bp, Methylobacterium sp.
atgaagcgcgtgctcgtaggcattgccgttccgcttctcatggcggccggcccgcaacagacgcgctcggctccgccccccgcgccgccgctcagagccggcgccatcccgccgggtgacgcccctggggcccgcgacgcgtccgcgctgccccgctacggcggcggccttctcctcgagagcaaggcgggcgccttcgacgagatcgcgctgccgaacgccaagctggagcggcgcgcggacgaggtcgacgcccacaacaacgatctcttccttccgcccgagccactgacggtcgaagggcgggtcacccggatgagctatctcctgccggagggccgcaccgccctcgaggtggtgcggggctaccagcagaccgtgaaggatgccggcggcagcgtgttgttcgagtgcagccgggacgagtgcggcggctccggcgtcaccgcggcgcgttcgggcggcagcaagaccggcctgatccacaggtag

SEQ ID NO: 8429 - DNA, 141 bp, Methylobacterium sp.
ttgtcctccatcaagatcaagcccgcctgcgacggcacctacacgctctaccgcgacggcgacgccgtcagctcgggcctcaccctgtatcaggcccaggagctcgccgccgtgctgcgctgcctcgagccgaggggctga

SEQ ID NO: 8430 - DNA, 570 bp, Methylobacterium sp.
atgctgacattcagctttgctgatcccagcctgtcgctcgcggccgaactcggcgacgcggtcgagcgggtcttcgcgatcaacacctacgattatctgccggggctggaacgctcgaacctgctcgcctcaatcattatcaagagcgtgcgggcgccggtcgtcggtccggtcttcgcggctttggagaaccggtcgatcaccggcggcatcatgagcggaggcttccacgacccacgcagcctaccctccgacctgctcgacgagtacgcccgggtcggcgctcgggccggctacagcacggccgcgagaaaactgctcaaggcgctcccgagcttcgtcgcggcccgcgcccgttacctttctgtcaccgcgccgatcacgctggtctggggtgacgaggactgggccaacctgcgggaccgcgccggcgtcgcggccgcactccctttgccggaggtgatcaccctcgaccagacggggcacttcagcgccctggagcgctcccaggcctgggccgacatcatcctggctcggacggcgaggccgaagctctcggccgtcggctga

SEQ ID NO: 8431 - DNA, 159 bp, Methylobacterium sp.
ttgcggacgccctcgcacaagaccgtgcagggtgacgcccaggcgagtgccgtccgcgaatggcggcgctcgctggcagagctgcccacggcgaccaatgggttcaattccgatggcattgccgtcgcgatcgaaggactgctcacgcttgccgcctaa

SEQ ID NO: 8432 - DNA, 438 bp, Methylobacterium sp.
ttgatcttgccgcccttcggcgcgaccctgctctcgaccgctggtgcggtcgtttcctcccagacttggcccgcccggctcagcgccgcggcgggttttttcgtcctaaccggtcaaaggttcgtgattgagcgggagcctcgtatcctaatccacgttagccccggcctcacccctgccgagccagtgatgcctctctacacaatcgataccgatgacggggacctcttcgtcgcgggttccctagaaaccggcatcgactgtccgctaaaggccaggatggaagcgcatcgggtgctcggatcgatgacaagatacgctctgcccgatggggagcaccgcgtcctacaggccatcgttcgcgacgacatcgggcaggaggtctacgtcgcgaccatcacgtccacaggcgagtggaaaattccgcttggcgcctaa

SEQ ID NO: 8433 - DNA, 186 bp, Methylobacterium sp.
atggagcggcggaacgatcgtgaggtgcgctgggccgcggagcggcacgcgcgagagtcggcgcggaaccaagcagtcctgctctggtccgcgatccgggcggagcgccgggccgacgcggatccgggcgcccgactcaggcccatcctgctcgccgcgatgaccgacgagatgcaagcccgctga

SEQ ID NO: 8434 - DNA, 963 bp, Methylobacterium sp.
atgacgcgcgcgctcctcaccctcgcgctggtcgcggtgtcatccatcctcctcggcctcgtgctcgatccgcgcggttatgaggtcagggtcctgtgcctcgtcctgctcacggcctcaatggctcagagttggaacatcgtgggcggccttgccaaccagatctcgctcggccacggggcgttcttcgggatcggagcctatacctcgacgatcctgacgatcgcgacgggcctgtcgccctggctcggagcgcccctgggcatgctgctggctgccctcgcggcgctgctgctctcgctcccgacgatgcggctgaagggcccctacttcgcactggcgacgctggcgttcgccgagggctgccgcgtgatcgccaactcactcgcggtgaccggcggctcgcagggactctccgtgccgttcgccggcaactcgtggtggatgctgcaattccgcggggccggcggctacgtgccggtcttcgtcggcctgttcgttctgacgagcctcgtcttcgccctcctctcgaacgggcggtggggttacctgatgcgggcgctgcgcgagaacgaggacgcggcggaggtggccggcgtcgacacgctgcgcacgaagctcctgggaagcctgacctccgcggcgctgaccgcgctgtgcggcacggcgtttgcccaactgacctttttcttcgatcccgacagcgtgttcagcccgtccggcatctcaatccgcatggccctagtggcgatcgtgggtggggtcgggacattgaccggcccgttgatcggcgcgctgctgatcgtacccctcgaggagatcctgagcagcacgctctcgcagtacctcgccggcatcgctcccttcaccttcggcttcgtactcgtggccgtggtgatcctgcgcccgcgcgggctcgcgtccctgccggggctgcgctggatcgagggcagacgctcatga

SEQ ID NO: 8435 - DNA, 519 bp, Methylobacterium sp.
atgcaggatcccgatctcctctcagcccaccgcatcggcgccgccctctcgctggcgggtctcgccgtgctgatgctgggcgaggccggggagccgcagcccctcgggaccgccacgggctgcctcgtcgcggcgctcgccgccttcgcggtcgatgccctgcggcgcgggggcagccgccgcacccgccgccccgccgccgggcggcgccgggctctcctgccggggcggcaggcggcccccgcggtccctgcgctctctcccgcccccgcggcgccggaggccgggcccccggaggccgtcacggcggggcgctgggcgatgcccgcgacgcagcgcgatccgcgcgtccacgccgccctctccatggcggtcgcgcgcttccggagcgcgggcccgcccgcggcggatggcgggccgggacgcggtccggatgcgggcccggatccggggcaggacgatgcgcgccgggcggcgctggcggacgtgcgcaaccgccgcctcgcgcgccgggattga

SEQ ID NO: 8436 - DNA, 174 bp, Methylobacterium sp.
atgctcctcgccctgcctttcatcctcgtcgcgctcgccgtcctcgtcgtcggtgtccagatcctgctggtcgtcaagatggccgacctgttcgaggcgccccgcgacgcgcgtcgcgacgtccgcaacgtccatgcccgctatcccgccacgccggccggccgctacgcctga

SEQ ID NO: 8437 - DNA, 705 bp, Methylobacterium sp.
atgcgcgtgatgtcccagccggtgggcttgccggaggtggtcgagagcgatcttgtccgtcaggtcgcgcgcagcctgaccgcggcgatcgtgcaagggcacctgcgccctggcgccaaggtgtcggaggcggcggtggcccgcgaactcggcatcagccgtgcgccggtgcgcgaggcggctcgcctcctggagaatcaaggcctgctgcgcgcctcgccgcggcgcggcttcttcgtgcgcgaactctcggcagccgatgtcgacgaactctacgacctgaggatctgcgtcgagcgccacgccgcggtcgcggcttcccgccggctgacgccggaggcgcgcgtcgccctacgccgccagctcgacctgatggacacgatcgcccgcgaggacgacccgtccaccatcgtggaggcggactaccagttccaccgcatgatctgcgaggtcgctggcaacggccgtctgttgcgcctgttcgacggcctcgcctcggagttgcgcatcgtgatcggcctgatcgggcgtctgtacgatgatccgatgaagctcgctcgcgcccatgtgccgctgctggacgccattgaggccggccggccggacgcgatcctggcggaggtcgaccaccatctcggcgtcgctcgccgcgaggtcggcctcctcctgcaaagcctctccccggcaaaaccggatgtcttgtga

SEQ ID NO: 8438 - DNA, 936 bp, Methylobacterium sp.
atgcgctgtgtcctcctgagcgcgaccttcgacctgcgcgccctctgtccgagcgcgctcgacgcggcctccgacgtgatcgagttcgtcgacgatccggcggattcgcccgagacggtgcggctcgccctggcctggcagccggccgacgacgcgctgacccgctacccaaacctcgctgccgtctgctctgtgggtgcgggcgtcgacagtctcgtcacctgcccgagcctgcggccggacctgccggtggtgcgcgtggtcgatcccgaacaggcgcgggcgatgtcgggcttcgtgctctggcacgtcatcggccaccagcggcgcttccgcacctacgccgccaatcagcttgcccggcgctggcgctacctcgctccgccggaggcgagcgcggtccccgtcggcctgctcggctacgggaggatcgggcagcgggtggcctccgatctcatggcgctcggctttcccgtctccgcctggagccgaacgccgcgggagggggagcccggcggcgtcgcccaccaccacggcccggagggcctccgggccatggtggccggcagcgaggtgctgatcaacctgcttcctctcacgcgggagacgcgcgggctcatcgatgcggccttcctccgccggctcccgcgtggcgcctacctggtgcaggtcggacgcggcgagcatctggtggaggcggccctgctcgacgctctggaatccggccatctctcgggtgcggccctcgacgtattcgccaccgagcccttgccggagacgcacgccttctgggagcacccggcggtcttcgtcacgccccacgaggcctgccacgcgaacgagcgggcgatcgcccggaccctgcgcgccacggcggagtccgtccacgccggacgtcggccgcccgacaccgtcgacaccgcgcgcggctactga

SEQ ID NO: 8439 - DNA, 1044 bp, Methylobacterium sp.
atgagcggccaccgtccacccaactatctgccggtccggccggactggctggctgccggctacgaggagccgctcaagcccgagttgccgatcatcgacgcccatcaccacctgtgggaccggccaggctggcgttacctgttcgaggagtacctgaccgatgtccgcgagagcggccacaaggttgaggccagcgtctacatgcaggcgcagtccatgtaccgcgccgaaggtccgccggcgttcaaggtgatcggcgagaccgagttcgccaacggcgtggcggccatggcggcgagcggcctgtacggcccgacgcgggtgtgcgccggcatcatcggccacgtcgacctccgcggtgggaccgcggtggcggccgtgttggaggaccatctgcgggccgccggcgatcgcttccggggcattcgccatctgaccacctgggatcccgatgcgagcctgaccaacccgctgagtgcctgcccgccgggtctcctgggagacacggcgttccgggctggcttcgcttgcctggctttcctgaatctgagctacgacgcgtggctgttccatcctcagatcgatgagctgaccgacctcgcccgcgccttcccgaccaccacgatcgtgctcaaccactgcggcggcgtcctcggcatcggcgcctatgccgggcggcgcgaggcgatcttcgcgcagtggtcgaaagccatccgcaggctggcggaatgcccaaacgttgtggtcaagctcggcggccttggcatgcgcatcaacgggttcggcttcgaggccggcgccgtgccgccatcatcagaccagctcgcgcaggcgtggcgaccctacatcgaaacctgcatcgacgccttcggccctgcgcgctgcatgttcgagagcaacttcccggtcgacaagggctcctacggctacggcacgctctggaacgcgttcaagcgcctcaccctccaggcagcggaggatgagatcaccgcgctgttcagcgggaccgccgcgcgcatctatgcggtgccaacccggtcttga

SEQ ID NO: 8440 - DNA, 3267 bp, Methylobacterium sp.
atgagcagcgtcacctccgccctgacgagcgccctctacgcgagcgcggcgcagacggggacgcgccccgacaccgtcacggccgacgcattcgcccgctggcccgtcgccgcgcaggcggctctcgtgcgcagcttcggcaccggcagtccaccgtccatcctagtcggccaagccggccagcgagccatcgcgacgctgaacgagaccggtaccgacgtggacgtggtgcaggcgcccgcgagcctcgacacggcgcctgcggacctgacccgcgaggcgttcgagcgctggcccggcgcggcgcagatcttctacgttcgggcgaacggcagcggtgatccgtgccgcgtcgatctcggcgggacggcgccgggcggctccaccgcgacgctggcggagacctacggcctagccaacggcgtcgtcctgacggacaggggcgcgccgacggctgccgaggacgcgttgatcaagatgccggtcgcccagctcacgtcggcggactttttcacgctctcgccggacgaccagtacgcgtatttccagaaaaacggcacttcggtctcgatgccctcgggtccggcagtgctggtcctgaagctcgacacgcagcctccgaaccccacgacgcgcgccatcctcaccctcagcagcaacggacgtccattcgcggtcgaggtgcaggcgagcgactatccgggattcgcaggcctgaccggctcgaagatcgcgcagacaagtcccgtgaaggccagcctcttcgccgcgtggccgcgggagatccagcgcgcttacgtggagggcaggttcaccggcgcgaccgatcccgacacgaccgacgcctttcagcccgcgttctatccgaaggtggtcgttttcaccgacggttcgaagatcgcctccgtcaccgcgccgggcgcggaggtcgagatgatcgacatcccggcgggcttcggcaacggcacgaccggtctggcggccggaaccttcctgtcatggtcgccggccgcgcagctcgccttcgcgcgcgaggtgtacaacagcacgagcctgccaagcttcaccctgccgggctccaccggcgcgcaggcactctccgtgacccttgcgctcagccggaacggcctgacgcttgcgagcgtcggcgaccgcgcgaccaacctcgccgtcgatccggccgccctcgatctcgatctcttccatctctggccgatcgaggaccgggtagcctacatcgatgcgaagggcggcggcacaccaagatcgctcctgacgggcgccggcaccttcctgctgagcctcggcccggacgcactgccacgtctcgagagtgtgccgaccgggttcacgacgacgcccgctgccctcgcgcccgcgaccttcctcggctggtcgcccgcgatccgagccgcctatctcggccagtccggccttgcaggtgtgacggagacaacggtcgtcgacgctgccggcaacagcgtcatgcagcggtcggcgacgatcggaacggcgcccggcccggtcctgacggcgacgcgtataccctccggcgacgtcgtcacgacgggatcgatcctcgctatcgacccgacccgcggcatggggctgccgatcccgaacgctggcacctacggcggcgcgggcggccttgaccgagacccgaacgcgtcgagcgcggatgcgctcttcccgggcctcgacggcacggccgggcgctccatcgagaacaagccggccaaggtcgcggcgcagttcgcgaaggcgcccaaggacctcgcgcccgatgagttcgggacttggaattccgtgattcagttggagtacctgcgcaagcacggcacggccagccagggctacgccctcgtgatcggtccaggccccgacggcgccaccgccacgacggccttcatgtcggaatcggggactaaggtctacaccgtcggcaccctgcagaagacggatgtcggcaagatgtcatccagggatcaggctgttctggtcaccttggacgccttcaccaagccgctcacaggccgcgcggccgccctggaactgacggccggcaacgcggcgctcctcaaggcgatcgacgacctcgccagcgcgatcgcgctcgatcccaccccgctcaagggcggccagacccccatgccgctcgccgaccgccaggtcttcctgcatcaggtcgcgatcctcaaggacaaggttgcgggcagcagcatcgtctctgccagcagcattcagccgcagatcgacgacctgaaagcgcgtttcgagcgcgcgaacgcgttcgcgaccgcgctcccgcggaaagcgctcactgccgatcccctgaaggtcgaatatgaaacgcccgctttgagcctgggcgaaggcataccgcccgcgacggcaaaaatttcggtcgacccggatcataacacgaagatcgacctttcgaagtttctcaccgatcagttgggcagcgtacatccattgactgcagattctgcaaaggttattaactatagttcgccgataaagatcaaattctacgacggtgccggaaatcaaattaaggtgagtggtagcctgaacgctgtggagatctcccgccttcaggccggcgtcgtgcaggtcaacgcgccgacgttgagtacggacggcaaccaagccctgcagcaatgttacaggaacctgatatcccaggagcggcagctcctcagcctcgccgagagccgggcatccctggcccagaccggcaagctggcgggcagtacgcagcatctggacgtcccgaacctcgtctacctcttccagcttcaggccaacctgaccggcgaggcgaagctgcgcgccgatacggaggagctcaaccagatcaatgcgctggtgaagctctacggtgtggcgcaaaacatggtcaaccgcattctaaaggacaacgattcctccggaaagggaaatatctcccccagcggaggcatgacgcgggaagaaaaggaggccggcgtcttcttcgctggcggggcgtctcatccgatcgagatcatctacagcaacatcagccatccgaacgatgggttcggagcgcggccgtacgagcgctggggcaagctctcgacgcagctgtcggagcgcgtgacgctgatcaaccaggagagtcagatcaaaatgaactcggtcaactcgtcgaccaaggccaaggaccgcaacttcgacttggccaacaacgcgctgacgaagatgaacgagatcgtgcagaagatcgccggcgcgatgtga

SEQ ID NO: 8441 - DNA, 216 bp, Methylobacterium sp.
atgtggaagctggttgctctggtgcaggcgcagctgccgaattcggctcaccaagcccgcgttcacctgctggagcagctctacgcactggagcaggaggccttggagcgcggtgcggatccgggcaccctccgctcgattcttgcgacacaggcgttcgtccggagaagtgatccattgatggggcgcatggcgacgccggaacggccccaatga

SEQ ID NO: 8442 - DNA, 1245 bp, Methylobacterium sp.
atgctcgcgtccgcgatgcccgctggactcccgatgatgaggatagacggaatgttgctggtcaatacgaacccggcgcacggccgtgcgctcgaagtggcggatgccgaaatgctgtcggtcgcggcagccgagacagtcgagcgcttcctggaacatcgcccggatcatcgcccaacgccgcttcacgcgctgccggcggcagcccgatcgctcggcgttgccgcgatccatgtgaaggacgagggattccgcctcgggctcggcagtttcaaggcgttggggggcgcctatgccgtcatccggctcgtgctggaggaggccgggaagcggctcgggcttgccctcggtccggccgacctctcgcgacaggacgtgcgggccgtggcggccgggatgacgttcggctgcgcgacggacggcaaccacggccgctcggtggctcagggcgcgcaactcgtcggagcgcgatcagcaatcttcgtccatgccggcgtgagtgaggagcgcatcgccgccatcgccttttacggggccgagatgatccgctgcgccggcacctacgacgacagcgtcgaggaggccgcccgcgcgtgcgccgtcaacggctggacggtggtgtccgacacctcctggcccggctacgagcacatacccggcctcgtcatgcagggttacaccgccctactgcgcgaggcgttgcgcgaggtgccggagccccccacgcacgtattcatccaggccggcgtcggcgggatcgctgcgacattggccggccacttggctgtcgtctacggcgccaaccgcccgaaactggtcgtggtcgagccggcgcgcgcggcctgcctaatcgcctcggccgaggccgggaagccgactaaggtcgcccacggtgagccgaccgtgatggccatgctggaatgctacgagccgtcgctggtggcttggcgtgtgctttcgcgcgcggcggacgccttcatgacggtggacgaggacgatgccgtctcggccatgaaccgcctcgcccgccccgagaccggtgacccggccatcgtcgctggggaaagcggcggggctggcttcgccggactcgtacgggtcgtcggcaacgcggcttggcgtgacgccgtcggccttggtcctgaggcacgggtccttctcgtcaacacggagggtgcgaccgatcccggccgctaccgggaactgacgggcctcgcgccgacggatgtcgcttgcgccgcctga

SEQ ID NO: 8443 - DNA, 228 bp, Methylobacterium sp.
atgacgagcgccctggatatcctgacacggtccggaaccccgtcctcgctcggcagggctcgcctgcgggccgagcgacaggcgcgggacggcacgtgcgtcccggccggcgcagtcggcaccgtcatcgagatcctcggtggtgggcaggccttcgtcgtggagttcgtcgaccccgtgcagactgtcctgactgtgcgggtcgaggatctgacggggctcgagtag

SEQ ID NO: 8444 - DNA, 459 bp, Methylobacterium sp.
atgaacgtcgtgaacttcgcgcacggcgccctcttcatggtcggcgcctatgtgggcgtgctcctctacggctataccggcagcttctggctgagcctcgtcgcggcgccgctggcgatggggctcctggggctcgccgccgagccgtgcctgctctttctcgacgagccctccgaggggatcatgccgatcctcgtcgaggagatgctcgagcagttcgtcgcgatgaagcgggcgggcacgacgatcctgctcgtcgagcagaacgtggacctcgccctcgacgtctgcgaccgcgtctacatcgccaaggcggatgtcggcggcaagatcgcgaccctcggcggccgcctcatgcaggcgacatcgcgcaagctcgccgacgcgttcttcggcacgttcgcggctgagctcggcaccgccggcgatcccggagtccccgcgccggcagcggcctga

SEQ ID NO: 8445 - DNA, 765 bp, Methylobacterium sp.
ctcgaccaccgtgccgagacccacccgcccacacccgtctggtggcgggacgacgacgcggtcgccgccacgcccgccctcgaccggctgctcgccctgggagagacttgcgccgccccgatcctcctggcggcgatcccggcgcacatcgccccctcgctcgggcggcgcctcgacggcgcgccgggcgtgcgcctcgccgtacacgggctcgcccacgcgaaccacgcgggcccaggcgagaagcccgccgagttcggcccgcaccgcccgctcgccgcgctggtggccgatgcgcgggagggcctgcgccgcgcccgggagcacctgccgcaggacgccctgctgccggtcttcgtgccgccctggaaccggctcgcacccgatctcgccgccgcgctgccggatctcggctatgccggcctctccgccgccgcgccccggcaggcgcctccggaacgggtcggcctcgtccgcgccgacatccacatcgacccgatcgactggcgcggcacccgctcgctcgccgatcccgaccgcttggtggacgacctcgtggcgcggctcggggccggcgctccggtcggcatcctcacccaccacctcgcccacgacgcggcgctctgggcctttctcgaagccctgctgccgctgctctccggtcacccggccgtgacggttctcgatccgcgacacctgttcgcccgtccgcccgtggacgcgggcgccgcgccgtggtctcgtcggccggcgagggcttcgtga

SEQ ID NO: 8446 - DNA, 393 bp, Methylobacterium sp.
acggcactgggcgatggcaagatcctgttcagcgccagcaccgcggcgaacggcaccgagctgtgggtgacggacggcaccgccgcaggcaccatcctcgtcacagacgtcaacgctgcgacgatgccttccttcccgagccgcttcacggcgctgggcaacggcaagggcgtgttcgtcgccaacgatgcgaggagcggcttcgagctgtgggtgaccgatggcaccgccgcaggtaccagcctcctcaaggacatctacgcaggacccggtgcatcctccccggccggcttcacgacggtgggcgacggcagggtcctgttcagcgccagggacgcgtcgaacggcaccgagctgtgggtgacggacggcaccgcagccggcacatccctc

SEQ ID NO: 8447 - DNA, 3351 bp, Methylobacterium sp.
ggcggcggtggtggtggcggcatcggcggcggcatcagcttcggccgtggtggtgcgggcggcttcggcggcggcggcggcgcctctagtggcttcggcggcggcggtggcttcggcggtggcggtggcaacggtggccgcggtggcttcggcggcggcggcggcggcggtggcagtgcccgtgtcggcggcttcggtggcggcaacggcggcgtcgggagtggcggcggcggcggcggcctcggagcaggcggcgacatcttcgtccaggcgggcgccacgctcgtcatcgtcggcggcagcctgagcggcggcgcggtcagcccaggtggcggcgccggcgccggccaggcctacggcagcggcatcttcctccagcgcaacgccggcgatccgcttccgagcctgacgctggccgccacgcccggcgccccggccaccttcgccgacgtcatcaccgaccagaacggcgcggcgggcagcacggcccacggcgcggtcgggctctcgatcggcgacgccaccacacccaacaccggcatcgtcacgctctcggccgtgaacacctacacgggcgacaccacggtccaatccggcaccctgctggtcgacggtcagatcgccaactcggccgtgaccgtccggagcggcgccaccctcggcggctcgggcacgaccggcggcgtgacggttctgtccggcggcacgttctcgcccggcaacagccccggcctgatccgcaccggcgacctcgccctcaccgccggatccaccttcgtcgagcagatcggcggggcgacacccggcacggactacgaccagacccgggtcaccggcacggtcgatctcggcggcgccacgctcgacctgcagcgcctcggcgcctacgcgcccctcctcggccagaccttcacgatcatcgacaacgacggcgcggacgccgtcaccggcaccttcgccggactggccgaaggccaggacatcgtgctcggccgctaccggttcgcgatcagctaccggggcggggacggcaacgacgtcgccctgcaggtgtccggtgcccccggcccggtggtgaccgcctcgcccggcgcggccgccttcacggagagcgacaacgccgccgctgtgcccgtcgcggtcgatcccggcctcacggtcgccgatcccgacgcggcgaccctggcctcggccaccgtggcgatcaccggcaacttcaccgtgggcgaggacagcctcgccttcgtcaacaacagcgcgacgatgggcaacatcgtcggcctctacgacgccgcgaccgggcggctcgtcctgacctcggccggcgcgagcgcgaccctggcgcagtggcagaccgcgctgcgcggcgtcacctacacgaacggctccgacacgccgacgaccgccgaccggaccgtcagcctcacggtcgacgacggcgcgttcgccagccccgccgtcacgcgccgcgtcacggtggcggccgtcaacgacgcgcccgtcaacacgctgccggccagcctcgccgtcgggtcgagcgggcgggccgcgctcagcggcctcgcggtggcggacgcggatgccggaagcggcgtgctggtcaccagcctgacggtgcaggccggcacgctcacggcaacgagcccgccgggcggggcgctcgtcgccggcagcggcaccgccagcctgaccctgaccggcacgatctcgcaaatcaacgcggtcctggcggccccggacggcctcgtgttccagggcagccccggcaccaccacccagctcaccatggcgacccgcgacggtggccacgcgggcggaccggagaagaccgatacggacaccgccagcctcgtcgtcgatcaggcgcgctacgccatcgcggtcgcgccggcctccgtgagcgagggcacgggcggccccggcaacgccctgacctacacggtgacccgcaccggcgacctcagccagatcacgaccgtcgcggtcgggttctcgggcacggccacactcggcagcgactacacggtcgctggcaccggcacggccggcgacggcagctacgccgccggcctgctcaccttcgcggccggccaggccacggcgcgcgtccgcgtcaccaccgtgccggacggcacgcacgagcccgacgagaccgtcgtcgcgacgatcagcggcccgagccagagcggtctggtcacgaccgcctcggcgacggggaccctcgtcaacgacgacgcgccgccaccgagccccggctccgaccccgatccggtccctgtcccgggcacgtggagcgggggccggatgaccggcctcgtcacgaccatcgacccggccgccgcacttgccgcggccctgcgggccctgcagggcctgcccgcgggccccgacgaggccgcagtgcgggccggcatcggtgcgtttctggccgggttacccgccggcaccacgatcagcgtctcggccttcgagcccatacccggcaccggcgacatccgcatcgcggggccgacggacggcacccggaccatcgtgatcctcgacgcctcggccacgccgcaggggacaccgatcaccctggacgacctgggcttcgtggtcctgtcaggaccgccgtcactcataggcggtgccggcgcgcagatggtctacggcgatgccagcgctcaatcgatggtgctgggcgccgacgacgacaccctgcacggcggcgccggcaacgacgtggtcggctcgaaggccggcaacgacctgctctacggggacgcgggcaacgacaccgtgttcggcggcatcggcgccgacacgctgtggggcggcacggagcaggatctcgtctacggcaaccaggacgccgacctgatctacggcaacctgggcgccgacagcctctacggcggtcagggcgacgaccgggcctatggcgggcagggcgacgaccggatctggggcaatgccggggccgaccgcctgttcggcaatgccggggccgacctcgtctacggcaaccagggcgcggacgtgatctacggcaaccagggggcggacacgctgttcggcgggcaggaggccgacacgctgttcgggggacaggatgcggacgtggtctacggcaacctcggggccgacctcgtctacggcaacctcggagccgacgtgctctacggcgggcagggcaacgacgtgctctacggcggacaaggtgacgacgtactggtgggcgggctcggcgacgacatcctggtgggcgggctgggcgcggaccgctacgtgctcggtgccggcagcgggcgcgacctgatccggggcttcgaccaagccgcgggcgaccgtctggttctgggcgggtag

SEQ ID NO: 8448 - DNA, 189 bp, Methylobacterium sp.
atggagacccggcgcggcgccgacatcgtcgcccggaccctggaggcgctcggcggcttcggcgcatgcgtgacggacgcggccgacctgccggccgcgctggcggcggcccaggccagccgaaagcccgcccgcctcaccgtgatgatcgagagggtgccggcgcgggtgatccgccggccgggctga

SEQ ID NO: 8449 - DNA, 234 bp, Methylobacterium sp.
gcggcggcggtggaggagcagggcgcggcgacccaggagatcgtgcgcaacgtctcgcaagcctcgaccggcacgggcgaggtgacgcgcaacatcgcgggcgtggcgggcgcggccgaggagacgggggcttcggccgcccaggtgctcggcgcggcctccgagctgtcgcgccagtccgagcacctctcggcggaggtgcagcgcttcctcgcgagcgtccgcgccgcctga

SEQ ID NO: 8450 - DNA, 153 bp, Methylobacterium sp.
atgagcgacgacgacaggaagcccgacgacaagcctgccaacatcgcgccggacgcggtgaaggacccgaacgagaagaccgagggcaagccgggtgagggcccgaagggcggcggcacccagcgggacgagacggatccgggcggcagctga

SEQ ID NO: 8451 - DNA, 402 bp, Methylobacterium sp.
atgggcgatcctcccgcacctctggcgggcctgcacatccttctggtcgaggacgattacctcgtcgccaccgagctggcgcggtggctgcgcgcggccggtgccgacgtgatggggccggtggcccggatcgagcaggcctgcgggctgatcgaccggcgcaggcccgatgcggccgtcctcgagatcaggctcgaggccgaacccggcggcggagacacggtccatcccctggcggaccggctcgacgcgctcggcgtgccctgcctgttcgtgaccggcgaccctcgtctcgcccgcctgccggcctacggcggcatgccgtgcctcgagaagccgcttcaggaaacggacctgatcggggagctcgggcgcctgctcgacggcgcgcgcgccggttga

SEQ ID NO: 8452 - DNA, 1305 bp, Methylobacterium sp.
atgacccagcacagacgtcgcggaaatccggtccggtgcgcggcggccggcattgccctggccgtctcactcgggccggccgcggccgagagcggcgacctgctccatgtcggagaccgcctgaagatcacggtctacgaggtcgtcgagagcgcggaccgccccggcgcgggtgagccgcaggaggcgggaacggctccccccgtgcaggccgcctacccgcgcctcgatctctcgggcgagtacgtcatcgagtcgagcgggcgcgtgatgctgccgctgatcggcgccttcgacgccgtcgagcgcccggtcgaagcgctgcgggcccagatcggcgacgccttcgtgcgcaccttccggcgccgtccggacatcgccgtgaccttcgtgcagcgcgcgcccgtctacgtcgtcggcgccgtgcgcaaccccggcgcctttccgttcgcggcgggcctgttcgtcgcccaggcgctcgcgctcgcgggcggcgacctgacgaacgcaccgcccgagcgcgcgctggaaatcgtgcggggccgggaacagcgcgagaccgcgcgcgagcgcctgaaggcgctgctcgtacgccgagccgtcgccaaatccgagagcgagggggcggcgctcgcggcggacgagggcctgatcaagctcgtgggagccgagacggccgccgggctgatgaaccgcgagcagcggctcatcaagctgcgtgcccaggagcggtcgagcgcccggacggttcaggagcgcgcggtcgcgaccgccgaggaggaggtcgagctcctgagccagcgcctcgcgaactacgacgcccaggtcaaggcccgcggcgaccggctccggatcatggaagggctgttctcgcgccaagtggtcgagaacgagcgcgtcgtcgacatccgccgggactacgcggacatggaggggcggcggcgggacatcgagatcagcctgctgcagagccggcagcgcttggaggccgtcaagcgcgccctcgaacagggtgagctcgaccggcgcctcgccctcgagaacgagttcgtgagggtcaccggggagttgcgcgaggccgagcgcggcttcgaggccgcgaccacggtggcaagcctgctcgcccgcgggcaggggcccgaagcatccgaggccgccgcggtcacctacgacatcctgcgccgcaatggtggcggactggagacgctgcatgtcggacagggggagatgctcgaacccggcgacgtcctgcgggtgcagatcggccggccgagcgagggggtcggcaaggtcgcggggaaatga

SEQ ID NO: 8453 - DNA, 975 bp, Methylobacterium sp.
atggacctgcgtcagctccggtacttcgtcgccatcgtcgagcagggctcgttctcgcgggccgccgaggtgctgcgggtggcccagccggcgctgagccagcacatgcgccacatggaggcggagctcgggttgccgctgctgcaccgggggccgcgcggggcggtgccgacggaggccggggcgcggctcctcacccacgcccgcgccatcctcgaccgcttcgccgagatccccgacagcgtgcggggggccgaccggccggtgacgggggacgtgcgcatcggcctgcccggcacggtcagcgagatcctgtcggtgccgctgatcgagcgggtgcgggcggagcatccgggcatccggctccgcgtcgcggaagccatgagcggctacatcctcgactggctcaaccgggacgccgtcgaccttgcggtgctctacaacccggccgcgccgaagggcctcgtcctgcgccacgcgctcaccgaggagctgtgcctgttcgggcggcccgcgggcgggggggacctgccagacgggccggtgtcgctggcgcgggcggcggcgctcccgctgatcctgcccgccctgtcccacggcctgcgcgacctgatcgaggaagtcgcggagatggacggtgtctcggtcacacccggcatcgagatcgattcctacgcgcgcatcaaggagctggccgcgcgcggccacggcttcggcatcctgccgcgggcggcggtcgccgcggaggtggcggccggcatcgtccgggcctggccgatcggcagcccgcccctgcggcggcggatctacctcgcccacgccgccgaccggccgctctcggcggcggccgcggccgtgtcgggccacgcctgggacctgctgggcgagctggtgcgcgctggcgtctggcctgccgaattggccggcccggatccagcgcggccgttgaccggtgcggcgggggcggccatctag

SEQ ID NO: 8454 - DNA, 438 bp, Methylobacterium sp.
atgagcgcggtcatcgagcgccgggtcctcgatcgcctgatcgccctcgggcgggcgacggggcggatctcgtccgacgagttgcgcgcccacttgcccaccgcgaccatgacggccgaggacatcgcggtcgtggtgctggaactggaagagtccggcgtcgaggtggaattcgagggaccgctggagaccgcggggcgcccgtccccggtccggccggtcgccgagctgccgccgctcccgacggcgccggccgtcgcggcctcccccgccccgaccgtgcgtgcggcggatccgcccgcatccacctcgtcggcggcggcccggtccggagcttcctggtcgggcggccggaatacggtcacccgtgcggtgattgcggccggcgcgctcaccgttctggtgatcgcggtcgtgctgctgctcgtccggcgctga

SEQ ID NO: 8455 - DNA, 225 bp, Methylobacterium sp.
atgtcctttgccctcgccttgcctgtcgccgaagcctccctcttcaccctcggctgcctgctgatccacgccctgcgccgccacgccgacgtggtgacgggcgccctcgcctgtctgctggtgctcgtcacgctgctgctggcggtggccggcacgccggagccggtgctgcgggcgcatgccctggccctggagaacggcgaggtgatccagttcctcaactag

SEQ ID NO: 8456 - DNA, 660 bp, Methylobacterium sp.
atgatcgctctgcgcagtctcatgacggcactaccctacaatccggccgagcgccgccgggcctgggcgggggcgttcgcgccgtatttcgacatggcgcccaaggaacgcgatccggcgccgggcctactcgccctgacccggcatcgcttcgaagccctcacgctgttcgagatgacggccccggcccagaccttccggcggacgccggtgatggcggccgggcaggcgctcgatcacctgatggttctgttctggctcgacggcgaggggcgcgtgacgtggcatggcggcacggccgcgttcggtcgcctgcagggcgtggtgctcaacctcgcccagcccgctaccctcgtcgtcggccccgtccaggcgactgggctcgtcctgccgcgggcgctggtcggggatcggttgcccgatctcgcggctctgcacggagccgtgctcgatctcgcctccgatccggtgagtcgcctgttctttacgagcgtgcaggacctcgccgagaacgcgagcgccgtgcgcgacgatatgctcccgcaggtcacgcgggccattgccaccgtcgccgccgccgccctgtgccgcctgaccgccgtatgtcccaccgcgatcgttcccgcgccgaagcgcctactggaagaggtcccggcgtga

SEQ ID NO: 8457 - DNA, 219 bp, Methylobacterium sp.
gtgagccgcgaggaattgctcggccccgcgacactgaccgtctggccgcacagcatcgacgccaaggcagtcgaaccgcgcgagatggcaagcctcgtcgtcgccttggaggaggccgcgaccgccctgcgcagcggcgagggcaccccgtgggtcatcacgagtgccggcacgatgcttccgcccgatcttctgcggaacctgttggcagcaccgtga

SEQ ID NO: 8458 - DNA, 240 bp, Methylobacterium sp.
atgcctgtgctggacgacggcttcacttacggtggtctggtcctcggactggctgcgctcgcgctctggctccgtctcgcctcgcgcgccgtaccgaacttcgagaccatgctggcgcgttatcaggacgagcgggtcccctcggataccgcgccgccgagcggattgggccggctcgtggcatgcgccaccgcgctggccctgaccttctcggccatcggctacgccattccggactga

SEQ ID NO: 8459 - DNA, 267 bp, Methylobacterium sp.
atgacgttcgcccgctcgacgctttcggtcgccctgcttctcgccgccctgcccgccgcggcccagactcaggctcccgacctcaccgggaccggcggcggtcccacgaccacgatcaccgcgccctacacgaaccgggagggcgtgacgaaaccgccgggcgacgccctcggcccccgcgacatgtcctcggccgcggcggagcgccgcgaggagcgcgcgatcgagcgcatcgagaacagcatctgcgccggctgcgaggattga

SEQ ID NO: 8460 - DNA, 834 bp, Methylobacterium sp.
atggcgctcaacctgaagcagtggttggcaggcctgttcgggctgatgctcgtcctggcgctggcgcagggcggcctggcgctcgtcaagctcgacgcggtggcggaccggacggcgctgctgctcgacgacacgatcccgtcggtgaacgccgcgcacggcatcaacgccaccatcatccgcacgcggctctggcagttccgctacgtcacggccgagagcgagaccgcccggggcgagagcctggccaaggtctccgagttcacgaacgaccgggacgcccagatcgaggcctaccgggcgcgcgtcagctccgcggcggagcagacggtctacggcgacctccagaccaagctcgcccagctgaagcccgactgggaccggctgcgcgccttcccgcccgagcgccacgcggaggccatggccttcttccgggggccgatgaacgcgaactacctcgcggtctccggggcggcgcgcgccctcgtcgacgtcaatctcgcggccgccaagaccgccgacgcgaaggtgcgcgccgagcaggcctcggccacccgcgcgacgctgctgatgctcggcgtcgccgtcgtgatcgccctcggcgcgacggtcttcagcttcctcggcgtgtcgcggccgatcgagcggatgacctcggcgatgcggcgtctcgccggcggggacacggcctccgagatcccctatggcgggcgccgggacgagatcggcgcgatgtccggcgccgtgcaggtgttccgccagaacctcgtgcgcacccgcgagctcgaggcggagacggcgctggcgcgggcctcggcggaggagcagcgcaag

SEQ ID NO: 8461 - DNA, 372 bp, Methylobacterium sp.
atgttgcgcgtcgatgagagaccgcagatccaggcgacgacccgcgccgcccccgtgctgccgaggcggcccgaccggcccgagcggcgcacgcacggctatcgccgggccggcaccaccgacccgttcgccgctctcgatgtccaatccggccgcgtgatcggccgcggcaaatggcgccatcgccccaacgcggcgtgttcgagaccattgtcggtctggagcgggcggatccacgcctccatcgatcagaccgacgccgagccggagccgttcgtctggacgaagtccgccgacaatatcctcgccggcatcagacacttctgccaacgaacgtcccactcagaccactcggcgggcgacgcgacctga

SEQ ID NO: 8462 - DNA, 861 bp, Methylobacterium sp.
atgtcaatctcgatcgcttcccctctcgcgggtatccgcgatgtcctggtcggccttacggaggagggccgcggtgacgaggccgcggcctcccttggctatggcctgactctggcacgggacgcgggcgcccacctcaccgtgcaatccgccgccctccggctcatgactaccggcctgccgctgtgcgggttcgctgacgagctcgtcggcgccgagaacggtcgcctagccgtcctcgcccgaaaagcggcggagcggatcagggaggacgcggaaggagcgggcgtcgtttgcacggcggagtcgccgagcctcatgtaccacgaggtggtcctccggctctcgacccgggcgcggttgcacgacctgaccgttctcgacacagagcctttcgcggcgatgccggaccgcgacttgatggagggcgtgctcttcgggagcgggcgcccgatcatcgtggtgccgacgggttgggataccttccgggcgcgccgcgtcgtcgttgcctgggacgggagcgcgcaggcggctagggcggcgaacgacgcgctgccgttcctgcgcgcggcggaagcggtcgctgtggtctgcgtcgaggaaaccgagcggctgttgtcgatggtgcccggcgcggagtttgctccgcacctcgcgcgccacggcgtcgcggtcacggtcgacgaccgtccggtcgaggtcgacgtcgccgagaccctgcgcagggcgaccgagcagttcggggccgacatgatcgtgatgggcgcttaccggcactcgcgcatgcgcgagtggttcctaggcggcgccacgcaatcgctgctagcccggagtagcatccccctgtttttggcccactga

SEQ ID NO: 8463 - DNA, 603 bp, Methylobacterium sp.
atgccgatgtcgatccgatcccctctcggcctgagcgtcgtcctggccgccctggttctcgcgcaggccggtgcccgcgccgagccatcggccggaacctggacggatccgccggccaagtccgcggccaagtccgccgtcgagccccccgagccgcccggcgccggggtggctcaggagcggggcgccagatcggtcggcgccaagtcggtcggtgccaagtcggccgagacgaagtcggccgagaccggatcggcgaccccgcgggccgaacccgtgaagcggaagcccgttcgcgcagtccgcgcacccgcgccgcgccgcacggtggcggcccggccggtgcgccggcccgagccggtcgtgcggagcgcgacggtgcggccggtccgggtcgcgcggccgctccaccgggactggccgccggcggagccggtctacgtggcgccgcgcgcctacgatccgcgcgacccgcggctggagcggctctggagcgccgaggaggccggctacctcgcggtgcacgggcgccacgtggcctatccggacgggcgcaccctgcggatctaccggccgagccgcgacgacgaggatctcgactga

SEQ ID NO: 8464 - DNA, 225 bp, Methylobacterium sp.
gtgacgcttactgacctggtcgctgcgatgcaggcccgcgaggcggcccgggcggcgcggggcgagcccccggcttacatcgtcgaggccgacgccacggggacgtccgtcacatggagcctgcccgggcacggcctcgtccggcgcgagcccggcggcaggtgcgtgcgtctgcgggacggagtcgagatcccgacgacgggatggggctatcccgcccggtag

SEQ ID NO: 8465 - DNA, 489 bp, Methylobacterium sp.
atggaaccgatgagaaagctgcgctgggagcccccgggcgggatcgccgccgagcccgctcgccccgatccgctgaccagcctcgtgcgcctcgtcagggggccgacggcccggccggacgcgccgccggtctcccccgaggactggaccgggctgatcgaccgggtccgtctcgccgcgggccgcgcccgcgaggccgaggcccacgccctcgagcgcgagcagcagatgcaggagctgatgcggcaggtccgcgcggaggccgaggcggccgaggcgcgcgtccgcgcggccgagatccgggccgccgccgccgaggcgcgcgccgagacctgcctgcgcgaggccgaggcgcgggtcgagcaggccgaggcccgcgcccgcacggccgagacgtggctgctgcgggtccacgagaccatcgccagcgagttcgcccccgtccaccgggatctcgaacccgctctcgaccgcgaggcggcgcgatga

SEQ ID NO: 8466 - DNA, 270 bp, Methylobacterium sp.
atgatcaaagcaggcccgttcgccgtcctcgccatcctggccgccggccccgcgctggcgcagcccgcgaccacggccgcgcctcccgcggcgggcggcacggtgacgacccagcccaacaccaccggcaacagccccgacgtcgtgatctcccgcggcggcaccggcgccgagaccgccaccacgaactccgccgcgggcggcaatgccggccagccggaacgcggcgtgccgcagggcagcgccaacggcggcggcggcagccgctga

SEQ ID NO: 8467 - DNA, 276 bp, Methylobacterium sp.
atgaacgcgcaggcagaggcacagggagagacgctgagggagcagcttgggcagaagcgggccgcgatcgcggcgggggtcgcggcggggggcctgtccggaacggaggcggaagcgcgggtcgccgacctgctggcgggacgcgcggagccggagacggcggatctgcgccgcctgctcatggagtaccgcgatctcgaagcgcgacctgccgacgaggccgacgtgcgcttggccgaggcgggcgaggtcttcgcgccggaggacgacgcctga

SEQ ID NO: 8468 - DNA, 294 bp, Methylobacterium sp.
gtgacgacccgccgcccgaaccccggccccggcggtgccgttgtcccggacccgcacgcgaaggaggccggtgccatgacgatcaacctctcccttatccgcagccacatggaggtggttggcccggacggcagccatgtcggcaccgtcgacgcggtggagggccggcggatcaagctgacccgcaaggatccggcggctcacggccagcaccacagcttcgacgccgacctcgtggccgcggtcgacgacaaggtccggctcaacaccacggacctcgcggccggcggctga

SEQ ID NO: 8469 - DNA, 876 bp, Methylobacterium sp.
gtgggcgccctcctcacctctcatgctgacggcccgctcgctggccgtcagcccttgacctacaaggggcagcgagtccttacgaccgaactggccgcgagggcgttcggggcgtcggacaagcagctccaggacaactaccagaacaacgccgaccgcttcgaggtcggtaagcacttccataaggtgacgggcgccgagctgcgggcgctcaagaaccaacccgatttcgtcgggttagtgggcccgcaggccccgcacctcaccctctggaccgagcgcggcgtcgcccggcacgcgaagatccttgagaccgatacggcctgggagatcttcgaggcgctggaggacacctacttccgggttcgggaggaggcacgggccgagcgcaccgccgggccgccggtcgagacctccgcccgcgagatccgcctgatgcacaagcacgccctcgccatcgccacggcggccggtctcgcgggcaatcagctccttatcgcggccaaccgcgtcacgaagcgcgggaccggcttcgacgttctggccgagatgggcatcacgcacctcgtcgccccggtgaacgacccgctggtgatcccgacgaagctcggccaggatctcggcggcctgaccccgcgggaggtcaacaagctcctcgcacggctcggataccagtgggccgacaaggaccaccgcgaccgcaacctctggcgtccgacgccgaagggcgaggcgctgggcgcgcaactcatggaccgcgagcgcagcaacgacacgggcgcggcgcagcagctgatgtggcccctggccgcgacgctagaggtgctgcgggcgggcctgcgcgacgatgccggcgacgacggagaggcggcatga

SEQ ID NO: 8470 - DNA, 774 bp, Methylobacterium sp.
atgaacctcttcaaacagttcgatatctacagcctcaaggcgcgggttttcccggcgttgatcgctggcctgccgacgttggcactcctgtttgtcatcgttccgtgggatcatttcggtatgtcccacgccatcgcggcagcaatgggtgcggtcttgctgtttgccttcgcagatatggcgcggcatcgcggccgggtcgtccagacgcggcttgggactggggcgacacccgagcaatggcaccgaggcaaccctgacgtgccagaggtctccaaggataccttccgtgactacatggcccgccagctcaagcggccagccccgacgattgaaaatgaacaggccgaccccgctcgtgccaacgacttctacctgagcgccaatgcgtggctacgtgaccgcacgcgcgacacccgcgcattctcactcttgttcagcgagaacgtcacttacgggttccggcgcaacctgctcggactgaagatgaccggtttggtgctgaacctcctagttttggtgttctgctctggcattctgtggttccggccgccatacttcgccgcgctgcccaatatggatgagaagctgacgttcatcatcgcggcagtagtgctgcactcggcctacttggtgttcgcagttggcaaagcggcggtccgtgacgcttcacgggcgtacgggcggcagctgatcctcagcacggaagccctgatgaagaaggcgcctgccgcatcgaaaggcgtcacgcctgacggatcgaaggctgggtga

SEQ ID NO: 8471 - DNA, 441 bp, Methylobacterium sp.
atgcgctgcacgctcaccctccggacgggcgaggacccccgcccctacgccgtgctcgaccgggccgcccgcgacctcgcggcggcgctcgttccggtcccctccggcatcctgctgctcggcgccgagcacgggcgcgacgtcgcgcggctcggcgccctgctcgcggtgcacgaggcggagaccggcctggccgacggcgccctgcggatcgtgccggtcctggggacggcccgcgccgtgctggcggcggcgagcttcgcggatgcggggccgcgcctcgcggccctcgccctcgacgcgacggccctggcggagcaggccctgggggaggccgaacgcgtgcaggcgcgggcgatggcggggctcgccgccgccgccgcgggcgtgccgctgatcgcgctcgcccgcgacgcggcgggccgcctcggggacgcgtga

SEQ ID NO: 8472 - DNA, 1059 bp, Methylobacterium sp.
atgactgaccggaccgatcaggaggccgagagcgggagacaggcggggcgccccagggcaccggacgacctgccgacccgggatgagaatttccggctcctcgtcgatacgatcccgcagctcgtctggcgcgcgcggggacggggcgattgggtctggtcgagccggcaatggcagggtttcaccggccagagcgaggcggaggcgcgcgaccgcggctggctcgcggccgtccacccggacgaccgggcccgcaccgaggcggcctggacccgggccgaggctgaggatcggctcgcagtcgagcaccggctgctccaggcctccacgggcgagtaccgctggttcgagacgcgggccctgccggtcggcggatccgacggagaggcgcgggagtggttcggcaccgcgaccgacatccacgacctgaagatggcgcaggcgcagcaggcccacctgctcagcgaattgcagcaccgggtccgcaacaccctggccacggtccgcgcgatcgcccggcgctccgccgagacgagcgagagcgtcgaggattacgccatgcatctcgagggccggctgaacgccgtctcgcgggtgcagagcgcgatcatccgcaacccgatcggcggcctcagcctcccgctcctggtggccgacgagctcttcgcctaccgcgcccatgagggcgaggacttcaccatcgccggccccccggtcgtggttccggcgcgcgcggcggagcgcctggcccttgccctgcacgaactggcgaccaacgcggtgaagttcggcgcgctcgcgcagcaggagcggggctcgatcgcgatcgcctggacggtggaagaccgtcagaagggccccgtcctgatcctcgactggacggaaggcggcctcacgctcgcgggcacggagccgcagcgctacggtttcggcatggacgtgctgcagcgtatgctgccgcacgacctgaaggcggaggtcgtcgtcgccttccgcgccgacgggctgacctgtcgcatcgccctgccgctcgacgccgcgacgccgctgccggcctga

SEQ ID NO: 8473 - DNA, 279 bp, Methylobacterium sp.
atgcccgtgctcgccctcgccgccctgctcgccggggcgctggtcgccctgccgaccccggccgcgacggccggtctcgaccgcggcagcccgttctaccgcgccgccccctacgtgcccccctccgccgccaccttcagcgcgcccgccgaggcggagcggttccgcccggtccacgtccacgatgcgccgcccatacctccaggcggccggttgccgaaccagcgggccggaccggtgcgcgaccatgtggtgcgcgacatctgcatcggttgctga

SEQ ID NO: 8474 - DNA, 756 bp, Methylobacterium sp.
atgaccgaagagaccggggcgccggcaggcctcgacatccgccacctcgtcgtcgaggaggccgagcagtcccggatgaacggcgtgcacctcgtggcgaaccggctcgcccgcgagcaggtccgcctcggccagagcgtgcggatcgtcgtcctgcacccgccggcgcgggcggtcgatccgggcgtgtgggacgcgcccgtcgaggcgctgccgctcgagggccacagcctgttcggccacctcgtccagccggcgccgcgcctcgtcgcgggcctcgtcgcgggcgccggcccgggcaccctggtccacgtccacggtgcgcgccggccgctgctgctggcgatcgggcgggagctggcgcgccggggcatccgctacgtcgtcaccatccacgggcgctacgcgcacgtcgccgatgccgggatgcgccgggcgcaccgctcgaccagcctctacctcgcgatgttcgagcgccggatcctggagcgggcgtggttcgtccacgcgctgacggtgcaggaggccgaggccgtccgccagatcgcgccgcgcgcgcgcatcgcgatcgtggcgaacgcggcctattcgagcgccttcgacgcgccccccccgccgcccgcgcgcgccttcccctcgccggacttcccgctcttcgggttctgcgggcgctacgccgcccatcacaaggggctcgacctgctgatcggcggcctcgcggcccaccgggcggcgggcgggcggggacgtctggcg

SEQ ID NO: 8475 - DNA, 1314 bp, Methylobacterium sp.
gtggcactcaagctcgaccgcagggaaccgggggtctggatctcggtgggcacccacgtcgccgtggtggccgccgcgatcatcggcatctcggccccggccctgccggaggcgcaggagggcgtgcccgtcgaggtgatcaccgagaaccagttctcggagctgaccaagggcgagcgcaacgccgagaagccgctctccgacgccaagccccgcgccgaccgccaggcggaaaagttcgaggagcgcgagcccgagaacgccaaggtcgattcgccgaccgcgcccacccgcaccgccgacatgaaggtcgccaacgcggacgcgatggcgctccgcatgagcgagccggacccggccgaggagcgggccaaggcggaggccaaggccgccgcggagaaggcggccgccgagaaggccgaggccgccaaggccgcgaaggcggcggccgccgagaaggccgctgcggagaaggcggaggccaaggcgaaggccgaggccgccaaggcggaggccgagaagcgcgaggaactcgccaagctgatcgagcgcgaggaggccgaggccgccgccgaggcgaaggccaaagccaaggcggaggccgccgcgaaggcgaaggccgaggctgccgccaaggccaaggctgaggccgccgcgaaggccgaggccgagcgcaaggaggccgagcaccagaagcagatggccgagaaggcggaggcggagcgcgagaaggcggaggccgccgcgaaggcgaaggcggaggctgccgccaaggcggaggccgccgccaaggccgcgaaggccaaggcgatggcggacgccaaggcgaaagcagatgccgaggccaaggcgcgcaagcaggccgagatcgccgacaagttcaacgccggcgacatcaagtccctgctcgcctcgaaggcgccctcgcaatcgacgggcgcgacggggcgcgacgtgcagcgcgtcgcctcgctcggtgctgccaccggcacgtcgcagaagctctcgccctcgatgcgcgacgcgctcgtcggcatgctccagcagcagatcgagcgctgctactcggccccgcccggcgcctcgcagggcgtgatcctgccggtactcgacatccgcctgaacccggacggatcgctgggcagcgagccgcgggtgatgcgctcgggccagaacgcgaccgaccaatcgatcgcccaggccgcgctgcgtgccgtgcggcgctgcgcgccctacaagatcccggctcagtacgcgcccttctacaacgactggaaagccatcaacgcggagttcgagttcacggcgacctga

SEQ ID NO: 8476 - DNA, 279 bp, Methylobacterium sp.
gtgatcgttctgttggccggcctctggccgggattggccgtggccctcctcctcggactcggtatcggcgccctctcgggatggccgcaggaccgcgcgatcccgctcggcctcggcatcctcgcgctcctgctcgccgggctcgcgacctcaggcctggtcacaggcgtggccggcctctggctggagagcggcgcgctgatgctcgccgtctatgccgtgggctgcgtgctcggaagtctcgcgcgcgggcagcgcaccgatccggacgggacgtag

SEQ ID NO: 8477 - DNA, 507 bp, Methylobacterium sp.
atgcccaccattcgtcgcgcgtcctggcgcccccgcaagatgttcggctacgacgtcgagtcgtacaagacgaacgacaactgggaactcgaactcaactaccagttcagaaattcagacataacgcccgaggcgagggagatgctcctaaggctgcggttggatatctggttcattcgtttgcctgtagagcacaggcagattgcaacgctcatcaagatcgatacacaccatcgaaccacgaaagagttggtggagagtctggatgcagccccacgcgtctatctgacggaggaattccaaaccagaaatgacacaagggtcggtcggagcgacatgcatggatacattagatatggcacttaccactattcgttcgtcgatggcagagtgaaggaatatactaacggcaatcaagaatttctttggaatgccgtccgagactacatgtactggagcaccgtatcgagagcggacaaagccgccctcgccgccatcgagttctag

SEQ ID NO: 8478 - DNA, 309 bp, Methylobacterium sp.
atggccaggaacacccccaaggatcgggccgcggcggcggcggccctcgctcggatcgccgaattcctcgacgtcccgatcgcgggcttctacgagcctgtgccgggatcgaacgggggcgcacctgccgatccggcccggcaggcggagatccgggagctgatccggcagtttctgaggttgcacgacccgcaggcgcggggacgctgcctcgcctatgtgcggcgcgtcgccgacgaggccggctggcagcccgcccccgtgccgggtgccgccgaggagaccgcctcgcgcctcaaaggctcgtga

SEQ ID NO: 8479 - DNA, 1470 bp, Methylobacterium sp.
atgcggaccctgccggaagatttgcccgaagatctggccttcgcgccggccgtgacgctgctcgatctcctcgcccggcgggcggtgacggcgcgggcgctcctcgaactgcacctcgcgcggatcgcgcggtttccgcggatcaacgcggtgatcttcaccgatcccgacgccgcccgggcgcgcgcggacgccgccgatgccgcgctggagcgcggcgagcgctggggccccctgcacggcctgccgatgaccgtgaaggaaaccaacaacgtcgccggatggccgacgacctacggcgacccggcactggcgcgccacgttcccgcccgcaacgccgtggtggtcgaccggcttctggcggccggcgcgatcatcttcggcaagacgaacgtgccgatcaacgcgctcgactggcagagctacaacgccctgcacggcacgacgcgcaacccctgggacctcgcgcggacgccgggcggctcgtccggtggcgccacggccgcgctcgcggccggtctggtgccgctggaactcgggagcgatgccggcggctcgatccgcctgcccgcgcatttctgcggcgtgttcggccacaagccgacgccggggatcgtgccgaacctcgggaacgagcgtcccggcagcctcctcgacaacgacttggttgtcagcggccccctggcccggtccgtcgccgatctggtgctcgccctcgacgtgatcgccggaccggcagggccggacgcggccgcgtggcggctccagcttccgcccccgcgggcgacgggcctgcgcggcctgcgcgtggccctgatctccgactcgcccgtggccgaggtcgatcagaaataccgcgacgcgatcctcgaactcggcggacggctccgggccgagggcgcggaggtcgtcgcggatgcgctgccgttcgacgatcacgagcggcaccacgcgatctatctccagctgctgcgcggggcggcatccggacggcttccccaggccgcgttcgacgaggcggtgcggcgctccgccgtcgcggacgcggatgcgagcccctacgtttcgcagaccttcagcgcctacgcgcagcgccatcgggactggatcgcggcctcggaggtccgtgcgcagctgaaacgcgcctggagcgccttcttcacccggttcgatgtcgtcatcgccccggcgggcgtcggcccggccttcccgatcgacgaacggcgaccgcgcgaggagcggacgctgacggtgaacgggcaccggatcgactacaacgatcagctcttctgggcaggcctcgcgacgctcgcctcgcttccggcgaccgcagcgcccatcgggcggatcgatggcctcccggtcggcgtccagatcatcgggccctacctcgaagatcgaacgaccctggccatcgcggcagaactcgagcggctgaacccgttcgttgctccgcaggaactcgcctga

SEQ ID NO: 8480 - DNA, 804 bp, Methylobacterium sp.
gtgagcgtcgcgcccgcggtcgcgccggagccgccggtgctcgccctgtccgatgtccggttcgcctatcggggctcggagcccccgatcctcgacgccctcacgctcgacgtggccgagggcgccttcgtggcgatcctcggcccctcgggcgggggcaagtcgaccctgctgaagctgctggccgggctcgaacggccgcaggccggcaccatgacgctcgccgggacgccgatccgcggcccgcggcgggagatcggcatggtcttccagaagccgacgctgctgccctggcggagcgtgcgcgacaacgtcctgcttccggcggccttcgcgtcgcgcgcgagcgatgccgagcgcgcccgcgccgaccacctgatcgagaccgtgggtctggcacgggcggcggctctctacccgggcgcgttgagcggcggcatggcgcagcgcgtcggtctcgcccggatgctgatgcaccggccgcagctcctgctcctcgacgagcccttctcggccctcgacgcgatgacccgcgagcggctctcgctggagctgcagcggatctggatggaggagcgctcgacggcgctcttcgtcacccactcgatccccgaggccctgttcctcgcggaccgcatcgtggtgctggcgggccggccgggccgcatcctcgcggacatggaggtcccgctggcccgacccaggaccctggacagcctcggtgctcccgagttcgcgcggctcgcgcgcgagctgaggcgtctcttcgacgattccgtcgccgcgggagacacggtccgatga

SEQ ID NO: 8481 - DNA, 1092 bp, Methylobacterium sp.
atgatgaaatcgccgtcgcgcctcaggttctccgcgtgcctgatcctcgcgggcctcctgggcacccacatcgcctgtgcgcaggcgcaggaccgggtgaaggtcggcctcgcgatcccgccctccgtcaccgagggaagcgttcaggcgatcgccgaggagctgcgcctgttcggcgacgagaacctgcaggtcgagtacgtcgtcctgccgggtgccggcgccctgctcccgcagctcctccagcgcaacatcaccctcgcgctgccgctccccgagaccctgctgtccgcccacaagaccggcgagccgccgctcccagtgagctacgtgtacaatgccgggccccgcaacacgctcgagatcgcggtcaaggcggattccggcatcaagagcctcgccgatctgcgcggcgccgccatcggggtcggggccctgacctgggggacgatcccgcagacccgcgcgctgctgcgctcggtcggcctggagcccggcaaggacgtgcagatcgtggcggtcggcgtcctcggcgcagggtttcacgcgctgcgggagaaccgcgtccaggccctcaacttcaacagcacgtggatcgacctcctcgagggcgagggcacgcccgcccggcgcctcgcgtttccgccgaccttccgccggatgatcgtcaacgggttcctggcgcaccgcgcgacgctggagagcgatcccgggctgatcgagcggttcggccgcgcctggaccaaggcgctcgtcgtctgcgacgcgaatccgcgcgcctgcatcgaggcgttctggcgccgcaacccgggcgtccgaccgcagggcgacaccgccggtccgctggccgcgaacgtccgcctgctgcagcgctggatcgagccgctgctgcgcgacgagacggggcaggcccgggttcccggcgcctacgacctcgacatcatcaaggcctacatcgccgagatgcgggccaacggcgagttcgcggccgacgacatcccggtcgcgtcctacttcacgaacgcgctggtgccggcctacgcggcgttcgatcgcgaggccctgatcgcccgcgcccgggccctgccgtga

SEQ ID NO: 8482 - DNA, 390 bp, Methylobacterium sp.
ttgggggcacgcattgttccacgaccaggatctgccggccgacaccggcgtcgacgctgctatcggcgagctcgccgacacgggggcgcggtcgcccctcccccggagaccgggtcccgccccgacctccgcccgatcctcctccgtccctgcgcgaccgacgactacctctccgacaagaccgacatcctcgacctcatccggcgccgcatcaaggagcgcgcgctggagccgaaggacatccgccggaccatcagggggtggcggcccgaggagcactaccgggtcacctgcggcttctacgactgcgacatcagccagaggcgcgcctaccagctcgcggccgccgtcgggctcaagcggaccaagcgcctgcccttcgagctctga

SEQ ID NO: 8483 - DNA, 246 bp, Methylobacterium sp.
atgcgcccgatcctgcttctcgccctgctcgtcctgcccgcctccgcctcggcgcagatgatggacggtcccgtggccggcggggcgttcggaatgagcggcgccgactatttcggcgacatccacgaccggccgccgcccgaccgcgaggcgatccgggcccgggcgaaccggcaccgcctcgcatcggcggcgaagcctcgcgcgagcaagccccggatacccgcgcggcgcgcgccgctctga

SEQ ID NO: 8484 - DNA, 561 bp, Methylobacterium sp.
atgctgatcggcgccggctcccttctgtgccgcgggccggccacgccgccccccgcgccgcgcgtcgacgcgcaggccttcgcgccggcggcggccgctggcgttcccaccactcccgggcgcccgcccgccgccctgatcttcgccgagcattttccggtgacctccggcgcggcctgggagccgccggtcgcggcgcgcccggtgcccgcaccgcgcgtcgccgcagcacccgtgcgccgcccagtggcggcgcaggctccggcccgccggccggagctcgtcgtcgcccgcgcggcggagcgcgcccgcgaacccctgccggaacccctgcccgaacccctggccgaacccgcgcctgcgcccgtggcgatctcccagccctggctcgtcccgccggccgcgatcccggacgtcgagggggaggaggacgggctgcccggcctcgccctgcccttcgcaccggcggcccaagcggtcggcgaggcggtgggctacgtgcgcggccgcgccgccgcgctgggcggctcggtctcgatcctcgtcgaccggatgcgctga

SEQ ID NO: 8485 - DNA, 252 bp, Methylobacterium sp.
atgtcgctcgcagcgagcccggacgcgggcgtgagcttcgacccgttcggggagaagctggagacgccgcatgccgtcggtttacccgcggcttcgcgcgacggtgccggccatcgggcggtcgcggccgccttctgggcgctggcgctgcttctcgtcggctgccgcgtctatctctcggattatccggtggcccaggccgtcgcctcggcgggcgaggccgtccgcacgcatctggccgccgtcttctga

SEQ ID NO: 8486 - DNA, 93 bp, Methylobacterium sp.
ttgtccctcgtcatcatgctcgccggcgcagtgggcgccatcgttctcactctggcggcgctgccggccgccgaccgcttcctgcgatggtga

SEQ ID NO: 8487 - DNA, 1014 bp, Methylobacterium sp.
atgaacctcaagcccggcaagatcgctgccctggcggcggccgcaatcctcaccgttcatgcgccggcgtcagccgactggaagccggaacgcccggtcgagttcgtcgcggccgcgggccccggcggcggaacggacctcttcgcccgtgtcgtccaatcggccctgtccaaagacaaactcctcgacgtgcccgtcatcgtcaccaacaaggctggcggaagcggcgccgagaccttcatccatgccaagacctcgggcggcgatgcctacaagctcttcttcggcacgcaggatgcctacgccctgccgctcgccaacaagctgtcctacagcctgaaggacctggagccggtcgcggcgatgaccttcgatccgttcatcctgtgggtgaacccgaaggcatccggcatccaggacgtgaagggcttcatcgagaaggcgaaggcggcgcccgggaccatcaaggtcggcggcgccaaggcgaaggaagccgacgagaccttgatgacgctcatcgagaaggcggccggcatcgacctctcctacatcccctacaagagcggcagcgaggccgcggtgcaggtcgcaggcggccacatccaggccaacgtcaacaatccgagcgagagcgtggagcagtggcgggccggcgtgcagaagccgctctgcgtgttcgaggaaacccgcctcaccgacacgacggtcatcgccgatggcatgtcctggagttcgatcccgacctgcatcgaggcgggcctcgacatcaagtccttcgcccagccgcggaccatctgggcggccaagggcatcccgccggaggcgctggcctactacacgggcctcttcaagaaggtcgcgcagaccgaggagttcaagggctacatggcgcggggcgcgcagatcccgcgcaccctcaccggcgatgaactgaaggccttcatcgagcagcaccgggccacctatgccggctactacaagaccaatggctggctgaagggcgccgtggactag

SEQ ID NO: 8488 - DNA, 483 bp, Methylobacterium sp.
atggaaatctcacgcaggaccagcgagatcgcgacgtccgcagccacagcgctcatcggcctgatcgtctgctacggcgccctggagaacggcatcggctgggaggagtccggcccgagttcgggcttcttccccttctgcgtcggctgcctgatcgtcttcggcagcgccgtcaccggcgcgcaggccacgttccgcccggccgaggggcggccgcccttcctggaccgcgagcgcgcccgcgccgcgatcctgttcttcctgccgatcgtggccttcgcggcgctctcggtctggctcggcctctacgtcgcgatggcgatctacatcgtctacgcgatgtacgtgcctggacggttgcggctcgcgacgtcgatcgcggcgggcctggccgtcgccgccgtcaacttcgtcatcttcgagaagctgttcatggtgcccctgctcaaggggcccctgctgaacgccgtcggcatctactga

SEQ ID NO: 8489 - DNA, 1539 bp, Methylobacterium sp.
atgagcaacatcagcctgctcctcgacggcttcggcgtcgccctcagcacccatcacgtgctgatcatggtcggcggtgtgctgctcggtctcgttgtcggcgtcctgcccggcctcggcgcgccgaacggcgtctcgctcctgctgccgctgaccttctccatggatccggtctccgcgatcatcctgctcaccagcatgtactggggggcgctgttcggcggctcgaccacctcgatcctgttcaacatcccgggcgagccctcctccgtcgcgacgacgttcgacggctatccgatggcgcggcagggcgaggcggtgcgcgcgctgacgctcgccttctcgtcggccgggatcggcgcgctcaccggggtcatcgtcatcaccctcctatcgggctgggtcgcgaacttcgccctgcgcttcggcgcggccgagtacttcgccgtgtatttcatggccttcgcgagcttcatcggcatgtcgagcggctcgcccttcaagacgctggtctcgatgatgctgggctttgcctgcgcgaccatcggcgcggacaccatctcgggcgagagccggctcaccttcgacttcgagcagctgatcggcggcgtcagcttcctcgtcgcggtcatcggcctgttcggcctcggcgagctgatcatgacaatggaggagaacctcgagttccacggcgtgaaggccagactcagcctgcgcgagatcggccgcgccgtgctcgaactgccccgctactgggccacgatcgtgcgcagcgcgctcatcggctgctggatgggcatcaccccgggcggtccgaccgcggcctccttcatgagctacgcgatcggcgcccgcttcgcgaaagacaagacgcgcttcggcaagggcgcgccggagggcatcgtggcaccggaaaccgccgaccattcggccggctcctgcgcgctcctgccgatgctggcactcggaatcccgggctcggcgaccgccgcggtcatgatgggcggcctgatgatctggggcctcgctccgggacccatgctgttcaccacgcggcccgacttcgtctggggtctcatcgccagcatgtatctcggcaacatcatcgcggtgatcctggtgctcgcgacggtgccgatgttcgcctacatcctgcgtgccccgttccgcatcgtcggcccgatgatcacggtggtgtgcatcatcggcgcctatacggtggccagccacaccttcgacatctggctcgcgctgatcttcggcgtcgccggctacgtgttcaagaagctcgactacccgctcgcgcccttcgtgctggccatggtgctcggcgacaaggccgaggacgccttccgccaggcgatgctcacttcgggcggctcggcctcgatcttctggtccaacggcctcgtcggcaccatgatggcgctgggcgttctgctgctctgcctgccgctgatctcgaaactgctgcgcgaaacgggtatcggtttccgcaggaaggcgctgccgcagcaacgggagatcggctcgacatga

SEQ ID NO: 8490 - DNA, 108 bp, Methylobacterium sp.
atgcaggacatgaccctgaagctcttctcctacggcatgatcggcgcgttcgtatgcggcctcgccctcaccacctggagcgcggcgggcctgctgatcggcctctga

SEQ ID NO: 8491 - DNA, 918 bp, Methylobacterium sp.
gtgacactgatcaatctcagcctacccggcaaccttctcggcggcaccaacgtcggcggactggtctctatcggcggcaacaatacgagcagcgataccatcgccgatatcggcatcgcggcgaacctgcccggtgcgaacatcgtgaacggcgtcacgagcctgctgacgccggaaggcaacctgctctcggtcgcggccgacgccaacgtgcaggtcgggaccggcgcgggcgacctcgtcaacggcctcatcggcaacgacctgctcatcggctcgggcggcgacgaccggatcaacggcggtgcgggcaacgacgtcctcgacgggggcgagggcggcgacctgatctacggcaaccagggcaacgacacgctctacggccgcttcggcgaagactacctcaacggcggccagggcgacgacctgatctacggcaaccagggcaacgacacgatcgccggctccctcgggcgcgacacggtctatgccggccagggcaacgaccgggtggactactcggccttcagcgacgcgcagctcatctacggcaacctgcaggacgacgtgctgatcggcggctcgggcgccgaccggatgttcggcggccagggcaacgaccagctggtgggcggggccggcagcgacaccctctacggcaatctcggcgacgacatcctgaccggcgggtccggagcggaccggttcgtgttcgccggtccgatcgccggccagaacagcggcgcggaccggatcaccgacttcaatgccggcgagggtgaccggatcgcgctgaacggtcagacggccaccgccttcgacagcggcggcaacacgatcctgctcctgtccggtggcgggacgatccagctcgacggcgtcgcggcgggttccgtccagagcggctggttcgcctga

SEQ ID NO: 8492 - DNA, 2259 bp, Methylobacterium sp.
atgccgccggatgatcgtcgcgagcgcccgctcctcaacccggtcctgacgctgcgcaaggaaccggtgccggaggccgccaaaggcggcggtcccagcgagaaggacatcgtgcaggaccgcctgtccacacagaggcgggcgctctcggcgcggctggaggcgatcgcggccagcggcgccaccgccccgcacgccgggcgcatccacctcgctgtcgagatgttcgaggactcgttcgcgccgagctggacgccccgccccctattcacggacggccgccgcgcgcgcctcgttgcacccgcccgcaacggctacctcgtcgaggccgaggttgcctacctgccgagcctcgcccggcacatccgcaccgcctcagcggtcgacgcgcgggtcgccatctcccgggtgcgcgacatccgggcctacggtgccgacgaattgctccgggggcgggagatcgaggcgctctgggaccgggctactgaggtcgagggtggcaaagccttcgtcctgtggctgcttcccttccgcgacgagggcgcccgtgcgtcggtggtccagaccctcatgcggttcgagaccgagcgggccgtggtgccgagctactcggcagtcgagttccccctcgcgcgcagggacggggcggacgcgctcgtgactatccgaggcgatgaaaccaacctcgcccggactgtccgccggtatcgcggggcgggccacgcgcgcggcgtcgtcacggtgccgagccgcgacgcgcttcggaccatcgtcctgtcgggctcgtccttccgcatcgacccggtgccgcgcatcgaggcaacagcgcccggcatcggcgccgagccgacgccgcccgtgccaaacgccagcgctcagccgatcgtagcggtggtcgacggagggctcaccgcgcagagctacgccggccttgaagcctggcgggcacacgatctcgtgccgccaggcatggccgatcacgtgcacggcaaccgcgtgacctccctcgcggtacatgcccatgcctggaacaaccgcctcggcctgccgcgcctcgactgccgtgtgggcacggcgcgcgccgtgccgcgcgagggctcgaactatccggccgaccccgcccgtctcgtcgactacctgcgcgccctcgcccgtgcgcaccctgagacgaaggtctggaacatgtcgttcaacgcgatcgagccagaggccgaagccgacctcgtgagctttctcggcgacgagatccgctcgatcgcgcgtgagcacggcatcctgccggttatctccatcggcaaccggcgtcgcggcggcaccgaccagctctgcgcccccgccgattgcgaggcggccctgacggtcggcgggcgagaccacgcgggagacggcatcccgggcggcccctgcagcgtctcgctgcgcggccccgggccagacggcatgctcaagccggacctgtcgtggttctcgcgcctccgcatgatcggcggcagccagcagacgggcagcagcttcgccacacccctggtgtcctcactggcggcgcacaccttcgccaacctgcgcgacccgacccccgatctcgtgcgggcgctgctcatcaacgcgaccgagttggaggggcacgacgcggccctgggctggggtacgccctggcatgaccacttcccctggacctgcgcgcccggctccgtgaccctcgcgtggcgcgccacgatgcggccgggcttcaactattactggcgcgacatcccgatcccgccggagatggtgaaggcgggtaagctcgccgggaaggggcagctcacggcgatcctcaatccgctcgtcgcggaggatgggggccccaactacttcgccacgcgcctgcaggttgccctgcagtacggcactcgcgctgggggcacaggcaacctgctcggctcgatgcgggaggaccgggcgcccgagcgggaggccagggccgacttggccaaatggcaccctgtccgccgtcacatccgggatttcgggaagcgtgggggcatcgcgtttagcggcaacaccatgcggctgcacgcccgcatctacgcccgcgacctgttccagttcgaggacgtcaccagccaccacgaccttggcgagcaggacgtggccttcgtcctaaccctcagtgacgggtcggacaggagcgacctctacaactccatgacgcagcagctcggcaccttcgtcgagagcgcagtggtcgagcagacggtcgagatcgagcaggagtga

SEQ ID NO: 8493 - DNA, 135 bp, Methylobacterium sp.
atggaagcgtgcattgcggcggccgagcgcgcccacgaggcgctcgcccggctggaagaggcgaacatcgacgcgccagtgagggggtgggcgctctggggctccaccgacatctggggcctgcccctgcgatag

SEQ ID NO: 8494 - DNA, 312 bp, Methylobacterium sp.
atggccgcttccgccgctattcccgccgtcccgctactcggcatcgacgccgacgacccggtcgtggccagcgtcttcgagattgccaggaaatacctcaagacgaccgacgggaactggaacaccgagacccggctggaggaggcgcagatcgactcgctcgacttcgtggagctggtcttcgagatcgaggaccggttcggcatcgaactgaacttcaacgcgaacgagcaggcggtgagcgagatgacgttcggcgacgtcgtcgagctgatccggaccgcgctcgcgcgcaaggcccgtaccgcgtga

SEQ ID NO: 8495 - DNA, 1191 bp, Methylobacterium sp.
gtgagtgccgtcgtcgtctccggtctcggcgtcgcggcgccctgcggccttaccaccgcggatttctgggcgagcctcgtcgccggccgctccgccttcacgccggcgcaagcgctgcccggttcgggcatcatcgccgcagagatcgtggagagcgcggatttctccggcctgccgatcccggtgccgggggcatgcgaccgcaacgccgtgctggccgtggcggccgcgcgcgaggccatggcggatgcaggcctgacgcccggctcggttgcgccacagcgcgtggcggtcgtgatcggaaacggcggcggcggcctcaccagcctcgacacgcagtacgagcgcctgttcgtggagaacaagcggccgcacccgttctccgtggttcgggcgatgggaagctcctcggcgagctgggtctcgatcgcgttcggggcgcaggggccttgcttcgtcgtggcgagcgcctgcgcctcgggcacgcaggcgatcggcgtggcggcccagctcgtgcgcgcgggtatcgtggatgtggcgatcgccggcggtaccgaggcgccgctctcccgcgggacgctgcaggcctggaacgccatgaagatcatgagccgcacgggctgccgcccgttctcgcgcgaccgcgacgggctggtcgtcgccgagggggccggtatcgtgatcctggagcgcgaggcgcatgcgcgggcgcgcgggcgcaagccggaggtcgcggtggcaagcctcggttcgggcgcggatgcgggcgacatcgtcgccccctcggcagatggcatggcccgggccatgcgcgcggccctggcagaggccgatctgtcgccggccgacatcgcctacgtcaacgcgcacgggaccgggacccgggccaacgacctgaccgaggtgcaggccctgcgcgcggtgttcggcggggcgttgccgccggtctcttcgacgaaggcggtgaccgggcatgcgctcggcggggccggcggcctggaggccgtcgcgaccgtgctggcgatgacgcacgcgctggcccccccgaccgcccatctcaccgatccggacccggacctcgacatcgacgcgatcccgctggaagcgcgcgcgatgccgatcctggcggcgatgtcgaattccttcgcgttcggcgggctcaacgcgagcttggtgctgcggcgggtgtga

SEQ ID NO: 8496 - DNA, 201 bp, Methylobacterium sp.
atgagcgaccgcgccacccaactggctcgctgcctgatggaggagggcatccgcttccccgtgggtcaggacggcaagatcgcgccgggctccatccggacgttcctggccgatcgcttccccggcatcagccaagccgaggtgacccgcggcgttctcatcgcgatcgaactcgccaagttggatcgggggttgcgatga

SEQ ID NO: 8497 - DNA, 1125 bp, Methylobacterium sp.
atggcctacgatgtcttctggttcctgccgacctccggcgacacgcgctatctcggcacctccgatttcggccgcgcgcccacgaacgcctatatccggcagatcgcagagaccgcggaccggctcggctacgacggcctgctgatcccgaccggcgcctcctgcaccgacccgtgggtgacggccgcgagcctcgccaccgtgacgcgacgcatcaagctcttggtagcgctgcgcacctcgatcaccggcccgacgctcggcgcgcggcaggccgcggcgctggacgaggcgctgggcggccggctcctcctcaacgtggtggtggggggcgacgccaccgagctcgccgccgacggcgccttctacgaccatgccgaacgctacgcagcggccgacgagtacctcaccgtctggaagcggctgatggcgggcgagacggtcgatttcgagggccgccacgtccgggtccagggcgccaggaacttccaccccgcggtgcagacgccctggccgccgctctatttcggcggctcctcgccggctgcgcacgagcttgccgccaagcatgtcgacgcctacctgacctggggcgagccgccggaggcggtggcagagaagatcgccgacgtccgcgagcgcgcggcgcgccggggccgcagcgtccgcttcggcgtgcgcctgcacgtcatcgtgcgcgagacggaagaggaggcctgggccgaggccgaccgcctgatcagccgcctcaccgacgacgacatcgctcgcgcccaggccaactacgcccggatggactcggttgggcaggcccgcatggcggcgctccacgggggccggcgcgaccggctcgtggtggcgccgaacctctgggccggcgtcgggctggtgcgcgggggcgcgggcacggcgctcgtcggctcgcccgaacaggtcgtacagcgactcaacgactacgccgcgctcggcgtcgacaccttcgtgctctcgggctacccgcacttggaggaggcgatccgcttcgccgaactcgccttcccgctgatcgccggaaaagaaccggtgacgctgcgggactccgcccagaccggcggcgctttcgacatccgcgccgccgcgcggtga

SEQ ID NO: 8498 - DNA, 1647 bp, Methylobacterium sp.
atgtccgtcatacggctgccgttcatgtgggaacgggcgcagctgacggagaacggccccctgaacgccggcgagatcgcgcagatggacgcggtcgtcggctacgcggcgagccggggcatgcaggtgatcctggaaccgcacaatttcgggtccggtttcgggcatctgatcgggagcgccgagacgcccaacagtgccttcgcggatttctgggctcggctggcgggccacttcgccggccgcggcaacgtcatcttcgggctgatgaacgagccgcacgctcagaccgcgcagcaatggctgggttccgccaacgcggcgatcgcggccatccgcgcgaccggcgcgcgccaggagatcctggtacccggcagctactggtcgggcgcccacagctgggtcagcagcgacaacgacacggtgaccgggcccggcatcgtcgatcccctgaacaatttcgccttcgaggtgcatcagtacctcgacagcgacagttcgggcacgcaccccaacgtggtctccgcggccatcggcgtggagcggctgagcgccgtcacccaatgggccgaggccacgcacagccgcctgttcctcggcgagttcggtgtcgcgcaggatgcgaccagcctcgcggcgctcgccaacatgatggcctacatgcgcgcccacccggtctgggagggcgcgacctactgggccgccggaccctggtggggcgactacatgtacacgatcgagcccaccggtctcggcagcgggcaggtcgtcgatcggccgcagatggacgttctggaactcttcctggggagcgctgcgccacagggcggtacggcgaccggcgcgatcctgagcgggacatccggcgcggacctcatcaccctgccgcccgggtccgtcacctaccggggcggcctcggcaacgacacggtctacggcagcgtcgatgccgacctgatctacggcaaccagggcgacgatcgcgtcgtggccggcagctcgccgggtaccctggggcgcgacaccgtcttcggcggccaggggcaggacctcatcgattacagcaacaacggcctcggctcgttcatctacggcaacatgggggacgacacgctcaccggcggatccggcgacgacgtgctgtacggagggcagggccaggatctcatcgcggtcggcgaggggagaaacctcgcctacggcaacctgggcgacgacacgctcatcggcggttcgggaagcgacacgctgttcggcggccagggcagcgatgtgatcaccgcacacagcgccccgggcgcgggatcgctgatctacgggaatttcggcagcgacctgctgacggcgggttcggggaacgacacgctctacggcggtcagggcgcggacaccctcgtggcgggcgcgggcagcgacgtgctggtgggtgggctgggggccgatctctacgtgctcggcaccggaacggggcgtgtccggatcgtcggattcgaccagagcgccggggatcggatgcggatcggcggccagaccttctcggtcggcaccgcccagagcggagatgccctgttgaccctctcgggcggcggcacggtcgatctggccaacatccgggcagagcaggtgagcgcgagcttcttcgcctga

SEQ ID NO: 8499 - DNA, 2316 bp, Methylobacterium sp.
atggcagttcccgagaccgccgaagccggctcgcgcttcgagcccttcgccgtcctgtcgttccaggcccggatcgccgaggtctgccagcgtcgtctcggcgcggcgctcgacggttacgtcgccgccacggacgccgccaaccgcgcctggatcgatgccgcccggccgctcacgccgctgggggcctggggtgaggcggtcagctactggaccgatttcacccagcgctcgctcctgttctgggacacgctccggcatcgcggcaacgactggctggcccacgaggccgcgggcaagccgcccctgatcgccttcgattacgagatcgtggccgatgcgcgccgctacgagcgcccggcgaactacgcgctcgcgcgcatcgccgcgcccccggaccgcccgaccgatcccgacaagcgcccctacgtgatcatcgacccgcgggcgggtcacgggcccggcatcggcggcttcaaggaggattctgaggtcggcgtcgcgctgcgcgccggccatcccgtctacatggtcatcttcttccccgagccggtcccaggccagaccctcgccgacgtggcctgggccgaggccgagttcctgcgcgtcgtgcgcgatcgccacccgacacgcgggaagcccgtcgtcgtcggaaattgccaaggcggctgggccgccatcctgatgggcgcgctagagccgaaaggcgccggccccatcgtgatgaacggcgcgccgatgtcctactgggccggaaacgacgccgagaacccgatgcgttacgcgggcggcctgctcggcggcagctggacggcgcttctggcaagcgatctcggcggcggcaggttcgacggggcctacctcgtcgagaacttcgaatcgctcaacccggccaacacgtatttcggcaagtcctacaatcttttcgcaaaaatcgacaccgaggcgccgcgctacctcgccttcgagcgctggtggggcggctacttcttgatgaaccgcgaggagatcggctggatcgtcgacaacctcttcgtgggtaaccggctggcctccgggcgagcggaatgggcgcccggcagggccttcgacctgagggcgatccgctcgccgatcattctgttcgcctcgctgggcgacaacatcaccccgccacagcaggccttcaactgggtcgccgatctctacccgacgaccgaggatctcaaggcgaacggtcaggtgatcgtcggcctgatgcacgagagtgtcgggcatctcgggatcttcgtctccgggagcatcgcgcgacgggagcacagccagatcgtggatctgctcgactacatcgagcaccttccgcccggcctctacggcatgaaggtcgaggagcagcaggtggacggcgcggtgcgctacgacgccgtcctgcacgaggtccgggtcgaggatctgcaggagctgcagaaatacgcccgcaaggacgaggtgccgttcgtggccgtggagcaggtctcccggctgaacgccgcggcctacgagagctgcgtgcgtccagtggttgaggccctagtccgcccggagacggcgcccgtgctgcgcgcgctgcacccactcagggcgcggcgctgggctctgtccgacctcaacccgttcctcgcgccgctcggcgcctgggcagatcttgtcaggacccaccgcgtgcggcgcgacgaggccggccccctggccacggccgagcgtcggggcgcggccggcatcatggccggctgggacctctaccgcgacctgcgcgatgcggcggccgagactctgttctacgccgtctacggcaccgtgagcctgacggcacgcacggaagtgccaaaagcggcttcccctgaccgagacaccgcaacgaaccgcgttgccctggaccagatcgacgagggcggcttcacggacgccgcagtccgggccggccttctggtgtcgcggctcggtcgcaatcagcgtcgcgtctcgaccttcaagcggatccgcgccctcgtgggctacgatgtcggcctgcttgccatgccgacggaggcggcggcgcgggtcgtgcggcggcaggctgccatcgtagagcacgcaccggatcaggctcttgccacgctgccgagccttgtatcgagggcggaggagcgacgtcggctcctcgacgtcctgaagcgtttggcgagccatctcgaccttcagccggaacagcgggccctgattccgcgcatcgaggagcttctcggagccgcaaccgaggccgaggcggcaccagaccgcgagtccgtgtcccagccgatccggcgccaagcgagctga

SEQ ID NO: 8500 - DNA, 1596 bp, Methylobacterium sp.
gtgattcagtccgaggcggaggagcgcgcgcggatcgcggcggatctcgaagaggcgcagcgcaaggcgcaaagggctctggcgcagctggaagcgcggacgcgcgaggctgagatgagcaaggcccgcctggagttcatgctcgacgagaagggccactacgtcggtgagcgtcttccccagatgctgaagcgctatccgatgccggctgaggagattgcggtcgtcccggtcaagcggggtcgcggacgtccgcgtaaggacggttcgccggcgcagccgcgttcggaggcggagcgcaccgcgtctcgcgcacgtcgctcttcgggcaaccgggcttgggataagcgcggacgtagcgctgcgttccgcctgcgtgtgccggcggctatctccgaccttaacgacacaggcaatatggtcacggcggatgcgtcgacacaggcggccatcgccctcgtgccggaccgcgagagccccgggccggagccggaggcccgtggcccggaggtcctccagccgcagagtgtcgagccggtggtgcagccgccgctcgcggccgcgctcatcctgccggcgctgacgcgcgaggtcggcgatctgctgggcgatgtcgataatccggacgaggatgagcgcggccagatcgaggccggcacgatcagcgataaggtgctcgacatcttctccgcggaggccttggccgagcgggcgaagctgcgtgatccccggcgtctgccggcgggctacgatccgtcctgggcggatgcctgggtgcgggatccgctcgcgccgctgccggagatggtgcgggagttcatcacgttcgggactgctgtcgacaagcgcccggaggatttgacggacgaggaggcgcgtctgctggcggggccggcgatgtttccgattccggaggacttcgatccggcggactaccggggccggcctctgccgcccttctttacacgggagaaggacgtgtcggcctatgagtggaaggccgagatcacccgggcgggcggcacgatgcagaagctcgtggcgaggaacgccctctacatcgatgagatccgggagatcgagcgggcgcgtcggcggatgtggccgtacgcggtcgcgcgtcgggacctgatcaagggcctgatggaaggcctcgcggtcggtgaactcagcttcgagccggtctcgatggcgccggccgatctggcgcgcagcgtgcgctggctggtcttccgctgggccgatcacgactggctgcagttgatcgcgaacgccgatctcgacctctactatacccggatcctcgacaaggtgccctggccggaaggcctgtcgcggcgcgccctgctggagcggttcggcaagggcgtcgatctgacgagcccgctgaacatgtcgtcccaggaccgtccgccgctgttcctcttcgaggaggttgagtgggtctacggcacgggcttcggcatcagagcggcggatggcggccggatcgatctcccccgcgtgggcatcgcgcccggtcccgacttcggggcgatcgactgcacggttccgatcgagcgcgatcccgatgtggatccgcaggcatggaggtga

SEQ ID NO: 8501 - DNA, 102 bp, Methylobacterium sp.
gtgatcctgctcgacctgccagaccggcccgcggtgatggtcccggagatcgaggcgattgagcagcatctcgcccgtctcatcgacgacctgctcggctga

SEQ ID NO: 8502 - DNA, 711 bp, Methylobacterium sp.
atgcttgaaaccaggaacctccgggccggctacggccacatcacggtgctgtgggacctctcgctcaccttccgagagggcgcgctcaccgcgatcgtcggcccgaacggggccggcaagaccacgctcctgcgcgcgctcaccgggctgatcccgcacgacggcgagattcggctcgggggtgagcgcctcgccggcaagacctgggatctggcgggccagggcatcgtgatggtgccggagggccgcctcgtcttccgcgacatgagcgtggaggagaacctctgcctcggcgcctacccgaagcgctgccgcggcgacgtgtcctccgggctcgaccgggtctacggcctgttcccgcgcctgcgcgagcgccgcgggcagatggccggctcgctctcgggcggcgaggcgcagatgctcgccatgggccgggggctgatgtcgcagcccaagatcctgctgatcgacgaaccctcgctcggcctcgccccggtgatcgtcaacgaggtgttcgacatcgtggcccgcctgaaggaggccgggaccacgatcctgctggtcgagcagaatacccgcgtggcgctctcggtggccgacgacgtgcatctcctgcgcggcgggcaggtgcggctcagcgtgccggcggcgcaagtcgatctcgaccgcctgcacgacctctacttcgcgcgggaggcgcagagcgcgtga

SEQ ID NO: 8503 - DNA, 873 bp, Methylobacterium sp.
atgatcgccctcatcctccaggccctgttctcgggtctcctcgtcggcagcgtctacgccctcgtggcgctcggcatcgccatcaccttcggggcgatgcggatcatcaacctcgcccacggcgagctcgtcctgctcgcggcctactccgcctacgtgatcgaggcccgcgccggcctcgatccctacctcgcggttcccctggcgctcgtcgtggtggcgatcgtctgcaccgcgctcttcctgatgatcgaccgcatccgcgagcaccgggagctgaactcgctgatcctgacctacgggatcggcatcgtgatcaccaatgcgatcctgctggtcttcgccagcgacgtgcgcacgacgaactcgccgcgccttcaggacgcgacctcgatcgggtccgtctacgcgatgaacggagagatcgtggccttctgcctgagcctcgcgctgatggtcgccctgtggtggtggctgaagaagagctggtacgggcgggcggtgcgcgccgtctcgtcgaaccgggcggcggccaccctgatgggcatcagcccggtccgcaccgagctggtctcgttcctggtcgcgggcgcgctcgcgagcttcgcgggcgtggcgctctacacgatgagcgtggtgcagccggcgctcggccacgcgctgacgatcaaggccttcatcgtcacggtcctggcaggcgtcggctcaatccccggcgtattcctggccgcgatcctgctcgggatcaccgaggcgctcaccgtcaccctcgcgagttccgccctgcaggaactcgccggcatggtgctgttcctcctcgtgctcttcctgctgccgaacggcctgttcggcgcgcgcgcccgccgcggctga

SEQ ID NO: 8504 - DNA, 264 bp, Methylobacterium sp.
atgttccaccacgttgcggtcgcgctgctcggcggctttctcaccatcgctctcggctggcggtcgctcggcctcggcgccctggtgctggcgccgctcgtcgccagcctcggcacgctcgccgtcgccgtcctgctcgatcggcgcgcccgccgggccgcgcccgccggctcttggatccgggacatcgaggccggcgcgccaagggccgtggccaacgaccggagcacggacccggcggccctgtgccgccgccgcgcctga

SEQ ID NO: 8505 - DNA, 309 bp, Methylobacterium sp.
atgggggttgcatcggatatggcaagagccacgcaggaggggggaagcgcgccggacaccgcgaccttgctccaggatgcggatcgctacgacccgctccggatcgctctgcggaacgcgcgcgacgcgttcgatccggatcgcgcgatgcgggagaggcgagcgcccgcagcgccgctgatctggtacatcgaggacacccccgacatggcactcccgcgaacgagggccggttcggacgcgcggccgcgtcagccggacatcggtgccgtgcgcggggacttcgacaccgctgccggcatcgtgtag

SEQ ID NO: 8506 - DNA, 255 bp, Methylobacterium sp.
atgacgcaagacccgaacagcggcgcacccgccgcgccggaggatgtcccgccgccacgccgcggcccgggccgcgcccagcgccgctaccggctcgatccggccgcccgcgcccggatcggccgcggcctgcggctgctctacgcggaagcgctgacccagccggttcccgagcggctcgaacggctcgtcgcacaactcggcgcggcccgccccgcttgccccagcgaacagattgaggagccgccgcgatga

SEQ ID NO: 8507 - DNA, 792 bp, Methylobacterium sp.
atgacccagccggcggcggtcgagatcctcacgtcggcagccccggcatatgggatcacgccgcttctctcgaccaatggtcgcctacgcgcagccgtgcccgtcctgatgacggacgggagccttcacggctacgaacttgaggtccaggcgagcggcggccggccttatgttcgggaggcgaccctaggggctcgtctcccggcgttctgcccgatgcggcatatcaatgccgatgggtcgttctgcctgaactgggaaccctacgagagcttggcgctcgaagccaccgcggacggcgcgacatggtggggtgccgtgttgcagttcctgcgcctgcaggagcgtgcgcggcgcctgcgccgatggccggaccgtcgcgaatgggcccatggcggcgctgccgtacaccagcgcaaggcgcttgaagcggccgcggcgatctcgccccggctgcgcgaccggctgttccagggacgcgtagccgcggttcggtcgaaagggtgttcgtcgcgggggagcgcggttcggttgcatgtcgacggccggacgatggcgcgtatcttcgtcaagcaacgtcgcccggcgacgcttcggcaagcctgcccgtgcgggcaggacgaacggcccctgacgctccggcgctgccgcgatcatgctgaccgcctcgtcgagatcgtcggcgcgatgcaggacatggcgacagcggagcgagcgttctggaagtcgttcgaaggtaaagcttgttgcgggaccatgaagggttgcccgttgggcaccgccaagccgtga

SEQ ID NO: 8508 - DNA, 549 bp, Methylobacterium sp.
atgcaggccgacggcgccacggttgtcggcacttggatgtggcgatgcggcgattgccacatcctcgatgtgggcgccgccgaactcctgacgggcgcctcggacctcgccgacacggaactgcctgccgaggcgctcgcccggcgcgtcctgctggcggatcgtccggccgttctctcggcgctggagcggatgggtcgcgagcgcggcgtcgtcgtgttcgagtatcgcgtctggacaccagagggcatccgctggctgctgagtcacggccgggtctatccggcgcagccgggcatgccggcgcacggccacggcgtcctcatcgacatcacccaccggaagccgccacctccggagccggccgggccggaagagacaacgccgtccgctctcgagcgtgcggcgcgccacgcgctcggcgcgcgcgccgcggtcgacgaggacggaagcgcctcgctccggctcctggtcgacatgttcctgctggaggtcggacgcgtgatcgcgcgccgagccggggtggcgggcgcacgcggcctgcactga

SEQ ID NO: 8509 - DNA, 315 bp, Methylobacterium sp.
gtgttcgaaaccgatgatccgcgaccgtcagaaacgaccgggacctcgaagttcggtaccgagcacgcgtccggccggccgctgcccgcggctgcgcaacgcaccctggacgacgtcgccgaggccctcggcctcgcgaccgatcttctcggccgcatcgattccgccgcgccgaaccgggacatcgctgccgccagcctcgcggaggcatcggccctcctgcaggccttcatccgcatcgaggacgcggcaacgcgccagcgctgcctcgccttcgtgcaggccgccgccgccgaggtacagggccgcagctag

SEQ ID NO: 8510 - DNA, 252 bp, Methylobacterium sp.
atgaaccgcgacacccacaccgcggccgacgccgagcgcgcgctgcgcgccctccagcgcgacccggccgcctctgcctacggcgcgtacctgcgccggaagggcctcatcggccgccccgaccccggagcccgcatgaagatcctcgccatcctcgcgcggctcctcggccgcgggcccgacgatccgccgcccgcgccggccggcgtgatccggttcgggcgcgtcctctcgcagggaatcggccgatga

SEQ ID NO: 8511 - DNA, 249 bp, Methylobacterium sp.
atgtcatcgcatcatcgcgccgtcgcactcgcgctcgccggcctcctcgctctccccgcactcgccgccgcccgcgaggcgcaccacggcaaaaccgcggcgcatcaggcagcaaagccgcagagccgggcggccatcgccgcttcggaaggcttcacggcccggatgagccgcctcgacgccctgatgggcggacagcaacagcaactcgcgccgcgcgcccgctcggcgagcgccctcccgaactga

SEQ ID NO: 8512 - DNA, 354 bp, Methylobacterium sp.
atgaccgaagaccttgcgccctcccggcgtcccaccgcgcgcggcctgtcgttccgccgccgcagccggatcgtgcccggcccgctccggccggcgcagacgcgcacgggcggtggcgtggcggccggcatgctcaccggcgccctgctcggtctcgccttcctggcagccttcacgctgccgttcgtgcgcgtcggcggttccgcgggcgaggcggagcacaaggccgcccgcgcggccgtccggacctccgcggcccaggcggaccggggtggggcggggggcatggccgcgccggagcgcgccgccgatcgcggggtgccggacggtccggcgggcgggagaccgaattag

SEQ ID NO: 8513 - DNA, 837 bp, Methylobacterium sp.
gtgccctctctctcgacccggctgatcccgcccgcgatgctggacgtgatcaagcgctcacccaccctctacggcgtcgggcgcaaggcccgcttcgcgctgggctcgcgcctcggcgcccgcccggtcgccgggatcgggcgggcccactacaacgacttcatgctgacctcgaccgcgcccgacaaggtcgcgagctacatggccggcgccgcgcagttcgtcgacatcctcgaggccgccgtcaccgaggccgggcgcgactgggagtcgatcacccgcgcgctggagatcggctgcggctacggccgcatcgtgcgccagctctcccgccgcctgccgggcgagcgcatcgccgtctgcgacatgatcgaggagggcgcccgcttcacggccgccgagttcggcgccgcgcaggtgccggtgatggagcgcgccgagccgaagccggcctccgcctacgacctcgtctacctgctctcggtctacacccacctgccgcgcgccgtggtgcacgccaacctcgccgacgtggcccgcgccctgaggcccggcgggatcgtggtcttcaccatccacggccagggctcggccgagcaggccgagcgctacgagcagttctggctcgacaagccggcggtgctcgccgccctggcgcgcgagggctactactacgcccgctacccctactacacggccgattacggcctgacctggttcagccgcgcagccgtcgaggcgctcgtcgccgaggcggcgccggacctggagcccctctcctaccgggcgatgcagctcgacgggcaccaggacgtgttcgtctaccggaagcgctga

SEQ ID NO: 8514 - DNA, 1278 bp, Methylobacterium sp.
atgcgcgggctcgcggccggcctcgtcggcctcggcctcgcgaccggttgggccgggccggccgccgcgttccagccgcccgcgaccgtcgaggccgcgcaggccggcttcgacgccgcgcggctcgaggcgatcgccgcgttcgtgcagcgggacgtggcggcggggaagatccccggcatggtgctgctcgtgatgcgggacggccgccccgtgctcgcccgagccttcggcgagcagacgcccggcacgccgatgcgcacggatagcatccaccgcatcgcctcgaccacgaagctcttcgtgacgacggccgccatgcgcctctacgagcagggccgtttcaagctctcggacccggtcgcgacctacctgccggaactcgcggcgctgacggtctatgccggcgccgagagcgccaccgagggagacgccccgccgccggtggcgccccagcgcgcgccgacgatccacgacctgatgcgccacacagcgggcttcacctactggtggatcggcccggccaatgccgtgcgccgcaaccagcgcgcgcagaacctcgaagggctctacgacctcaccggcgaggagatgctggggaagctcgcgcagcagcccctgctctaccagccgggctcgaccttcgagtactccatcgccaccgacgtgctcggccacctgctggagcggctggagggcaagccgctcgaccggatcgtggccgagcaggtgctggagccgctgggcctgtgggacacggtctggcaggtggacgacgcccgcgccgcgcgcctcgccgagccctcgcagcggacgcgggagacggacccgctggcctgggtctacacctggctcgacctgcgcaaggcgccgaagcgcttctcgggcggtgccggtctcgcctcgacggcgggcgatgtcgggcgccttctccagatgctggccaatggcggcgcgatcgacggggtgcggctcctggcgtcgcagaccgtgcgcctgatgctgcacagcgaccacctcgccgggatcaaggggccgcgcaacaacgtcgacccgggctacggctggagcctcgtgaacccggtccgcctcggctcggggccgcacgccacgccgggcgcggccggcgacgtctactggggcggcatcaccggcccgcgctacatgatcgacccggccgagcggctcgtggtggtggcgctgttccaggcgccgagcctgcgcggccactactacgcgatcctgcggcagatggtgtacggcgcgatgacgaagtga

SEQ ID NO: 8515 - DNA, 450 bp, Methylobacterium sp.
atgcctgaagcggacatcacccgcgctcagttcttcgccgacgacctgctccgctgggagacccgcggacccggcgacacggccaacgccatgcggcgtgtcgcgcagcgcgcggccctcccgttctcgaagctctgggcgctccgctaccggccgcccaaggccgtcgcctctcacgtcctcgcggctctccaggccgcccacgctcgcgaagtcgagcggcagctgaggaagctcgcccatgaagtcgagaccaccgcgcgcatcgccccgccttcggaccctgctgtggctgcggctgcggctgctctgcacgcggctcagggcgagggcgagggcgtggcgcgaccggatgtggaagcgcctcgagcggcgcccgcgacccggtcgcgaccgctgaaggatcaccgcgacctgccgctgtggcgggcgctggacgagggagagtga

SEQ ID NO: 8516 - DNA, 300 bp, Methylobacterium sp.
gtgagcgagcagaaccacttcgccgtccgcctggcgctggccggcttccccggcccctatgcggtgcgcgcctcttccgagggcgtgatcgtcgaccgcgacggccgccccttcgagcaggtcctcccggtgttcgacagcaccggagaccggcgcgccaccgccgtcatcgcctgcatcgccctgaaccggctctgcggcttcccggacaccgcaatcgtgcaaggggcggaccacgtcgaggtcgccgccgtcgtgagcctgcagcagaccggccgcccggccgccgcggcggagtga

SEQ ID NO: 8517 - DNA, 186 bp, Methylobacterium sp.
atgagcgccctcgcgacctaccgcatctccggctccggcggcctcctccgcatcgtcacctgccggccggaggagctgatgcgcctgatgcaccgcatcgggatcgcctcctacacggccgaggtcacgacccgccccgcctaccgcgagatgattgacaccctgcgctgggaggagatgctgtga

SEQ ID NO: 8518 - DNA, 300 bp, Methylobacterium sp.
atggcgcgcttcatcgcgatcgagcgagagaccggacgcgtttacggcgatacgggccgctttggctcggtcggcaacgtggtctcgccggcggatgcggtcagtctgttcgatcgtcaggtcgggcgcgccatgcgcggcttcggctacgtcaaggcggacagtgatgccgcccagtacgatgtctatgagatccgcgcgggcgattccggccaagcctctgccaccgatgcggacgcgcgcgcggcggttcgtgagcacggcgcgctggccgcctctctggtaacctacaacacctga

SEQ ID NO: 8519 - DNA, 2241 bp, Methylobacterium sp.
atgtccacgcccgccgcctccccgaaagcccgcctcgccatcatcggctgcggcgccgtggtggaccaccacctcctgcccgccctgaagcggcagggctgggccccgagcgttctcgtcgaccgctcgcccgagcgcctcgcgctgctcgccggccgggccgggcggcggcgcgccgacatcgcgaccgccgccgactggcgcgaggtcgccgaccgcttcgacgccgcgctggtcgccacgccccacaccacccacggcccgatcgggctcgccctgctggaggccggcaagcacgtcttcatggagaagcccctcgccaccacgggcgtggagggcgaggcgatgatcgccgccgcctcgcgcaagggcctcgtgctcgcggtcggcctgctgcggcgcaacctcaccatcgccgcctggaccagggccctggtcgaatccggcacgatcggcacgatccgacgggtcgacgcgcgcgagggcttcgtcttcaactgggcgacgagctcggacgcgctgctgcgccgcgacctctcgggcggcggcgtgctgatggacacgggcgcccacaccctcgacatcctgggccactggttcggcccgatgacgccgacgcgctaccgcgacgacggggccagcggcgtcgaagccgactgcgtcgccgaattcctgctcgacggcggcggcgaggtgcgggtcgagctgagccgcacccgcaacctcgccaacaccgcccggatcgagggcacgcacggccatgtcgaggtcgcgctctaccgcaacgaggtggtggcgggctcccccaacgcgctcgccttcacgcatgcgggggtgagcggcaccgcgatgaagccgcagctcttccccgcgctcttcgacgccgagatgcgcgacttccgcgatgcggtggcaggcgggcgcgcgcccctggtcggcggcgaggagggtctcgcctcggtgcggcggatcgagggctgctacgcgctgcgcgagccgctggagcagccctgggacgccgcccacgcggcgctcgtcgacggcctcgcgcccggtgcccgcgtcgtcgtgacgggtgcgagcggcttcatcggcggccgtctggtcgagcggctggtgcgcgccggcatcgacgtcacctgcatcatccgcgagatcggcagcgcgacgcgtctcgcccgcctgccggtgcggctggtcaaggccgacctcaccgatcccgccgcgatcggcgcggcgctccgcggggccgacacggtgttccactgcgcctacgatccgcgctcgcgccggcagaacctggagggcgcgcgcgtgctcatcggggccgccgccgacgcgaaggtgcgccgcctcgtccatgtcagcaccttctcggtctacgagcccttcccgccgacgccgctgaccgaggagacccgcgacggggaccgcgcctggatctacgtgaaggacaagctcgacatcgagggccagatgctcgccgccgcccgcgagggccgggtcccgacggccgtggtgcagccgaccatcgtgtacggccccttctgcaagccctggacgaacgcgccggccgaggagctgatccacggcgaggtggttctgccggacggcggcgccggccggtgcagcgcggtcttcgtggacgacctcgtggacggcatgctgctggccgccacccgggacgcggcggtgggcgagcgcttcatcctgtcggggcccgacacggtgagctggggcacgttcttcagcgagttcgcccgcgcgctcggcgtgccgggcccgacctcctggccgctggcggaggtctcgaagcagaaccagggcttcgtgcgcgacgtgaagctggtgctgcgcaacccgaagcgcatcgtccagatcatcgtgcgctggcccccggcgcgctcggccctccaggcggggctcgacgcgctgcccaagcccctgcgggcgctcgtcgaccgctactatttcggcagcggcggtccggtcttcggcgcgctcatcgtgccggacccgcagaagaccgccctctacaccacgcgggcgaccgccgagatcggcaaggcgcggcggctgctcggctacgcgccgcgcttcgccttcgccgacgggatgcgcgagacgacgccctacctcgtctgggcctatgccgacctcgtgcgggcggcgcggcgcgcccgcggcacctccgcaccgcccgccgccccggtggggacgccggtcgcggacgcgcgctga

SEQ ID NO: 8520 - DNA, 114 bp, Methylobacterium sp.
ttgcgcgtcgatcggcagggggccgcgcggatcggccggcagatcgtggatctggcggtgctggcggccggcgggatcggtctcgccctgccgctgatcctgccgctgggctga

SEQ ID NO: 8521 - DNA, 267 bp, Methylobacterium sp.
atgacttcagagcttcgcgccaccctgctcgcggccacgctcctcgtcggcctctgcgccgccgccggggcggccgagcggcccgacggcacggccgccccggcccggggcagcggcgcgaccggctccacgacgagcgtcggcgcgggcggcctcaccggttccggcgcgaccgaggacgggacccgccgcaccggcggcaaggcgcccgccccggccaccgagcggggcggctcgaccgccccggccgccggcacgacgcgctga

SEQ ID NO: 8522 - DNA, 741 bp, Methylobacterium sp.
gtgtccgtgatcgattacccgctcaatcgcttcaccgacatggccagcctgtcggacgacgagcagaagcggttgcgcagcctcggcgacgcaccggtcccctacaagcgcgccgcgaccatccgggccgagggcgatcccgccccctgcatctacctgatgctggagggatgggtgctggcatcgatggtcctgccctcgggcggccggcaggtgacgaaggtccacctgccgggcgacatcctcgggacgcccagcatggcgctggccgccgccgcggagacgctcaccgccctgacggattgcgtggtcgccccggttcccctgacgcgcctgcgcgacctgttcgtcacccatccgcggctcgccgcgctgttcctgatggccgttcaggtcgagcggatcgccctgatggatgccatggcggcgatgggcaagaccgatgcgcgcgagcagatcatcggcttcctcctcgatctgcacgacaggctggcgcggctcggcaaagcgtcggacggcaccttcgagctcccgatgacccaggagcagatcggcgagaagctcggcatgacctccgtccatctcaaccgctccctgcgggtgctcgatgccgaggggctcctcacccgcacggggcggctcgtccggctgaacgacatcgagaccctgcgcggcctgtcgcagctgccgcggcggcagctccgaaccgatccggaatggctgcccgtgagccagggatag

SEQ ID NO: 8523 - DNA, 1548 bp, Methylobacterium sp.
atgaccctgctgggcgatgacatcgccgatttgcagcgtctcctgtccgaggcgcaggccaaggcgaacgccgccgacccgcacgcgctggtacgcgccctggagcaggcccagcagcgcctcgatcgcgcgcgcggcgaggctgaactgcgcgtcgtcgatgagcgcctgcagctggccgagaaagccttcctgcgtgcgtaccatgcccaacgcgccgctgagcgtgcggccggcaagcacctgagcaacggcaggaacctgaatggcgagagcatcggcaacctggccatggccatggtcggcagcgatgcagaccgcgaagggctctacaaggacctgatcggccgcaccggggcagacgccctgtccgagaaggagcgtgcgcggctggaaggcgccaagaagctaggcggcgacgacttcaaggaggtgttggccgagctggctgccagccgcggccaggaggccacccagggcaaggacatccgcgacagccgggccctgctcgacaacatcaagaccgacgtcgcgagcaagctgatcccggcggtgcagtccatgcgcgacggcatcatcttcatggccggccagggcaagctgaccgcccgggagatctcccagcgtgtcgccaaggccgagtacgatgagcgggtcggctcggtgcgtgactcctacaaggaccggatcaccgcccaggacaacatcatcgcgtcgatcgtcggcgtcgagggcatggggctgctgtccatgacggacgagcagaaggcccagctcgaagcggcggcgaaggagaaactgcggctggagcgcgagcgcgacaagaagctcaaggagatgtccggcgcctacgaaaccaccaagaagaacatcgacgctgccgcagcagcggccacccaggtcgaggagcagcgtgcgcgccaggttgaggtgtcgcgctcgaggccaggtggcaacctccccggcatcaccccgatcgctgtaggtggtactggcgccagcgacctgtttgcgggcgtgatcgggcaggagtcgggcggacggcactgcaacgccgacggcagccttgtcacttcgccgaagggcgcacgcggcatctcacagctgatgcccggcaccatgcgcgatccggggttcggtgtgcgacctgctcaggatgacagcagggaagaaaacctgcgggtcgggcgtgagtacctggagaagctgcaacaggagttcggcggtgaccgggagaaggcgctggccgcctacaatgccgggcatgcacgggtgaaaaaggcggtcgcgaagcatggcgaggcctggcttcagcatatgcccgctgagacccgccactacgtccccaccatcctgggccgcgtggattcccagcagctgccggccagccatcgcgaattggcggccagcgccggccaggctgtgaccgtcaacgtcgaaccgctgacggtggtgcaccagaacgagcgcggccaggagatccagcagccgcagaagctcaacgtcacggtttcacaggcgaagccgtttaacggccagacgcgatag

SEQ ID NO: 8524 - DNA, 384 bp, Methylobacterium sp.
atgggcgggaagcggctgcaccctgacgccgtgccaacgcccggcccctggctggtgcgcggcaaagccgacgcggatgccacgcccacggcggcgatgctcggcatcgagcccgcagcgaacgatcagccgggcggctggccgtacctgatccggcaggatcggctgatcgagcccggcgcttgcccgctacacctcgccaccggcatccagcgcctcgccgacgccaagctgatggctgccgcgcccgaccttgctgagatcctgctgcgacttgtgacggcgcccgacctgcgccgggccgacctcgacccgcacacgcaggaggtgaggacgcgcgcctgggcggtgctggtgcgggtcgcgccgcacctagagctatga

SEQ ID NO: 8525 - DNA, 2409 bp, Methylobacterium sp.
atgagcctcgtcggcctggggctcgtgcttgccccgcctgaggccagggccatcgagacgccgtacaacgccatcgagggcagtgccctggccattgccgcctacgaggcgagcaaggagcaatgcggctattccgagcgcctcggcaaagccatggccgacctcgacgcgttcttcgcccggcgccatggctatgcctggacccgcgcgaagcagtccggccccgacatgctgatccgtatgcgcaacgtcggccgcgtgctcggggcgcagtccgactgcgttatctacggcaaggccatcggctacgtgcttccggcctacctcaacgccgtcgatatggatcccctggtcatggctgaactcagcacgttgctgagcggcaaggatgctgccccgggcaatcgcggggccgagccggtaccagcacccgccccgggcagtgcggccgagacggtcgcggagctgaagcgccagaacccgaacatgaaccggagcgcagaacctgagggcttccgatccagcctgtcgcgggtcggcccgaaccgggatcgcggtggtgcggtcgcgcaggcaccagctcagcagccgagcggcgtggtcccgccgccgcccggcccgccaccgcaggggcagccaacagcctcggcagccgagcgcacggcactgccgccgcagggggcacggccgggcgaggccccaaccgtcgcgcctcaaggcagcactggggttgtcgcgaacgccagtcgagcgatcccgctggcttcggcggcaggcgccgcgacctgcccgatcaacaccgaatgccgccttgcggagccgacctttgcctgcaacgtcgatgacgccacgcgccttgcccaggctgggccgggcgcggggacgcaggctgggctcgcggcggtccagggcgggcggtgcgagaccgtcgcagcaggtcgcctgcttcgcttcgaggccacagcgtcgccacaggtcgtctacgccacggaccggggcgtccatgtcggttacctgccagtcggcatcttcgccccagcaggcacggcggatacgacgacctgtcgagccccgggcttctgcgccatacgtcccggcccccaggttcaggcatgtccgaccgccgagaacctggccctgtcgacccctgaggcacgcacggctgccaaatgcgtgaccctcagccccgggcaggtcggcgaggtggtgtcggtggccgcgggcatggggccgattgccgtcgggttcggcggcaacccaccgttcctggccacctactacctcggtcgcgccgacctcgtcggcattgaggttcaacccacacccaccccagcctcgcgcggctggtgccgtccgggcgactggtgcctgatcgacgcgcccgcgttgttctgccgtgagaaggacgcctacgagcgggtggcggcctcgccgctgggcgaagcgcggcgcgcagccatcatggctgaatcgagctgtcgtgtgctcatccgcggcaacccgatgaagccgagcgcgctgcccgtgccgggcgaggggcgcaagctgatcgaggtcgaacacccggtgtacaggaccggctggacgaatgcggccgccttcaaggtcgtcgcctacgcacccccgatccgctacacggcgcgcctgtcggacattcgggtgagcgcgggccgtaccccagcccttacggcagtcagcctgagcgcccagggtacccgtgatgcgtcaggcacgttccgcacgggcgcgaaggaacgggcggagttctgcaaaggctaccagagtgaggacgacccaagcgccctgcgcgcgtgcttggccgagccggacacgagcctgacggttgtggccaactgcgaggcgaagcaggtgaagctctacggcaccctgtatgccctcgaggagcgaccgcacgacgctgaccccgacatccacgtcgatgcaagccgccagtggctgttccgcgataaggcaagccgagagtggctggatggtacgaccgcctccgacgaggtgagcgtggccacggccttcaacgcgctatgccccggcaccaaccccgacgctgccttcggcattgcctatcgtgatccaagtgcccggtatccccgagagctacacgggcgctggttcaatgatcggcgtgcgtgccttgacccgaggcgcaacgaacctgactatgacgattatagctacacggagatatccgctgaaacgcagcgaagtcgaggcagtgaggatcgagtcaatgccgtgcggcgagttgggcagggtgcttgggtgattgacgagagtagcaaatctcaggaggatacagatacattttcaacgagcgcatacgctttgacccgtaacggcttaaggctgatgatgaacggaaacacgagcgaatggtttcgatgccaatga

SEQ ID NO: 8526 - DNA, 168 bp, Methylobacterium sp.
atgacggcccccgcgccttcggacgggcgcccggaccggccgcgcctgccggcgcgcgcgtggctgctgctgatcctcggtctggtgctggcgacgtatccggcgtggcggctcctcgtgttcgagccggatccgccgctcgacgcattgctgcgcttgcgctgctga

SEQ ID NO: 8527 - DNA, 204 bp, Methylobacterium sp.
atggaggtggccgtgctgatcttcgcccttctgtttgccgccctcggcatcctcggcgcgctcgtcggcctcggcgagctgggccatccggtcggcgcccacggcgtgcagagctacggctggggtctcaccgtcaacgcgatcgcgctggcggtgtatttcctgttcatgtggacccagcgctaccacggccgccggacctga

SEQ ID NO: 8528 - DNA, 231 bp, Methylobacterium sp.
atgccacgatatttcttcgacacctatgacggcacggtggttcacgatgacgagggccgcgtcatgccggatcttaacagcgcgcggctggaggcacggcatctcttgcgggatctcctcttggacgccgcgcccgaagccgacgtgagccggttccgcgccgacatccgcgacgagtcagggcgcgtcgtcgttacggcgaccctcacgctagcctacgcggacacctga

SEQ ID NO: 8529 - DNA, 207 bp, Methylobacterium sp.
atggtcgtcgcccacctgttccgaatcctcagcgcggtcctgttcgccgcggcgctcgtcatcgcgccgctcgcgaacccgctcctcgtctcggcctgcctgatcctcggcggcaccctcgcggcctggcgcggcgccgccgatctcggtctcctgacgggcgccctcggcctcgcccggtccgcggcggtccgccaccgggcctga

SEQ ID NO: 8530 - DNA, 270 bp, Methylobacterium sp.
atgccgatgcgcctgtccggagaggagccgcgcctggacgagggcgcggcggtctgcctgaccttcacgatcacggacggtcacatcctggtcccctgccgggtggggcacgcggcgcttcaggacgccttcggcccgccgggcggcaacgccatgacgatcttccgcgcgcatcgggacgcggtggtcgacggcgcgatccgcaggtacgagcggagcggtgccgagggcggggtcgttacgctcgcggcagccgacctcaccgcctga

SEQ ID NO: 8531 - DNA, 153 bp, Methylobacterium sp.
atgaaccccctcgccatcgccgtcatgctcgggatcctggtcgcctgggcggggctgctcgccgccgcgctctatctcggcaacccgctcctgctcgcgatcttcgccgtcgtctcggtggcgatgttcatccgctgggacgtgttcggctga

SEQ ID NO: 8532 - DNA, 375 bp, Methylobacterium sp.
atgacgacgctactgcgcggcctcgcgctgcccgcactcctcgccgctctcctcgcggcgccgctcgcccggccggccgcggccgcgagcaacaccacggtcggcgtcggctcgggcgccgtggccggtgccctcgtgggcggcccaatcggcgccgtcgccggggcgatcgtcggtggcgtggtgggcgcctcgaccgagcgcccgcgccgctaccgccgggtgcgcgcccgccgcagcgccctgccggtccggccggtggcacagcgcgcggcaccggcggcgccccggggcgcgctgacgccgaccgtctcggccgagcccgcgcccgccagcaccggctcgaccgggcggcgctggaccgatccgcgctga

SEQ ID NO: 8533 - DNA, 2616 bp, Methylobacterium sp.
atgaatcccgagctacacctgacccgcgacgacgtccggaacttctacaccctgtgtctcggtcggccggtcgagagcgaggcggcggccgaggggcgccgacaccagacagcgctcgaatgcgcttcgagcctcctgctctcgggcgagttcgaggcggagatcctgcgcccggtgctcaacggacgggcactgaagcacgccgggatcagcgaccgcaccttccggaagatccgcgcctgggcggcgcagcacggccccgccgtcttcggccaggtggtggaggatcccgcagcgtggcacaagaagtggcacagcctcctgcgcggcctcgtcaccagcgagcccgtgcgcgcagacttcgccgcgcggtacgccgagcacgaagcgttctgcgaggctcttgccgaggctgcggcacacaacgaggcgatcgtcgccggcgtcgaggagatcaatgccggtcgctgccgcggctacttcgtcgacgtgaccgaccgcagccgccacttcgtgctccagctccggatcaacggaaagacggtggccggcgtcccggtcctggagttccgcaaggagctgcaggagaagtatggcggctccggccatgacggcttcgacatccgcttcgacgacatccccgagattctcgggctcggcggcggcacagtcgatctcatcgagccgcgcaccggcttcgtacttctggaaaaacaccacgtcaccttctcgaacgcagcggcggccgagcagaacgaccggactatcgagaccctgcggggttaccgcagctacgtcgacgggctgatcgacgccctcgacggcaatcgtccgcaatcggtgacgagtgtcgccggctacggccgcaaccgaatcttcgtccggccgcccgcggctccgccgacctcgagccgagtcgcggtcgtgatcgatacgcgcggcgtcgagccgatcgaggattcgaccgcgatcctgcgggaggatctggcagccttgcgcgcgcagacgcatcagccggttgcgatccacctgctgcaggacgctgcgcaggtcggtgccggggctgaggcggaacggggcgcgatgagccgcttcgacagcgtggctcgcctccgggagacgctgcgcgcgcagaccgatctcgtcgtccacctccggccgggcgagcgcctggaaccggacgcgatcgcttggctcgcctatgcggccgaacgcccgggcgcgcatgtgacgtacgccgacggcgaggtggagcgcgcccgccccctctccggcatcgcgctggacccgatcttccgcagcgccctcgacatcgacctgctgctgacgtccgacacctacgacacgccgctatgcctgggcgtgtcctgcctcgacacggccgacctctcggaggaggcggatttccgtcgcggcgtgctgctcggcgccctcgagcggcacgggcgctgcgccttccggcacgtgccgctggtcctctcccgcggacgcggcggtcggaacgccgaggcagccgcgcgcgcgcgcgccaccgttcaggcccatctcgatcgggtcgggtcaggagcggttctggagccgcacgtggatgccctcgcggccccgctttccgagcgctcgcgggtgcgctggccggtacaggcgcgccggccgatcagcctgatcgtgccgacccgcgattccatcgacatggtgctcgcgctggtctcgagcctcaaggagtgcacgcgctacctcagcctcctgcgcgtccacgtcatctccaacaacagcgtcgcgccccagaccgagcgcgccctggacgttctggcatccgatgagatcgtcaggatctcgacgttcgaggggccgttcaactgggcgggcatcaacgatgcggcgatccgcgccgacgactgcgccgagatcgccgtctgcctgaacaacgacatgatctgccggacccaagggtgggacgagttgctgcgggcgcagctcgcgcgcccggacgtcgatgtcgtcggcggtcggcttctctacgcgaacggcatgctgcagcacgcgggcgtcgccatgaccggcggttggatgcacgaggccatgggcgacgcacccggtcacggtctctacaacgaccgcacgcgggtggcgcacgaatgcgctgccgtcaccggcgccttcatggcgttcgagcggcagttctatctcgacagcggtggtttcgacgcggcgaccttcccgatcacccacaacgacgtcgatttctgcctgcgtgccgagaagcgcggggcgcgcatcctctacgatccggagcaggtctggattcacttcgaatccgtcacccgcgggctcgacagtctcgacacggccaagactgagatgctgcacgagtctcatcaggccctgctgagccggcttccgcggccggattatctcgacctctcggtcaatccgcacttcgtccgcgatgcgcggcccttcacagcggtcgcgtggccgcggcgtgacaccgttctgtcgtggatcgaccagcagcagacccgcaacgccgcaccgtcgattgcgggcatcccggcggcggacggcgcaagggaccggccggacgcgaccgtggagacgcgcgcgcggaccgcctga

SEQ ID NO: 8534 - DNA, 1200 bp, Methylobacterium sp.
gtgccgatgcgcgcgccgctcgcctgggtcgagatcgccaagggcctgtgcatcggcctcgtggtgctgatgcacgccaccctcggcctggaggaggccctgggcgagcgcggctacgcccacgcgatggccgatttcgcgcagcccttccggatgccgaccttcttcgcgctctcgggcctgttcctcgggcgcgctctggcttcgggctggcgccccttcctcgagcggcgggtgttccactacctgtacttctacacgctctggctgctgatccaggaggtgatccgcttcccgcatctcggcggcggcacgctcgccggcaccctgaaccacgtcgcgtggtcctatgtcgagccgttctcgaccctgtggtttctctacgcgctcgccctgttcgcgctggtgacgcggctcgtcgagcgcgtggccgcccccgcggtgctgggcgtcgcgctcgggcttgccgggagcgacgtcacgaccggctggcacatcctcgacgtcgcctgcgacacctacgtcttcttctacggcggctaccggctcgccccacagatcctcgccttcggggctcggatgcgcgcccgcccggccctcgccgccgcggtgacggcgggctggctcctcgtcaacgcggtcctgatcttcaccgtcgtcccgaccctcggccacaccatggtcgccgaagccccgctcgtcgcgctgcccctcggcgtcctcggcgtgttcggggtgatcgcgctcgcgacgctgctggagcgcagcgtcgccgggccggcgctcgcctatgcgggctaccggtccatcgtgatctacctcgcggccttcgcgccggtcgccgccttgcgcgcgctgatggtgcgctacggggtgcccttcgacgtgggcaccgcgagcctcgcgctcacggctgccggcatcctgctgccgctcgccctggagcgcgcgctgcggggcacgccggccgcctgcctgttcgtgcggccctcggcaggcctgcgcgcgcccgccacgatcctgcggcgcggccggtcgctgctcgacaccgccgccgtggcctcggcggcctccgtcgcctccgtggcggaggccgggacctccgtcgcgtcggcgctggccgcgccgcccgttcaccgtggcgcgcttgttcccgcaggcgcgccgctgccgctggccctcggcccgcgggaatcgtaa

SEQ ID NO: 8535 - DNA, 402 bp, Methylobacterium sp.
atgaaggccggcgagagggccggcctgagcgcgccggccaggaccgtcatcgcccacgccgcctacctcaccgtcgccggcctcgccttcctgctcgcccccgagggcgtggcgcggctgctcggcgtgacggccgagccctaccttgtccggatcatcgggctcctgatgctctgcttcgccgcctattacgggcagttcgcgcggcacgaggaccggccgctgatcggcgcgagcgtcgcggtccgggtctgcctcgccgcggccttcgtcctcttggtgatggccgacctcgccccgatgccgctcctcgccttcgcgctggtggatcttatcggggcggccgcgacggccctcgccctgcggggccgctcgaccacggggccgttgccggcccattga

SEQ ID NO: 8536 - DNA, 129 bp, Methylobacterium sp.
atgcacgccctcaccgcccagctcctcgtcatggtcgccgccgtcatcgccggcgtgctcgtggccgagatgatcgagtccccggtccgtagctgggcgagccgcctcgcagccggccggcgccgctga

SEQ ID NO: 8537 - DNA, 222 bp, Methylobacterium sp.
atgcagcgtcggagccggacgccctacagcgcgggctttcgctccgagaccgcgtcggaacgcgcgcggcacgctgtcctgaaccgcttctcctacagcggcgggttcgacggctacgagggccgcatgacgtgcccgccctcgtggcggacctccgcgttccgcgacgatcaggatcgcggcgcgcgttccgccgcgcgcgacggatcccggaacggctag

SEQ ID NO: 8538 - DNA, 153 bp, Methylobacterium sp.
atgatcatgatcgtggggcttgtcggcatgccgatcctgctgatggcggtgacgctcgcggcggacgcgatgctgaagccctatccgagcaaggacgacgtctggcgcctgccgaaggtctcctccctgcgcgcgatgaccttccacccctga

SEQ ID NO: 8539 - DNA, 138 bp, Methylobacterium sp.
atgaccctcctcgccgccctcgccctcctccccttcgccgccgccgtccacgtctcgctcgtgatcgcgctggccaagaccttcgacggcgatgcgcagaataccggcacggccggtgcggtcccgacgctcgcctga

SEQ ID NO: 8540 - DNA, 189 bp, Methylobacterium sp.
atgccggacggatccgacacgccgagacccgacgagacgaccgagccggccggcgatccgccggcaccgccccgggcgcccgagggcgatccgccgcccgagccggccgcgccgcctgcgaaaggaggccgctcggacgaactcacgaaggcgggcgacgcgggcgacaagctcggcgacttcgcctga

SEQ ID NO: 8541 - DNA, 339 bp, Methylobacterium sp.
atggaaccgacgccgagttccgccatcgcggagatcgatcgcttcatcgaggagagccgccagctcatcgcccgcgcggaggcctgccgacagagcctgatcgcgctgggtgcccgggaggggcacctgctcatggccacccgaaccatcacggcgatgggccgcatccaggccacgctgctgcggcagcgcgcgatgctcccgcagcgcgcgatgctcccggagggcgcggccccgccggaggccgagcgcgtgccggccgtcgtcgtggtcgcgcgcgccgcccgcccctggtgggcgctggtcgggcgccggaaggccgaggcccggctgtcctga

SEQ ID NO: 8542 - DNA, 201 bp, Methylobacterium sp.
atgtcgaggcctgctctctttctcgccgccttcgcgctcgcgacggccgcgttctggctgacgatcctgaccgatccgccgacctcggaggccgcgccgaaggacctcgccgccgacgccgagccggtatccgcctccgccctgcgggtccggttcgtgcccgaggaactgtgcggccgcttcggcgactgcccgcgctga

SEQ ID NO: 8543 - DNA, 360 bp, Methylobacterium sp.
atgcgtcacatgatcctcggcgccgccctcgcgctgctcctgcccgtcgccgcccaggcagagggcgatgctgcggccggcgagaaggcgttcgcgccgtgcaaggcctgccacaacttcgagaagaacggcgtgggcccggacctgaagggcgtcgtcggccgcaaggcgggcacctatgagggctacaactactcggccgccctgaagaactcgggcctgacctgggacgaggccaacctcaaggagtggctgaaggacccgaagggcaaggtgccgggcaacaagatggtctatccgggcctcaaggacgagaagaagctcgacgacgtgatcgcctacctcaagtccaagacctga

SEQ ID NO: 8544 - DNA, 1140 bp, Methylobacterium sp.
gtggagaaatccgtgtcagatccgggccggcgccccgacctcgaatggctgaaggcgctggcggcgctcgaggtggtggtgtgccactccgatctcgcggtgaagcacttctcgggatcgctgatcgcccggtcgtggtacctgccgctgagcgggatcggggtcgaggtgttcttcgtcgtctccggctatctcatctgcctccgggcgcccgcctacgcgaacgcgctgtccttcctgcgcgcccgcctcctcaggctcatgccgctctacgccctgttcacggggctcgcggtcgcggcgcgcctgatcaatccggcctgggcctggaaccgctgggacgtctcggccggcaccatcatcggttccttcctgatcctgccgcagccgcactaccccatcgtgggcgtcggctggtcgctggagcacgaggtcatcttctacgcgctggtggccctgctgatcctggcgacgcggctcgcgggggaagcgcccgtctggttcggcctcgcgctgttcggactgggctggtgcggcgcgctcgtcggcatcgccccgagcgacgccgcctggtacctgcaccccgtcagcgtgctgatgacgggcttcgcggcgggctggctctaccgctgccacgaggtggacggacgggtcggcgtggcctggctcctcatggcctgcctcgccgtgaccgtcaccctgagcctcggcaccgacccggccaacaccgagcgcagcctccggctcacgggcgcctccgccctcgtgatcctgttcgtcgcgctccgcgacacgatcctgcggctgcccttcgccgaccggatcctgttcccgctggggctggcgacctacagcatctacctctcgcactggttcacgatgtcggcgctcggcaaggccgtcggacggctccgcctgcccgaatccgcgcagttgccggtgcgcctcgccgtcatcgcggtcgcggtcggggtcggcctcctcgtctaccggctgctcgaacggcccctcgaccgctggctgcgcgccggcgtgccgatcggggaggccttccgccagcccttccggcgtcggcgcgcgatggggccggagcccccgccggaggcgggcatcgctcatcccatcggcgcccacgagtaa

SEQ ID NO: 8545 - DNA, 351 bp, Methylobacterium sp.
atgaccctgcgcccgttcccgaccctcgccgtcctcctcgccctcgtcggcccggcggccgcgcaggcgcccaagccgcccgcaccgccgacgctggagcagatcgagcgcctggaagccggcccgcggcggcgcgacttctatctgagcccggaggcggccgaatcggcgcgcgccgccgaggccaagatggaggcgatgcagcggaagatggacgcccgcgtccgccgcgcgacccgcagcatctgcgagggctgcgccggtcaggccgcgcgccgccgcgacgcctccgccgcaccgcgcgacgacgtgccgggcatggacgatcctgcccaggcgccgctggactga

SEQ ID NO: 8546 - DNA, 171 bp, Methylobacterium sp.
atgtcccccctcccccgtctcgctctcgcggcgctcgccgccgcggcactcgccgcgtgctcccaggcgcccgcggcaccaggccccgagctcagcccgccgcccccgcgcgtcgatgccaagacgcagctcgaatacggcggcccgccgccccgcggcccgcgctactga

SEQ ID NO: 8547 - DNA, 231 bp, Methylobacterium sp.
atgccgaaacccagggacggccgccgactgccggatcgccggtccggccgatcttgcgaacggggcgagagaccgctggccatcgcggccgaccgctgcatcgcggcctacgaggccgtgctcgaactggatgacccggatctgcgccgcctctccgagatgctgctgctcgccgtcggcaagcgcctcgcgcgcgaggacggcggcgcgctgcgacacctgatgaactga

SEQ ID NO: 8548 - DNA, 1005 bp, Methylobacterium sp.
atgacgaagccgatcgacctcgcggacgtgcgcgcgcgcctcgccgccccgatcctcgggcgggcgcggacggaccccttcacgctcgacgtgcaccaccgccacccgcgcatcgccgcgatcaccttcgcgccggggcagccgatcggctacgcgctcgccgcgcactacccggactggaccgaccgcacggcgctcgccaaccggctcgccgcgatgcggctgttcttcggccggctccgggacctggagccggacctcgcgggctcctgcgacctctggctcgccgacatcccggaggcgccggggctcgccttctcgggggcggggaccgcgaacatcctcgtgcccgacgccgagttcgtcgccgccgagggctaccgcgccttccgcgagcgggtcgaggccggcttcgtcgactggggcgcgcgcgacccggccctgttctggcgcgggaccatgctgggggacccgaggaagcgcctgccgagctggcgggagctgcagcgcgcccgcctctgcctcgccgccgcggcgccgggggagggcgtgccgctcgacgcgaagttcgtcggcctgccgggcgacgccgaccgggacgcgccgggccggcgcgaggcggaagggctcggcctcgtggccgggcgggtgccgctcgaggccttcatgggctaccggcacgccgtcgacatcgacggcaactcctccgcctggatggggctgttcaccaagctcctgatgggctgcaccgtggtgaaggtggattcgcccctgggccaccggcaatggtactacgaccggctcgtgccctggatccacctcgtgcccgtctcggccgatctccacgacctcgcgggcgtgcgcgcctggctcgctcgcgaaccgggggccgccgaggccgtcgcggcgcggggccgggcgctcgccgccgccatcaccctcgatcaggcgttgctggacgtcgctccgcgcgtgatcgcccatatccgagccccgaaggcctga

SEQ ID NO: 8549 - DNA, 1155 bp, Methylobacterium sp.
gtggcgctgctcgcctgggagctcggggccgggttcggccacgcgcggcgcctgctcaccgccgcgcgcgggctgatcgcggcgggcttccgggtccgcgtctgccagcgcgagctctgggcctgcgccgaggagtttttggacctgggcgttccgaattttcaggcgccgcaccaccgctcgcagctgccgccgggcaccgccttccgcgcgcggggctacgccgacatgatggcgatcgccggctaccagagcgtcgaggggctcctgcccaccgtgctcggctgggacgcgctgatcgacgcggtccagccggacgtcatcgtcgccgactacgcgccgatgctggcgctcgccgcccacggccgggtgcctctggtcgcgatcggcgacgggttcgtgctgccgccgacccatcgcgaccgtttcccggtgctgcgcgagggcacccgcatggccgacgaggcgaccatggcgagacacgcgggtttggtgctggtatcccgacggcaaacagcgggtttctcgctgcccgaactcatcggcggacaggcccgcgtggtctgcacctacccggagagcgacgtctatgcggggcagcgcgagacccccgccgcggggcccctgacggtgccgggggggccgctggcgccggcggcgggggggacggtcttcttctacctcgcggccgattttccccataccgccaaactcttacaggcgctctgcgattcccggctgccggccgagggttttgtccgcgacgcgcccgaatcgctccgcgcggcgctgcgcgccaacggaatccgcctgcacgaccggccgccgccgctttccgacgcgctggcccgggccgggctcgtggtgcatcacggcggcatcggcacgatcgaatcctgcctcgccgccggccgcccgcagctcctcctgccgcgccatttcgagcagacgctgaacgcggaagtgcttgtggctcaaggggttgcgcggcgcctgccggtgcccttcaccctcgccgaggcccgcgcgcagctcgccgagtcggcccattcgcccgacctcccggcccgcgcgcacgcgctcgccgacgccctcgccgggcgcctcgggagcctcgacaccctcgtcgcggcctgccgcgcgctcgccgcctga

SEQ ID NO: 8550 - DNA, 1203 bp, Methylobacterium sp.
atgcggaccgttcttctcacctatgagttcggtgccgggcttgggcacctcaatcgcctcatcgccgtcgcgcagcggctccagggctgccgcctcgtcttcgccttaccagatctccctctcggtgttcctctggtgcgccggacgttcggcgaggccgccgagatcgtgcagggggtggtctggacggcgccgaccgcccctgaatcgcgccaggttccgacccacaccttcgccgacgtgatcgcgctcttcggcttcgccgagatggcgcggctcgaagccctgactgccaaggcgacggccctgctcgacgcggtcaagccggatctcgtcgtcgccgacttcgccccgaccctgcgcctcgcatccgcgggccgcgtgccgacggtcgtggtgggtaacggctacacgattccgcccggcggccgtctcctgccgccgatgcgcccttgggaaacgatggtgggaccggcgagccgcgcgcaggagggacaccttctcggcgcggtcaacgccgtgcgggcacggcggcagggggcggcggtcgatttcttcgccgacctgttccagggcgagcacagtttcccctgcactatcgcggagttcgacccctacggtacggctcgcgccgagccggtggtctggcccttcaacgtcccggtgatccccgagggtccgccggtcgccgagcggcacgggccggccgccttctgctacttccagggcaatcatccggcgctggcgccgacgcttgcggcggcaggcagccttggcgcgcgcgcggaggtgtacgtgcagggcctcgatccgcaggcggtcgcggcgcgctgcgcgcgcaacgtcggcgttcaccggaagcccgccgacttcgccgtagcgctgccgggcacccgcgtgctggtgcaccatgccggcctcggcaccgcctatgcgggagtgctcgctggcacgccgcaactcgttatcccgcacaatctcgaacacgccatcacggcacgaggcctggagcgcttcggctcggtggtacgcgtcggcgtcagcccggtgccggagcctggaacgctgacgcgaatcatgaagggcatgctcgctgacggcgacctgcaggcccgagccgcgcgagccgcccgggatctcgccgcgcggcgtgtgccggatccggtcggaccgatcgcggcggcctgcgccggtttcctgtag

SEQ ID NO: 8551 - DNA, 345 bp, Methylobacterium sp.
ttgatcaagaggttctgtctcgccctggccctagcgggcgggctcgtggccgccgcgccggcggcgtcggccctgacgctgcccacggccgccggcctcgtgggcgccaccgacagcgcggtcgtcgaggtgcgctggcggcgacactggcggcgccatcaccgccaccgctggcaccggcaccaccatcgccgctggcaccaccatcggcgccaccgccacgccctgcggcatcaccggccgctgcgcttcagcgtcggacaggtccacgccccgcgggtccagccctggcgcgatccggtgcgccccgtcgcgggcgggcgcctgaccccgcggctggactga

SEQ ID NO: 8552 - DNA, 195 bp, Methylobacterium sp.
atggttgcggcgttgaaacgggcggtgcggttgcggcggacgatgcgcgagcgcgacacgcgggtcgaggcgagcggctgcgccaaggcacggcccctacccgtcggagaggcgacgatcctggccgagcgcggtctcaccgcccgcgagttgatccgcatggcgcaggcggcgcgtcgcgcccggcaggactag

SEQ ID NO: 8553 - DNA, 903 bp, Methylobacterium sp.
ttgaccccactcttcgttccggtcggtattcgctccgccgacaaggcggcactgttgggtcgtggcggccatatcttcctcgtcggaggcaccaacagactgctgacggagtatgtgcgcgccgacgaagatccagtggccacaggcaccgcgcaggcttggctcaccctgatcgagcggcgcagagctaccttcgagaggctgggtgttcggtatgtccaggcgatctttcccgagaagcttacggtgctgccggagttctttccggaaccggtccgcacgcctggcgccatcctgcgccgtatagaagcagggcttgcttccaagcccgatctgtccgcaagctatgtctcgacgcgacatgccctcgcgacccagcccgaccctgcagcgacacttctgaagaccgattcgcatttctcgcctctcggatgctgggtggtcttccgcgccatcttggagcatctcggcatcgtcccggggctgacgccagcctttggcacgatccgagcgggtacgggcgatctcgcagttcgcttcttcggtatccctatcctggatacgcgaacggaggctgacctagacggcttggatgcgaccttccgggcgcgggcaatacgcacgttcgaatacactccgccgggccgtttcgtgggatcggcgcaatcgtggcacaaccccgatgcaccgatcgatgccagcatcctcgtgttcggcaactcgtattgtggagcggcggaaggacatcagggacagatgtcctggtggtttgcgcgatggtttcgcacctaccacttcgtctggcgcgcagacgtgccgcccggcttggtagagaagctgaagccggacatcgtcctgtgtcacaccgtcgagcgtttcctcgtcgaggtgcccgagacttga

SEQ ID NO: 8554 - DNA, 300 bp, Methylobacterium sp.
atgcgcaagttcgccatcatctccgccgccgccctgacgctcggcaccctcgcgacgactgccgccgacgcgcgtccgcgcggctatcacggccatggctacgccccgcacgcgggttacggctacggccatcgcggccggcgcggcatcggaaccggcgcggccgtgggcctgggaatcgcgggccttgctgccggcgcgatcgcggcgggcgcggcacgcgatgcctacgcccgggatggatactacggtcgccccgcctacgggtacggcggccctggctatggctacggttactga

SEQ ID NO: 8555 - DNA, 1398 bp, Methylobacterium sp.
atggccggcatcggattcgagctgcggcgcctcagccgccgcgaccagctcctgggcccgatggcggccgtcgcgcacgccgccctgatcgcggccggcccctggctctacacgatcctggcgatcttcctgatcagcgcggtcgccgggccggtcgttggcgccgacgcgaccgcgaccttccgggtcctgctcatctacatcttctcgctctcgctcgtcgccacggcaccggtcatcatgatcggcacgcgcgtgctggccgacgcgctgcaccgccgccactacgccgatatccgcggcctctactgcgccaccctggtcggctgcgccgccgcgacgctggccctcgcggccctcgtcctcgtcggtctctccggggtccgggcggaggctgcgctcgtcggcatcgcgggcgcgcagctcgtcggcatgctctggaccgcgctcgccttctgcggcgcggtgcgcgactaccggcacatcacgttcgccttcgcgctgggcctcgcggccggggcggggctcgcgatcggcgcagcctacctcaggctcgggccggtcgcgatggcggccggcgtgtgctgcggcttcctgatcatcttcctctggctgacggcgcgcttcctggcgaccttccccgagccctgcgagagcctggggccggcacgcgccgcgctcctcgaccgcctgcgcgccagcccggcgctcgcggtcggcgcgctggcgagcgcggtcggcgtctgggcggacaagtggatcgtctggaacggccggttcggcgagcgcgtcgatgtcgggctcatccacgcgccgctctacgacagccccatgttcgtcgccagcctgacggtcatcccggcgctggcactcttcgtcacgagcctggagacgagcttcttcgagagctaccacgcctatttccgggcgatcgagcgccacgcgacgctgcggcggatcgaggagcacgtgcgcgcgatggaggcggagacgctgcgcaccctcgtcgggatcatgacggtgcagatcacgctctgcctgatcgtgctgcagaccgccccgatgctgatccaggtcttcaacctgcagttccagcagatcgacatcctgcgcatgggctcgatcggagccctgttccagttcctcttcatcgtctgcacgacgatcatcgccttcttcgacgcgacccgcctctacgtcgcgctccacctgctcttcacggcctgcctgatcggggcgaccgccctggtctcgtcctcgcggatggagacgctggcgctcggctacatgagcacctgcatcctgctcgggctcggctccgtcctcccgttcctgcacgtcctgcgcacggtgaacttccgcgtcttcgtcgggagcgccgttgggccgaagcgctga

SEQ ID NO: 8556 - DNA, 1539 bp, Methylobacterium sp.
atgtggtttgagggccttcggcaggccagccgccgtcttccgatcgcggttccggcaccgacggccgacatctgcctcgtcgtcgaggggtgctacccctacgtgccgggcggcgtctcgacctgggtcgattggctgatccggggcaatccggacctgaccttcgccatcgtcgcgctcgtggcggacccgtccccgcgcgagatccgctacgcgctccccgccaacgtcgtgcgcttcgagagcctgccgctgaccgtgccgctcgacgcactgcgctggcgggaccgcgcgccgccggccgtcgagatcgcgctggccgataccctcgtcgctctcgtgaacggcggcggcctggccgccctgcgcgacctcgtgcggctcatccgggacccggccaaccacctgtcgctcggtgccctgatggcctcgcagctctcctggcgcctggcctcggccacctacgagcgcctgatgccgcacgcctcgttcctgcacttcttctgggcctggcgcgcgctgttcggcggcctgttcgccgtcgtgacggccccgctgccgccggcccgggtctaccacacgatctcgaccggctatgccgggctcttcgccgcccgggcggccctcgagaccggagctccgacgctcatcaccgagcacggcatctacaccaacgagcgccgggtcgagatcctgatggcggagtggatctgcgacacggtcgataaggggatcagcctccaggacgagcgcgtcgacctccgcgacatctggatccggaccttcgaggcgcacgccctcgtctgctatcaggcctgctcccgcatcctcaccctgtacgaggacaatcagcggctccagcgtgccctgggggcgccgcaggagcgcctcgcggtgatcccgaacgggatcgacctggcccgcttcgcgagcgtcgcgcccgtcggggcgaacgcgccgcccaccgtcgccctgatcgggcgcgtcgtgccgatcaaggacgtcaaatccttcatcgacgcggtcgcgctcatccgccggagcgtgccgggactgcgcgcgctcgttctcgggccgacggacgaggatccgcaatacttcgaggagtgctgcctgcgcgtcgccgagcacgcgctggaggagaccctcaccttcaccggaccggtgaacatcgtcgcctacatgtcgcagatccacgtggtggtcctgacgagcctcagcgaggcgcagcccctcgtcatcctggaagcgggcgccgccggcatcccgaccgtcgcgaccgacgtcggggcctgccgcgagatgatcgagggccgcgccgacgaggcgccgcggctcgggccgggcggcgaggtcacgcgcctcgtcgatccgcagcagaccgccgaggccgtcgcgggcctgttgcagaacgagccccggcggcgcgcctgcggtgaggccatgcgggcccgggtccggcagtcgtacagctccgccgacgcgctcgcggcctacgcgcgaacctatgcggcgtttctggacgggagtgggagctag

SEQ ID NO: 8557 - DNA, 1371 bp, Methylobacterium sp.
atgacgaacgcacgcctcctgctcctcctcgtcctcggcgccgtcgtgacggccgcgtacctcctcagctcgggaccggaggagcggatcgccaagctcgtgcgcgacggtcgcatcggccgggcgatcatcgtcgcggagggcgtactcgcgcagggacgggcgacgccgcgcatgctgacgacgctcgccggcctctacgacgccgagggggatccggagcgcgccgccgacctgctcgagatccatgctctggtctggccgggggagccggacattctcgcctcgctcgctgccctctacggacgctccggcaacgcggaggggcatgtcgcggcgctcgagcgcctcgtcgctgtccggccgtcgcgcgagacgctcgcccggctggccgcgctccatcggctggccggccgcttcgacgcggagttcaccgttctcgatcgtgccggggacggtgatctgctcggcgcgggcgaccaggagcgactggcccagcttctggtccagcgcggccggccgcagcgcgccgccgagcttctggctcgggccgaggatcggccgggcggccagggcgagcggggccggatgctcctgttcgagatccttctggagacgggggcaaccgcggaggcgggccggcgggcggcggactggctggccgagtggcgcaagccctggctggcggacaccctgctcctgcgcctcgctcccgtggcttccgccgagacgaccctcgcgctggcccggacggccatccggctcttccccgacacccgcttctatctcgccaagcgcctcgcggagcagggacacggagcgctcgcgcacaccatcgtgcgcggctggccggcgcccgacgcggccgtcacggagcgcgagatcggcggctacgtcgcggtggtccacgcgagcggcgatccgggtctgctccggccggcgatcgctgcgctcggacaggccggcttcgaggagcaggcgatcctcgccgaggccattgaacagacccacggcctgcccgtcctggccgcggcctggcccgaccttccgcccgaggcgctgctgcgccgtcccctgctcggggttcgtctcgcacgtctggggcggcgggacgacctggtgctctggctcgtgcggagcgccgacctcggcgcactgcgccccggcgagcacgcggcctggctctcggtgctgcgcgccgcgtgcgggcctttcgcgaccttcgagatcctggaccggcaacgccgccgcggcgagcttccgggcggcttcatggccgcctaccggcagctcgccgcgcaggtcggtgcctcggaccggcagcggcgtgacctcgtgagcatcggcgatggcgacagacaagtccgctga

SEQ ID NO: 8558 - DNA, 3888 bp, Methylobacterium sp.
ttggagaaccgcgacgggtcgacggatccggcgaaagcctcctacgtcatcgcgtttcagagcgcggtcgcgctcgctgacggcgcgccgatcttctggctgaacacggaccagaacagcaacacgggctatcaatccttctccggtgccgcgacaggtgcggaatactacgtaaccctgtcgggcggtctgccctatctgtacgatccgtcgaccattccggccaccggaaacgccggctatgtcgggccgatcaccgactacaagatcgacgcggccacgaacacgatcgagttcgcgatcccgcgcacgctgatcacggatgatcgggcgggactcgacctgaaggtcttcgccaacagcggcgtttctctgccgagcgacttcgcggcaacgacgtaccggatcaacgatcccgcgacgctgcccgcgccgggcgcgaaggcgcagaagatcggcatcgtctactccgccaccaccgcgaaccagtatttcggcgggaccgaggccgggcagacggcctactcccagctcttcatggcggctcagaatcaggcgaccgccgcgggtgtgtccttcgacgtcctgtccgaggccgacctgaaggacgtcggcaagatctcgggctacgacgcactggtcttcccatcgttccggaacgtcgctgccggcgacgtggacgcgatccagagcgcgctcaccacggcggtcacgcagtacaatgtcggcctgatcacggccggcgacttcatgaccaacgatgcgaccggcgcgccgttgggtgccgatccctacatccggatgaagaccctgctcgacctgacgcgtgcgggcgggacgagcaccgcggagccggtcagtgtcaacgcgacaggatcgggcttcaccggctaccaggcgaacgagctcgtccgggactacgcgtcgatgagcacgtcctggtatggaagcgcggacggcacggcaccgaccgtgctcgcgacgcagaccgtgacaggggccacgcacgacgccgtcgtcgcgacgctcacgggcggcaagaacgtccacttcgccaacgagagcctgctcggcgacaacaacatgctgcagcaggcaatcgattacgtcgtcgatccggcaagcgggccgagcctcagcctgcgcatgagtcgcgggaacgccatcgtcgcctcgcggaccgacatggaccaggccaaggagctgagcgacgtccggccgccgagcgggcccggaatttacgacaagctcctgcccatcctggcgcagtggaaagccgactacaacttcgtcggctcctactacatcgataccggggacggcacagctgcgaacggctcgaccgactgggactacgccaagcagaagtactacgatccgctgctcgccatgggcaacgagatcgggtcccactcggtcacgcacccggaagacaccaatcttctgtcgtccgatcagatcaaggccgagttccagggctcgaagaacacgatcgaggcgaacctcaaggttccggtgacaggggccgcggtccccggcatgccggagtacctgaggacgtcgaaggacatccagcagtactacaactacatcactggcggcgcgacactcgtcggagcgggctatcccggcgcgatcgggcacctgaccccggacgacccgaaggtctacatagccccgaacatgtccttcgacttcaccctcgtcggcttcaagggcctcgacgcgacgcaggccggggcggtgtgggagagcgagtggaacacgaacaccgcccattccgagatgccggtcgtggtctggccctggcacgattacggtccgacgggttggccggtggatcccaccgcgtcgaactatacgacgcagatgttcaccgacttcatcgcccgcgcctaccagttcggctcggagttcgtgaccctgagcgacctggcgcagcgcgtcgcctcctacgacgcctcggacctgacctacacctacgacaccgccgcgaacgccgtcacggccaagctcagctcgccggattcgggcaagttcgccctcgatctcggcacgggctcgacgatcaagagcgtcgccagctggtacgcctacgacgcgaacagcgtgttcgccgaccgggatggcggcatcttcacgatcaatctcgggacgacggccgacgacgtcacgcatctgagcaagatcgccgaccgtgccgaactcgtcagcgcgacgggcgacggcacgaacctcgacttcacggtcgtcggcgagggaacctacatcgtcaacctgaaggattcgatcggccagaacgtcgaggtgacggacaaggccgggaccaagctcgcctacacccagagcggcgacgcgctgagcatcaatttgacgggactcggcagccacgacgtctcgatcaaacagaagacgaccccactgccgaacctgccgccgacggtcgctcaggcgctgacggcgagcgtcgccgaaggcgatcagcccaagacgctcgatctgcttcagggtgcgagcgaccctaacgcgggcgacgttctggcggtcagcggcctcgcctacaagctcggctccgcaacggtcgccgacgccgccgcagccggcctcagttacgatgccgccacgcacacgctcacgctcgacccgcggagcgcactcttcgatcatctggcggtgggcaccacggagacggtgacggcgagctacacgatcgctgacggccacggcggaagcgtgggccagagcgcgaccttcaccatcgccggcaccaacgatgcgccgaccgttgccaacgcgctcaccgccagcctcaccgagggtgctgcgccggcgcagttcttcctcctcgccggcgcgaccgatccggacgacggcgagacggccaagctcgcgctcaggaacctgacctacacgctgggaacgggtgcggcgagcgcgacgccgcccgccggggtgagctacgatcccaacgggtacatcctgctggtcgacccgggcaatgcggccttcaccccgctcgccgcgggcgcgacgcagacgatcatgctggcctacgacatcttcgatccggctggcctagctgtccggcagaccgaaaccctgaccatcacgggcatcgacacgcccgcaccgggcggcggaggcgggggcgggggcggctccgtgccccccggcccgaccgccggcagcgacgtgctctacgggacgggcggcggcgaccggctcagcctcggcgcgggcaacgataccttcatcggcgccggcggagccgacctgatctacggcaatcaggacgacgacagcctcgcgggcggcggcggcgcggacaccctttacggcggccagggcaacgacatcgtcgccggcggccagggggacgaccggctcttcggcaacagcgggaacgacgtcgtctacgggaatcagggcaacgacgtcgtctacggcaaccagggtgcggacacgctcttcggcggccagggcgacgatgtcgtcttcggcggccaggacgccgacgtcgtctacggcaatctcggcgccgacgtcgtctacggcaacaagggcgacgacgtgctctacggcggccagggcgacgacgtgctctacggaggccagggcaacgacatcctgatcggtggcctcggcaacaacatcctcgtcggcgggctgggcgcggatctctaccgcttcagcgcgaacgcggcccacgacctgatcctcgggttctccgaggcggacggcgaccggatcgacctgcagggtcagaccttcacgctgggcacggcgggcgacggcgacgccctgctcctgctctcgggcggcggcagcgtccaggtcgcgggcgtcagcaccgccacgttcggcaacggggccgggtacctcgcctag

SEQ ID NO: 8559 - DNA, 243 bp, Methylobacterium sp.
atgctgggcaggctgatcgcatccgctcggagcgtggcgacgggcacgggcgccgtgcgggcgctgctcccgagcgggcggccgcgcgcgccgggcgcggccatcgcgcccgctccggagacgatgcccgacttccccccgatgcgtcccctcgaaccgccgccggcccgcaacgacgacgtactgcagcccgttcacgaggcggtggagcgtgacctgcgggcgcgcggctacctgggctga

SEQ ID NO: 8560 - DNA, 300 bp, Methylobacterium sp.
atgcgccttggtgcacgatcgatcctgctcaaactcgccgccgtcttcctgctctgcgccggcctcggcgtcacggtcgcgccgcgcgtggccgaggccgcgccgctcgccgtcccgtcggcggtcgaggcacccgcctccggtctggagacggtgcagtaccgccatcatcaccggcaccacggcctgcaccgcggctggcaccatcgccgccacttccaccatcaccgccggcacttccggccccaccacttccaccgccaccaccaccatcaccgccgcggcttctaccgctactga

SEQ ID NO: 8561 - DNA, 1209 bp, Methylobacterium sp.
gtgttcggtccggtcgcggacatcctgctctgtggcgccctcgcctacgccgccgcgctcgtcgcggcgcgcggactcagtcgcgcgggatttccggtgcccgcgggcggcgagactgcgatcgacgggctgcgcggcctgctcgccctggcggtgctcgtccaccatgtcgcgatctggatcccggtggcgcgcgccggtgcggcctggacgacgcccgaatcgctgctcctgcacaatctcggcgcgggcagcgtcgggctgttcttcatggtgacgggctacgtcttctacccgcgcgtcctcggcggtctgcggggcctcgacctcggccgcctcgcgctcggccggctgttccgcctctacccggccctcatcgcctcgatcctgctgatcctcagcctgatcctctggcggaccggcggggcgcgggccagcaccttccacgcggaggcggcggctctgctgcgctggctcgcctgcgcgggcaccccgccgctgctcggcgaggccgactccgggcggatgaacgcccacgtgctctggtcgctgcgctatgagttgctgttctacatcctcgtcctgccggcctgctgcgcggcgatggaccgggtccggggccgggcgccgacctggtgggtgcccgcgggactcctcgtcggcgcgctgctcctgcggccgttcaagaacgccctgccgctgatcggctacctgccgctcttcgcggtgggcatgctggcctacgaggtgcggctgcgcgaggcgctcgccgcccggctgcgcgggcccgcggccgcctgccttggtcttgccgcgctcgccctcgccgcgaccacgcaggtggtgcccggcaaaccggcggcgctcgccctctacggcgccttcttcgtctgtgtcgcctgcggcaacgatctcggcggcctgatgcgcgcaaggagcgcccggctgctcggcgcctgctcctacggcgtctacctgctgcacggcgtggtgctgagcgcgctcttcgtcgatctcgcgcccctcaccggcgcgatcccgaccgggctgctgccgctgctgatcccggcggcggcgatggctgccgtcctgctggcggccctcgtccacctcgccgtcgagcggcccggcatccgggccggacaggccctggcgcaggcctgggcgcgcgcgcccgtcctcggccgcctgcgcgcgcgggcggcctga

SEQ ID NO: 8562 - DNA, 1245 bp, Methylobacterium sp.
ttgcgtctgctggggcctgcctatcggctgttctacagcgatccagtcgagatcagccgcggggaaggcgttatcctctacgactctgcgggcagagactacctcgacgcctataacaacgtcgtttcgatcggacatgcgcatccacgcgtcgtggaggcgatctcggctcagttgcggacgctgtgcacccacacccgctacatccaagagggcatcctgagatacgcggaggatctgctcgggatgcatcaaggccgcgtcggtcacgcgatgttcacctgcaccggatccgaagcgaacgacctcgcggttcggatcgccaagcatcacaccggacgcaacggcgtgatcgtgacatcagaggcctaccatgggaattccgatctgacggccggcttctctccatctctgggcgacggctcgccgctgggcacgtgggtccgacgcgtgcctgcgccggatccgtatcgcgtcgatgttgcggacatgggagcatggatggccgataacgtggccgctgcgatccacgatctggagcgccgcggcgagggcgtggccgcattcatcgccgactccctcttctcctccgacggcatcttctcccatcccgccggcgtcctcgcgccggtggcggaggtcgtgcgcaaggcgggtggcgtcttcatcgccgatgaggtccagtccggattcggacgatcgggcgaacggctctggggctacgagcggcatggcgtcgatcccgacatcgtctccatgggcaagcccatgggcaacggctacccggtcgctgggatctgcgtcgcgcccgaacttgtcgagagcttcggcagggaaacccgctacttcaacacgttcggcgggaacaccgtggcaatcgctgcggctcaggcgacgctggatgtcatacgcgatgaggatctgcaggccaacgcggacaggatcggccgccgcatccgcgagggcttggctgagctcgccaagcgcgatccgcgcatcggagacgttcggggagcgggcctctacattggcgtcgagctcgtgcgcgatcgcgacacgaaggagccggacgccgccacggcgctcggcgtggtgaacggccttcgccaacggcgggttctcatctcggcgacgggcttcaatgccaacaccctcaagatccgtccgccgctcgtgttcggcgaagatcatgtcgaccggctactgacggagctcgagggtgtcctcggatcgataccggcatga

SEQ ID NO: 8563 - DNA, 987 bp, Methylobacterium sp.
atgctcgaggaagaggccgccggactttgccgatcacgctacgggcttgacggtgatctgctgcgctttgcaaccgagaaggacgatacgttccgggtacgcaacggacgtggcgaagccttcattctgaagatcacgaatcccggcgaggccgagtcggaagtcaatttacagacggacctgcttcattaccttgcaaaatcttcgccgcacctgcgtgtgccgcggatcatcccggacctcgatggaaatcgctacgcggcctacgtcgacgcggcggggcagagacggctcctcaggatgatgacgtttctgccaggcactcccctgagcgagatcgagccgacctcggccgagcgcgagaaggtcggagaggtcctgggatctctccgcctggcgatgtccgacttctcgcaccctgccgactgccgcgagatcgcctgggacatccgtcatctcggcaagctgtcgcacctcgtcggccacgtggaggattctggccgtcgttccttgattgaaggtggcatgagacgttttcgcgaaatcgaaagcgatcttaccaagtgtcgcatgcagatgctgcacaacgatttctcccggtcgaacatcgtggtcgatcgcaagacgccggagttcgtgtctggaatcattgatttcggagacgcagtacgcaccgccgtggcggtcgacgtatcgacagccctcctaaaccagctgtctccaattccccgggaggacctgttcgccgatgcgaaggacgtgctgcgcggatacctccggatcgcagacctgacggaagacgagctcaggttgattcctcatctcgtcatgggacgtgtgatagcgcgcgcgctcctgacgacttggcgcgcgcggctctttccagacaacgctgcctacatcctgcgcaacacctaccagggttggcatcagctacagtggtttctcgatcgcccgttccgggaaatctcgaacaccctcgcctga

SEQ ID NO: 8564 - DNA, 135 bp, Methylobacterium sp.
atggagaccctggacgggcctctgcccggcacgctgctggtgcagctgagccgcctgcaccgctccgagcacgcgcggctggctgcggcggaagcgccatcggcccaggccaccggtggcccgcgcgacggctga

SEQ ID NO: 8565 - DNA, 1290 bp, Methylobacterium sp.
atggcgccgcccgaccgagccgcgtccgagcccgtcgtgggccgcgccatcctgctgctgctcgtgctgctgctctgcctcggcggggtggcgaacgccctgcgcaaggacatcgccaagggcttcgacgaggtcgcccacgtctcctacgtggcgcagatccagcgcgagggcgcgctctggccggacctccgggcgctccgcatgctggaccccgcgagcctcgcgccgacggccctgccgaactacctcaaccacccgccgccctactacaccgcgctcgcccggctcggccccgcgatcggcgcggatccgtcggcggtcctcgtgctccggctgatcaatgtcgggctggcgagcgccgcgatggccgcgctgctcctgctcgccgccgggctcgcccggagccggcgcgcgttctgggcctacgcgatcccgctcgtcaccatcccgaccgcgctcgccctgaacggcgcggtcaacaacgacaacctcgcggtcctgggtggcgcgctggcgatgctgggcctgcagcgcctgctctgtggcgatcgccgggcctggctcgccgcggtgctggcgggcgtggtcgcggccgggctcgcgaagttcaccgcgctcctgctcgtcggcggctgcgccgggccggtcctcctctggctcgtcctgcgcgggcggctgcccgccgcggtgctcgttcccgccgccctcgccctcgcgctcggcgccgcgccctacgcggtgctcctcgcgcagtacggcagcccggtgcccgaggtgccgggccatctcgcgatgatgcgcgacggcgcccgcgcggccggctgggacggcgcgcgcctcgacttccccgcctacctcctgaacttcgccgcgctgttcgccgtccagttcatgcccgtcctggcggagccgggccccgtcgaaaccgcggcgctcgccctgccgctcgcgctgatggggctcagcctcgcaggcggcgcggcggcgctcgcccgcctcggcaccgggcgcgcccatcccctcgatccgctcgcggtcgcgggctgggcggcgatcggtctcgtgctcgccgcccatgtgcggttcggctacctgaaccatctcgccaccggctggcggctcgacgcctatccccgctactacctgccgctcgccgggatcacggcggtcggctgcgcctgcctcatcgccggcctgcccgaaggccgggcgcggcgcgggatcctggccttcctggcgggcgcgcccctggccttcggcctgctcggcgcgccgctcggcggctga

SEQ ID NO: 8566 - DNA, 225 bp, Methylobacterium sp.
atgcagctctcgacctacctcgccccgcccccgacgccgctgcgcgccgccaacgaggccgtgcccggccccgagccgctgcgcgacgcccggcccgcgcggcccgacgccgcggtgctgccgttccggccgctcgcgcgccgccaccgccgccccgccgagacgcacgagcgccgcggcgagatcctgctcttcctcggcgtgcgctacagccgcgcctcctga

SEQ ID NO: 8567 - DNA, 276 bp, Methylobacterium sp.
atgccccccaagcccgcccgcttcctcctcgccgccctgctcgtcgggctcgcaccgctccccgccgcggccgctccgccgcccggcgtcagtcccggctccggcacggagaacatcggcgccggtccggctcccggcacgccctccggcgtcgtcggcttcgacgggccgcccggcggcggggtcaacaccaccggcggtcccggtgcgctgccaccgagcacgccgccgtccaacaccggcctgcccgccggcagcccggcctccccgcgctga

SEQ ID NO: 8568 - DNA, 192 bp, Methylobacterium sp.
atgaacctggacgcgcagcacgaccgcacagccctgccgcccgcccccctccccgcaacgacccacccgattcagcagcccacggacccggccgaacaaggccgcaccgacgagacggcggaccgctccgagggcgagcccgccgcgacgcccaccaacgccttcgaggcgttcggctccttctccggctag

SEQ ID NO: 8569 - DNA, 282 bp, Methylobacterium sp.
atgtcggtcatcgaatcacgcgggacatcgcgcgcggcagcgtcggtcaacgcgacgccgcgcgagcggcgcgccagggcggtcgcgcacgccaaccagttgcgggccctcgcatgggtcgccctgcgggacggcgcgccgcacggcgcgatgcgggcggcgaccgcccgcacggccgcccggcgcatcctgcagcacgagcggcgcgccgccgtgctcaaccgcgcgctcgcgcaggcgctcgaggccctcgtcgaggagcaggccgaccttgtcggctga

SEQ ID NO: 8570 - DNA, 195 bp, Methylobacterium sp.
atgccccgcacccccgagccggagccgtacggatcggtcgagccgctgccggtcccccgcctgcgcggccggaggaccggtgacgccgagccgccgaccaacgagccactggatccggacgaacgtcccgatgtcggcctgagccagtccggcagcggcgaggaggcgatcgtccgccgggagaccgagatctga

SEQ ID NO: 8571 - DNA, 1272 bp, Methylobacterium sp.
atgacgacgctgacccgccgccaggcgctcgcgggcctgggcaccgccacgctcgctggggccttcccggccccggccatcgcccagaacgcgccgatcaggatcggcgggctcaccaccctggaggggcccttcgccaccggcggccaggatgcgttccgctgcgtccagatggagctggagcggatcaaccacatggccggcggacggcgcatcgcgttcatccgcgagagctcgaacgcccgcgccgacgtggcgcttgcccgcgcccgcaagctcgtcgagcaggacggcgtcgacatcgtgctcgggccgctctcgggggcggagggcatcgcactgaaggactattccgcgacgctcaccggcaagaccatcgtcaacggctcctcggccgccgccgacaccaccctgcgcaacccgtccaagaacttcttccggttctcgaccgacggcacacagtggatggccggcgtcggcaaccacgtccgcaagacgatgggcatcgaggaggtctgcgtggtcgcgggcgactacgccttcccctacgcccaggtcttcggcttcagccttgaatattgccgtgcgggcggccgggcgacctacctgtggtcgccgctgggcaccaccgacttcgcctcgcagatcgcccagatcccgaagagcgccggcgccttggtggtggtccatggcggcaccgacggtctcgccttcatgacgcagtacgcgcaagctggcggcagcctgccgatcatcggcggctcgatcatggccgaccagaccatgatgtcggcccgcggcccgcaccgcaagctgatgctcggcatggtcagcggcggcccgatcgccgacgtcaacgaggatccgaactggaacgacttcgtcgcccgctaccgcaagcgctgggcgaacgagggcgggttccagtcgccgtcgatccacggggtgaactacaccaccaacctccagggcatcctcggcgcgctggaggaggtgcgcggcgacctctcgggcgaccagagggccttccaggcggcgctggccaagcaccgcttcaagaacccgatgggggccgaggtctatctcgatcacaaccggcaggccgtgtcggacatcttcctgaccaagatcgaggagcgagagggcaagccggtgaccgtggccttcgcccgcgcgcccgcgatcaaccaaaccctcggggtgcccgaggcgcgcttcctcgcccacggggcgccctcgcgcaacaacacgggctgcatcgccggcacctga

SEQ ID NO: 8572 - DNA, 192 bp, Methylobacterium sp.
atgacgaggctcctcgggccgcccccggcgcgcacggcgcttcggcgcggcctggcccatctctgccgcctcgccggggccgggctgttcctggcgacctgcggcgtcgcctcctacacggccggggcgcactaccgcccggagccggtccgggccgcggatccgggatccgccccggtctgtccacgctga

SEQ ID NO: 8573 - DNA, 414 bp, Methylobacterium sp.
atgagtcccacgcgaacgccgccgggccccgcctgcccccgggcggccctcgacgcgctcggccgcgaggtcgggcgcgccctgcccccgcccgcggacgggctcggcgagagcctcgtccggcgggcgctgcgcgagacgccgggcgacgagcccgacgaggaccgcctcgtcgtccgcttcggcacggagtggcgcggcttcatccggcgccagaacccggaccggctcgccgccctcgacgcgctgatcgacgcgcagatcgagcgccgggcactcgcccgcttctaccggcgggtgcgcaacgcggcggtcgcggtgaccatcgcgggcttcgcggtcgcccagttcgggatcgaccggttgccggtcgtgcgccagatctggcgcctgctgcggggggagctgcgatga

SEQ ID NO: 8574 - DNA, 726 bp, Methylobacterium sp.
atgtcggcagcggagccgcaaccgaaccaggccgccgcagctgaggatctcgccccggccgaggtcgaggtcctggacgccgctcccgtcgcggccgggtcgtcttccgaggtcgtgacggaggcggtaagcgagcctgaatccgacgagacggtcgaggcccttgatgcatcggcagccgaggtcgacggggtgaccgaaccccaggcgggagcgatcgctgcagagcccaaggagcctgctgccgtcgacgagccgaccggcgagacggccgcgcaggtcgtctcggaggagggcgtctcgcaggagcccgccgaggtggcggcatcggacgtggcgcgcgccgaggcgccggatccggattccatcggggccgaatccctcctgccggtgtccgccttcgcggcactggatgctgcggacgcgtccgaggcgggagcggcacgtcccgctgtggcacggaccaccgtccgcttcacgttcgcgccggtgcggatcgacgtcgaggggatcggcgtcgtgctggcgaactacatgcacaacgagagcgtggcgattctcagctacatgcgggcgctcggcgcggcacgctcccccgccgacatgatccgcctgaacgttaccgcgatgcagcgcgccgctgatgcctcgctgacctgctggagcgacatcgcgcggcgcacggcccagggcgtgccgtggcagcgggagaaggctgcggcctag

SEQ ID NO: 8575 - DNA, 213 bp, Methylobacterium sp.
atgggcaagctgaagccggtctatctctatcgcctgcggctcctctacgctgccccgcgctactacgccccgcagagcatcaaccattacctggagaagcgtggtctgatccggcgcaccgggcgcgcgcttccggcccggcggcacgaggagtacgagatcacggaggccggccgcacggccttcgatgcagcgctcgcggcgccggagtga

SEQ ID NO: 8576 - DNA, 618 bp, Methylobacterium sp.
atgatcgaggatgtgatcgacggtcgtacaattccggtttcggagcagatctcgacgatgatctcgcggatcgctgagcggcagcagtacgatgctgttttcatcgacagtcgcgccggcctcgccgaattggcggctccagccgtgctcgggctcggtgccactgttttgctttttgggacggcacagaagcagactatcgagggctatcgcgctctgtttgccgctctgcagctgctggcgcaacgtgaccgagcgcagggtagggatgccgagtggcggaccagactgcgtccggtcctcgcaaagacgagcctagccccaggtgcggtggaacgataccttgaagacatgtacgagatctactccgcacacatctacgatgcggagactgacggcgagcagccgcccgatagccttcgtttcgcccaaaacgacaagtcggctcctcattggcctttgatagttccatttagccagaacttcgtcgatttcgatccggggcggataccgggtcagcttgtccaaagcttctacgagcagacgttcggacccttcctcgcccagattcagttggcgatggtctcggatgagaatatcggcgggtcacagccgtga

SEQ ID NO: 8577 - DNA, 279 bp, Methylobacterium sp.
atgattcgggctgccgcgatggaaactgagtcgcatcagcgcatttttcgctgtcacctgatggtgacggtgcaagccgtgctctctgagtaccggccgggggccagcgcccagatggtaacggacctgctcgcgcgtctcgaagccctggaagcaaaggctatggcggagggtgcgccagtcgcaacgatagcggccatccgtggcgccaaagttttgatacagattccgcccgcaccgagaatgcgccattttcctatagtggtgagcgatctctga

SEQ ID NO: 8578 - DNA, 243 bp, Methylobacterium sp.
atggcactttattttttcgacgtccacaactcccagttctcagcgcgtgatgaggacggcaaagagtgcgaaaaccgcgactctatcagtgccgaagcgctccggcagctatgtgtcattgccaaagacgacccgcttctccacatgaacggcacgatcggagcggttgtccgtgacgaacacgatcacgtggttctcacggccaacctagtcctggccgtggtgtgggttggcgacgcttaa

SEQ ID NO: 8579 - DNA, 312 bp, Methylobacterium sp.
gtgtgcgcccccgtcctcagcggcctcgccgccgcgatccagctcccggccctcccggcgggccgctcgggtccggtccgcgcgggtccggttcatccggttccggctccctcgccttgcggcgtgccggccccgccacgaccgatcccgccgctcttcctgcacggcatccggccggccctcgaagccgccttcggcaccgaggatgcggagcttgcaccggacgcgatcgccgcgctggtggcccggctccacaccggcccgctcgggccggcccaggcggaggcgagcccggccgtcgcggtggcctga

SEQ ID NO: 8580 - DNA, 360 bp, Methylobacterium sp.
atgagcaagccggttacggacaacaagcagacgatcgaccgcacccgccgcctgatcgccgagatgcgcgaggtcatcgaggacgcccgcctctccgtgctcgccgcgcgggacctcctgaagcagttccccagccccgagggggtcggaccggcatcccccctggtcgagccgcccgccgacgacccgtcggaggatctgacggtgcgcctcgtcgacatcctgctcgacgcgcacagcgtcgccaacctggacgatgacgcggagacgcgggtgctgctggagacggccctcctgcgggtcgggcatcggctcgcgcgtcgggccggtccgcgggcggccggactggttctccagtag

SEQ ID NO: 8581 - DNA, 213 bp, Methylobacterium sp.
ttgaccgcacgcccgaggctgctcgccgcagccgccctcctcgctgccctcgtcctcgccttcgtgcgcaagtccccggagccgcaggacccgtgcgaggcccatccccaggcctatccgtgcgccctgttcgccacggcgccgaccgccgcggctccgccgcaggatccgatgccgcacgggaacgacccggcggcggacggcacgtcctag

SEQ ID NO: 8582 - DNA, 297 bp, Methylobacterium sp.
atgagcgcgcgacgcctactgcacacgagcccggagggcacgcgctggtcgctcgcccgcgcaggggcggaggtcttcgtcctgcgcgagggcggcggggcatccgagcggatcgggctcgtgcgtttcctcgacggcgacccggctgcgccggaacggcgcgccctcctcgacctcgtggcgaccctggcggaggtcggatccgcgaacgggcttgcggccggaccggtgacgggcgcgccgccggaggcgggcgcggccgcggccgagccctcgccgggcgagtcggcctcgtag

SEQ ID NO: 8583 - DNA, 162 bp, Methylobacterium sp.
atgcccgacacgtcccaggatcccgccaccccgcgcgccgtcgcctactcggagcgggccaagcggcaatccttccagaccatcgcgatcatcgccggcttgatcctgttcatcatggtcgtgttcggcttcctgttcggcgcgggccgcctgatcgcctga

SEQ ID NO: 8584 - DNA, 237 bp, Methylobacterium sp.
atgacccggcccgacgacaccggacccgagaccgatcccggcgaggcgccttccggggcgcgggcctacggggaccggcccgtgagcgggcggccgcagggcggccgggcgccgggcgcgagcgagcccgccgacatgggctcgcccgaagggaccgacgcggcggagaacgacccgggtgggcgcgagcggcccgatgaccggctcgagccggcgggcggctatcgcggccgctga

SEQ ID NO: 8585 - DNA, 156 bp, Methylobacterium sp.
atgggcctcttcgtcgtcatcgcctgcgccttcctggtggccgccgtgctggaggtgctggccttccggcggcgcaacgagctggaggcggaggggctcgtcaccgtggtgcgtccggagacctcgacctatctgaacccgccccggccgtactga

SEQ ID NO: 8586 - DNA, 408 bp, Methylobacterium sp.
atggacgcgctcggccctctcgtcgcgtccggtcggatcgtcgacctgatcctgatcctcgtggcggcggaggccgcgctcgtggcgctctcgccccgccggttcggcccgcgcgcgcccctgctcgccgggctcgccgcgggggcgggcctgctgctggcgctccgcgcgggcctcggcggcgcgccctggccctggatcgccggagcgctggcgctcgccggcggcgcccacctcaccgaactggccctgcggcgcccgaagacgcttcgccgcagggaaccatccgcaacatcggctgaggcgctggcgttgggttcggtctcgcgccgacacgaacgcatgaagcggcgtcgcccgccgcccctcccccgcccatgcgcgggcgagggagcgcgcggcgcttga

SEQ ID NO: 8587 - DNA, 339 bp, Methylobacterium sp.
gtgacgaccatcatccggcggggccgcctgcgcccggccctcgcggcggccgcgccgctcgccctgctggtcgccgcgacgctggtcgccgcgacggtgagcgcggcggcgcaggaatcctgccgggcgagcctcggcccgagccgcgcggcggccctggtggcgcgctgcgtcgcggtctcgcccgcgccggtgccgcccgctctcgtgccgcccgatctcctgccgccctgccacgccgccaatccctgcgccgtgatcgaggcggagatcgcccgcggctgcgacgacctcgacgaggacgcgccggatttctgcctggcctaccgccaccgctga

SEQ ID NO: 8588 - DNA, 204 bp, Methylobacterium sp.
atgaagatcgtcagcgagaattacgccgcgtgcttcgcgcgctcccatgaggtcgatacgaccgaacggctgatgctcgacgcgatcgcctgcaacctgcgcagcctctacggcgacgccgccgccgcggtgccggacgatctcctcgtcctcgcgggacgcctggaggctccgaccccgcctgcggacatccgcgcagcctga

SEQ ID NO: 8589 - DNA, 717 bp, Methylobacterium sp.
gtgctgatcgtgaacaagagctacctgatggagcacggtacggggacgctgggcgacctgcgccggaacggcaacgtggtcgcggtcgatcccgtcgacctgaagctcgcgccgggaacccggatcgatgccgatctcctgatcgccagctcgcgcatgcaggacgcgttcttccgcgagcacttcgccgatctgacgacgttctacgtcccgcaccacgccgatctgaggatcccgcctccgggcgaaccgccggcgcggttcgggttgggctatttcggcgcgctctacaacgcgcccttcagggaggagcttgccaccgcggggctgtgcgacttccacaaggccgacgatccggccgagaccggctggatggcgagcctgccgcactacgcctgccattacgccgcccgcagctggcagcccttcgacgggttcaagccgttcacgaaggggatcatcgcggcgcgctgcggcgcggtcgtgatggtcgatcgcaaccccgaggccgaagcggcgctgggcccggactacccgttctacatcgacgatacgagccttgccggcatccgcacgggcgtggagtgcgcccgttcgggcttcggttcgcccctctgggaaacggcacgcgctgcgatggcgcggctcgcggcatcggtgtccgaggaggctgtcgccgcctcggtcctcaacctgagccgccacgtcgggcgctga

SEQ ID NO: 8590 - DNA, 216 bp, Methylobacterium sp.
atggtgctgctgtacgtgtccgccgcttggacgggcgggatcctgaccctggccgccctgtggcagcccctcggtccggcgctcgcgctggtcgcggcgcccttgggcgcgagcgcggtcaccgccggtgcggcctgcctgatcggcctccgcgcgaacgttcggcgcggtccacctccgggcggcgtggccctcggttggccgctggcccgttga

SEQ ID NO: 8591 - DNA, 483 bp, Methylobacterium sp.
atgcagacgacgctcctcctcgctgccgccgcgggcctcgtgctgggggccggcgcgctcctgtacgcgggcatccgcatcgggcggccacggcccggcgaggtctcgccggcccctgggggcactccggtcgccgcgcgtcgcctcgtcggcacgtggcagggtcggcagggctacgccttcgccgtcgcgctctcccataccggcccgggcgacatcccgatcgacgggatcgcggttctggcgcccgcgggggcccggatcagcgtccagccggccgacgacgaccgctggacgcgcccgggacgccgccacgcggttcggtggcgcgccccggcggggaagcgggagacgatcgtccagtgccgcctccacctgcccgccgcggcggcccggacggggacgcgggtgcaattccgcctcaccggcgcaccggagaccgggaaccagggtatccacgtgatgctgacggtcgatctctga

SEQ ID NO: 8592 - DNA, 270 bp, Methylobacterium sp.
atgacacagcagcgtgatcctgccccattcgggaccgttgaggccgccagggagtacgtcgccgatctggtcggcggcatcctggcccacgctcaggtcgtgagcatctacgccgagacgggcgacgatgccggcctgatctatgcgggcaaatgtaccagcgcctacctgcgggcgctggaggcgggcatccaagagcttgagcggtctcgcgctgtcgtcgcctatcgacggtccgcccaagcagtcagcatggtcgaggaggcgtga

SEQ ID NO: 8593 - DNA, 432 bp, Methylobacterium sp.
atgcgaacggtcaaactgcggccggaaccggtgttgatcgcgctccggtgggagaatccgggcgatgcaccggccgagaccgcgaccgacccgctggtccccgcgatccacccctggatcgccttcctgctcgaaccctggctccaggcgatcgagcaggccgggcccggcacgacccactggctgcaggagaccagcgcggcgatgagcgcgtgcctcggcgagtgggtcgacccgaccccggcgatcgagcgggcgctggatggtgcccgcaccgcctcggacctgctcgtcgcctgcatcaaccgggccggctgggcgaacgcggacgcgcagcggcaggtcgcccgcgcggcgatgggcgtcctgatcgaggccttgacccaggccgaggccagcgagagcaagaccgaactcggcctcggcttctga

SEQ ID NO: 8594 - DNA, 294 bp, Methylobacterium sp.
gtggattccgccgagatcgattccgccatgcagccggcccgatcggacccgggcgccgaaggccccgccaagatcctcaccggggacgcggtcctgccctgccgcctgcggcccgagggaagcgcggcggcgcgcctgtcgctgccgagcgccgtcggcatcccggagctcttcgtgctctcggacgaggcgagcggcgacgagcgcctcgcccgcgtcacctgccgcaggcagggcgcggacggcgcgcggctctgggtgcagttcctcggcccggcgcgcctcgcagcttga

SEQ ID NO: 8595 - DNA, 336 bp, Methylobacterium sp.
ttgagacggatcgttctggccggcctgctggtgctggcatccaccgccgccgacgcggcctgccgctgcgcctgcgtcagcgggcgggcggtggccgcctgctcctcgcagggcgagatggagccgatctgctcgcagatctgtcccgagggcctgacgcccggcgcgctcgtcgagccgctcgtgcccgcgggcgcgatccggctgcccggccccgccctctcggacgacgaactcggccgccgcggcgccgagacgaccgcgccgaacggcagcttcaaccccgcgcaggggctcgccctgccctccgtcggcggcaccagccagccgcaatag

SEQ ID NO: 8596 - DNA, 81 bp, Methylobacterium sp.
atgcccgaagaactcttggtgttcggcctgtcggccctgaccttcgcggcctacgccttctaccgcacggcgcggccctga

SEQ ID NO: 8597 - DNA, 1200 bp, Methylobacterium sp.
gtgagggcgctcgacctcgccgggcttcgcgccgacacgccgggcaccgcccacggcatccacctcaacaatgccggcgcgagcctgatgccgcggccggtcgtcgaggcggtgaaggcctatctcgatctcgaggcggcgtggtccgggcacggcgcggccgagcgggaggcggagcgcctcgcgggcgtctacgcgagcgtcgcccggctgatcggggcggagcccgacgagatcgcgctgacggagagcgcgacccgtgcgtggcagatggcgttctacgcgctcgcccgcggtttccggccgggcgaccgcctgctggtcgggcgccaggaatacggcgcgagtctcgtcgccctgcggcaggtcgcggcgacgaccggcgcgcgcgtcgagacgatcccctccgcgccggacggccgcatcgacgccgcggcgctggcggccatgctggacgatcgcgtccgcctcatcgccgccaccgcgatcccctcgaacggcggcctcgtgaaccccgtggccgcgatcggcgcgctcgcccgggcgcgcggcatcccgttcctgctcgatgcctgccagatggtcggccagcgcccggtcgacgtcgcggcgctcggctgcgacctgctggcggcgaccggccgcaagttcctgcgcgggccccgcggcaccggcttcctgtacgtgcggcgcgcctggctcgaccggctggagccggcaatgctcgaccatttcggcgcacccttcgacggggacggctaccggctgcgcgacgacgcgcgccgcttcgagacctacgagcacgaccacgccgcccggctcgggctcggcgtcgcggtcgattacgcgctgggcctcggcatcgaccggatcgcggcgcggatcggtacgctcgccgggatgctccggcagggcatcgccgccctgccgggcgcgacggtgcacgatctcggccccgatcccgccgggctcgtcaccctcacgctggccgggcaggattccgccactgtccgcgccgcgctcggcggggccggcatcagtgccggcctgtcgctgcacgccgccgcgccgctcgacgcggcggcgcgggccctgccgccgctcgtgcggctctcgccgcacgcctacaacagcgaggacgagatcgggcgcgcgctcgatgtcctcgccggtctcgcacagggaagagtacagccatga

SEQ ID NO: 8598 - DNA, 243 bp, Methylobacterium sp.
atgcgcctcgcacacgtcgccctcgccgccgccctggcgctcgcaaccgccggaccggccgccgcccaggttctgtcgaacccgagctcgaccaaccaggcgctcaccaaccagagcaacagccgagcgaaccagatcggcaccacgagccagaacaacgccgcccgcatggagatgcagcggagccagagcgctcagccgcccgccccgcccaccggcgtcgtcggcgtcccacggcgctag

SEQ ID NO: 8599 - DNA, 180 bp, Methylobacterium sp.
atggacaggatctcggctggcaggatcgggctcgggagcggcgcccccctgcgggccggcgcgacgcgcgatccgcgcttcgtcgccccccgcagcacgcatcccggcgccctctggctcgccgccgccgccccgctcgcggcgacgctgctgctcctcgccgcgcgcatctccggctga

SEQ ID NO: 8600 - DNA, 432 bp, Methylobacterium sp.
atggcgggcctcgaccggatccgcttcgccaagttcgtgaagtgccgggccctgatggagggcggcgcgacggcgggcgagcgggcggcgggcgcagcgggcgcggcccgcatcgccgcggccgcgggcctcagcctcgccgaggcgctgcggctgaccgggagcggccagccccgcgagacacgccgggatgcgccgccccgccggccccgcccctgggagacgccgccgctgcgcaccgacccgatcggccttgacgagatcctggcccagaaggcgcggacggaggcccatcgcaagcgcaaggccgcccgcgctgccgaggcgcggcgagcggacctcgccgccgaggcggccgagcgggcggcgctccgcgaggcgcaggaggcgcgcgaccgggcctgggccgaggcgcgggggaagacgggctga

SEQ ID NO: 8601 - DNA, 183 bp, Methylobacterium sp.
gtgctgcggcggatcctgatctccgcctccctctacctcttcgtcgccgctgccgtgatggcagcggccttcgtcctcgaccggctggagccggacgcggacggcgcggtggtggatctcggcgccgatccgggcgccgagatcctgacgacctccgttacgtcctggacgcaggcgcgctga

SEQ ID NO: 8602 - DNA, 249 bp, Methylobacterium sp.
atgcgcaagcttcagtacgacaccgggaccgcagcggagcctgcgggcgcggcgcacgcggatccgaacgcgcgggcggccctccgccggctcgccgagatctgtatcgaggcgcacggcatcgtcgcccgcgagggaccggaggaggttcgcctgccgctggaggagctgctcggccggatcggccgccagctcggcgcccagccggagaacgacgtggcggccgagacggccggggccggccgctga

SEQ ID NO: 8603 - DNA, 273 bp, Methylobacterium sp.
ttgcgcgtggaacacgtctcggaaggcgatccgcaagatcgccccagtcccgggcgcaccgcagagctcctggccgagatcgccgcgatcctgcgcgtcgacccggtgatcttcttcgacggcgagatccaggagcgcgtgagccgggacctcgccgcagatgaactcgccgaattgctcgccctgttccggtccatcgacacgcccaacctgtgcgaggcggcgcacgacctgatccgaaccctgaagcgggacaggaaaccggattcctga

SEQ ID NO: 8604 - DNA, 729 bp, Methylobacterium sp.
atggttcggcaaagaccgcggccatcggctttgtcagcgccgcagaacttcatctccgagagcttggcgcggcggctgtatcgcggccacaggcgggtgctttggggtctcgtcgccgtgctgggcgcggcgggcgcgctgctggggtccgaacgcgtcggcgcgctccgaccctggtccgatgcgccgccgccgagccgcccccccgacgttccggtgcaggaactcgtacggcaggagcgagacctcgtggcgcgcctgaaagcgctcgatgaaccgaccgatcgcgcggccaaacctgcggaggcgaaggagacggagctgtcggcgcccgagccagcgccgaaggaagcgtcgcccagatccgcgccggctcgagagcgggacgagaccacggcgagcgtgctgccggctcccgcggcaccggaggccgacaaggccgtgccgcgcggacccgacgcgatccctggttcggacccgggcccaactcaaacactcgagcgggccggccgctatcttggccgtggccagtatacgatcgcccgctatctctatgaggaggcttatcgggccggcgaggtccaaggcgcgctcggcatggccaagagctacgatgccgcctacctccgatcgatcggacttcaggccaagggggacccgcagcgcgcccgcatatggtaccgtcgcgcggccgggttcggcgatcgctcccgaagatccactccctga

SEQ ID NO: 8605 - DNA, 366 bp, Methylobacterium sp.
atgcgtaagcttgctgccatctcggccgcagccctgatcggtctcggcaccctggccagcaccggcgcagaggcgcgcggacgcggcggcgccgtcgccgcgggcgtcatcggcggcctggccgcgggtgccctcgtcggcgccgcggcctcgaacgcctacggctacggcgcgccggcctacggttacgactacgggtacggcggcggctatcccgcctacggctacggcggctacagcgatgttggctacgcgccgacctattcgcgccgcgtcgtgcgcagctacgattacggctacgccccggccggctacggctattccggctattcctggggcggtcccgcctacggctacggctggtaa

SEQ ID NO: 8606 - DNA, 291 bp, Methylobacterium sp.
atgcagatcaagacgatcgccgtcgccgcctcgctggttctcggcctctcgggcgccgctctcgcccagagcacgcagccgggcgcggccggtgcgagcgatccggccatgcgcagcggccatggcatggaccgctcgatgaaccggatggacccgaacaccagtccgggcagcaccggctcgaccggccgcgagggcggcatgggcaacatgggcggcggcagcggcgccagcagcaacaccggcgtcggcctgggcaaccagggcgccaaccagggcgcgcgccagtaa

SEQ ID NO: 8607 - DNA, 156 bp, Methylobacterium sp.
atgtctctcgtcaccattctgctgatcattctgatcattctcgccttcggtggcggcggcttcctgggcggcggcgcctatcgcggccccggcttcggcctcggcggcatcctgctcatcatcctgatcgtgctgctcgccaccgggcggctctga

SEQ ID NO: 8608 - DNA, 864 bp, Methylobacterium sp.
atggatcaggagcagagcagtcggcccgatctcgcggacgcccgtcatccgcacgcgggtgtcttcgcgcggaccgcatgcgtcgaggccgatgtccggcacgccgtgcgccacgccggcccatcgggtgcgcgcatgcccgcgatcgccaggtcgcccgccgcggaggcggggacgctcttcgcccgcgccccggatttcgcggccctgggccccgaggcccgcgcggcgctcgagaaggccgcgcacaagcggcgtcacgcgcataacggcttcatctaccttcaggacgacgaggccacgcacctgtacttcgtcgtctccggccacgtccgcatcgcgtcgctgatggaggacggatcggcggtcctgcacgccatcctgccgcccggcgagagtttcggtgagctcggcgtcttcgacgggtcgacctgttgcgacatggcgacggcgatcgggccgacggtcacggcggccatctcggtgcagagcctgagggtcctctccgagcgccatcccgagatcggtgcggcgctcggccgggtcgtcgcccgccgctaccgcggctacgtgctgctgacgcgcgacctcagcctcaagaccctcgccgcgcggctcgcccaggccgtgctccgcctcgcgggccatctcggcacgcgcacgcgctaccgcgaccgcgaggtcggcacgctgggcagcacggtgacgcagaccgatctcgggctgatggcgcgcggctcgcgcggaaacgtcaaccgcgtcctcaagacctgggagcgggccggctggatcgccgtcgccgaccggtgcatcctgatcctcgaccgcgggcgcctcgaaggcctcgcggcggaggattgctga

SEQ ID NO: 8609 - DNA, 240 bp, Methylobacterium sp.
atggacgcggatcgctccgggacggaggcgtccttcggcatgaccgacctcgaggaagccctgcaggggccggaccgcgcggccgtgcgcgccgaagccctggcgcgcctcgacggcgcgctcctccgggtcgaggcgcgcctgcgggagggcctcgacccgcgccagttcgcgtcggcggagagcatccgcgccgcgctcgtcaccgcgcgcgggctgctcgccgccgcgccgcgctga

SEQ ID NO: 8610 - DNA, 309 bp, Methylobacterium sp.
atggcgggagtgggaacctacggccagtacggcgcgacgcaggcgacgccgaccgatgccttcacgcagccctacaagagctacgacggcttcgacctgatctggcgccagaacaacctccagaagcagatgaaggacatcgagacggatatccgcaacatcgagcagaacgcgaacctctcggacaccgagaagatgttctcgatgcagatggccatgaactcgtggtcggccatcagcaacctgcgcaccaacatgctgaagacggtgtccgacacgctgaagtcggtcgcccgcaacgtcgcctga

SEQ ID NO: 8611 - DNA, 1185 bp, Methylobacterium sp.
atgtccggttcggccgagatcacccggcagagcgttgcggccttcaacgcgatctcgcccgtgggcgccgaggtcatggaggaggcgcgcggcagctaccgcggcgaggccgttaccctcgcctccgacgaggcgaagctcgccgacgcggccgaggagatcggcatgtcggtcgcgcaccgggccgacaagaaggcgctcggccagcgcagcgtgcgccagggacaggcggcctatccggaggcgctggcgcgcctgcgcgagtacctcgacgaactccccgacatgccgcgggaggccgaactcgtcgacctcatcgagcagctggaggccttccaggacctgctcgcggggacgggggagggcggcgcgggcgcgacgaaggaggacgtgctcgccgccctccacgccttcgaccccgacgtcacccaccagttcgccggcctggagatggcccgcgcccagttcgaggcgagcggggcggacccggtcttcctcgccctcctcgacgaggcccgcgcaacctacgagacgagcgaggtcgcccgcgacgtgcgcgcgggcttcgcggcggcgggcatcgccgcgcgcgcggccgagaccctggagaccgatccggcggccgtgcgcgaggtctaccgcgcgatgctgcgcgacacgctgcatctggggcagctcttcgacgcgctcggcaggttcgccctgctcacgaagttcgagacggcggtcgagactttcatggcggcggccggccgcgacctcggcagcgccggaccctcgacggacccgctcttcctgcacggcctgctcaccgaactcgccaagctgaagaagatgcagtcggccctcgacgggatgagcgacctcgtccggctgaccgagcgaagcctgcccgccgggcagcgcggcgccgacgtggtcgcgctcacgagccggatcctgaacttcgcggcgagcacgggcgtcggtgcggccgacgcgcgccggctgctggggtccttcgaggatcaggcgctgccggttcagctcgccttcgccaacgggctgcgcgggctccacggcgagctgcccgacgacgtgatgccctcgctgccggcgcgcctgcagcaggtcggggcgatcatggcgctcctcgacgggatcgtcgcggcggaggagcgcgccttcggcgagggccagcgatga

SEQ ID NO: 8612 - DNA, 378 bp, Methylobacterium sp.
atgagcttcgggagggcgagcctgggcgtcgtcgagggcttcgccgcgcagctcggcctgccgctgcggcccgcccgcgacggcagcgtcagcttcgccttcgcgacgaccggaacgctctcgctgacgccctccgcggacggaagccggatcctcgtcggcctcgcccgcccgttgcgcgcgcccgatagcgggcggctggagcgcgccctcgcctgcgcggggctccagccagcgacgggccgcgtggtccgggccggcctctccggcgacgacagcctccatctcgtgctggagctgccggaggcggcgttcgacctgcccgccctcgatgtctgcctgcaggaactcggggccctgcacgatcgggcggcgtga

SEQ ID NO: 8613 - DNA, 186 bp, Methylobacterium sp.
atgccgatcagcacgatcagcgattttattcagttgtactcgaccggcatcatctcgcgcgagtgcctcgaacatgagatccgctcctggaccgacgcggacgaggcgcaggaccggacgcccgagaccgagggctgcatcgtcctctatccggatgcctcgggcatctggcgcgcgccggcctga

SEQ ID NO: 8614 - DNA, 402 bp, Methylobacterium sp.
atgagatccatcggcagggccatcgcccccgcgctcgccctggcctgcgccgcaatctccgccgccgaggcgcggcaggcggctccgccgcgcaacctcgagtgccgcgacctccgccgcctgagcgacaacttcctgctcgacctgcgcatccggctggtcttctcgcggccgcggcacagctacgtccgcctggagaataccgggcgcggctggcagccggtggcggagcggcgctatctcgcgatcgagccgacccgcatcgtgctcgcggacaacgccgccttcaccacctacatcgagcggctgacgggcgattactaccacgtcgatcggacgcggacgggtctgtcggtctggggccgctgcgccctcgcgggcgggctgaaccgtctgttctag

SEQ ID NO: 8615 - DNA, 2064 bp, Methylobacterium sp.
gtggccgaagccgcctccgacaccgtcatcctcaagatcctcaccggcatgcaggccggcgtcgaggtcgcgctcgggcccggcgagtacgggctcggcaccggtcccgaggacgacatccagctcatcgacgtcagcatccgtcccggccatgcgcggctgcgggtctccggcggcgccgtgccgggcggccggatcgcgctggcgggggccgcaggcgcattgcggaccgccgcgggcctgcggatcgagcccggcagcggcttccacgagatcgagccgctcgacgtcgtcaccgccgggaccacgcgcttcgccctcggccatcccacctcgcaatgggcgaccgttctggaggatgccgacgcgccgcccccgagccggcaggccgcgccgctcggcggcgagcgcctgcgtctcctggcggtgcccctcggcgccctcgcgctgctcctcgccttcgcgggctggctggtgctcggcggcggcctgacccggatcgcgggccggatggagggcacgcgcgacgatctcgcgctcacgcgcgcggccctcgaccagttcccgttcggccggacggtcgcggcccggcaggaggtggacggcgcggtctacgtcaccggctacgtcgataccccggtcgagcgccgcgccctcgtgggcgcgctcgagaaggccggcgttcccgcgcggacccgcctctgggtgctgcagaccatccgggcggaggtggagagcctgatcgccgcccagaagctgccggtcgggttccggctctcggagggcggtgcgctcaccctcgacgggctgatcctcagcgaagcccgggcgaaccggttcgtcgagctggtcaaggaccgggtcgtcggcctcgcggaggtgcagtcccggatccgcacggcgcagaccctgctcggcgaggtcgagcgcctcgcccaggcggcgcaggtccagccctacgtgctgctgcgcgtcggcgacgacctgatcgaggcgacgggggcgatccccgccgagaagctcgacgccttcgtgggcttcctgcagagctacgcccgccgcttcgcccgcgagatcccgctgcgctccttcgtgcagctgcagggggcgggcgggagcgagcgggcgatcctcgtggggggcaccgccaccggctccgacgtcgcgctcgatccggaccagctcgcccagggcgggtaccgccccggcgacatcgtgccgggcgccggcggccgcgtcgcgggggcgcgcgcgacgaccgtggtggccgatgcgggcggggagggggcgctcgccgcccggcgcgacgcgcccgcgcgcgcccagccggacaccccgccggcgcgctccggcgccgccgcgaacgcggaccgggacgcggaccgggacgcggaccgggtcggggaccggacccgcgacctgctgcggcgctggcgggagggccgcctcggcaacgatccgaaggcccgcgccctgaaggaggcgctcgacgccctgcgggccaccgacccggcggcgggcaggggcgcgacgccgccgggctggtacctgccggtcctcgcggacgcgccggaggccgagggggcgccctgctgggccgagacccggctgcgcccgcgcgacgccgtggcggccctgttctggctcgatctcctcagcaccagcgaggccgtctccctcaccgatcaggagcgggggctgcagccggtgctcctcgaggtggcgctgaaccccgtccgggccgccgcctgcgcccgccggacgccggagggcgagcgggcggccgcgcactcggtctacctgcgcgagatcggccgcaacccggccttcctccgcttcatcacccgcgacctcgccccgttcgggctggatctgacgggggtcagcctcgtgccggcccgctacgtcctgacccgcggcgggcgccggctgcacgagggcgccgcacccgaccagaccagccgcgtcgcggccatcggcgagctcggcgtcgcggtgcagacgaaggccgggctctcggcggtggtgttcgagcccgatctgagctggaagatcacgcagtag

SEQ ID NO: 8616 - DNA, 459 bp, Methylobacterium sp.
atgcaggacgtacatcaggcggtccaggcgctcggcgcggcgatcgggatggagggcgtcgcgttcgacggggccggcaacctcaccctaatcttcgacggcgcgatggcgatcaacttccacgcgatcgaggccggcagcttcgagctgtgggccgacctgcccgacctcggcaacacccgcgatgccgagctgctcgcctcggtgctcgccgccaatcatctcggcgagggcaccggcgccgcgcgcctcgcgctgcgcccggaccgcagcggcttcgtcctctgccagcgcgtggggatcgccggcgccgacacgtcggcgctggtcgagacggtggcggccttcgtcgcctccgccagcgcctggaacgcgcgcgacgccggccgggcgttcgccggccgggacgccgccgcgaccgagccgggcgagcccggcttcagcatgatccgcgtctga

SEQ ID NO: 8617 - DNA, 1122 bp, Methylobacterium sp.
gtgagcgagggcggcgagaagaccgagctcccgaccccgaagaaggagcgcgacgcccgccagaaggggcaggtggcgcgcagccaggaggtggtctcggccggctccctgatggcggtgatcgcctatgtctggctcgcctggggcgacatcaaccggcggctcgccgccctgttcgacgtggtggcgcagctcgccctcggcgagttccgcgtcagcgccgccaacggcctctccatcgtcggcatggaatgcgtgaagatcctggcgccgatcgtcggcgtgacgatcgtggccggcatcagtacgaacgtgctgcagttcggcgtgctcttcgccttcgaatcgctggcgccgaagctggagaagatcagcccggcggccggcttcaagcgcatcttctcgatgaagcagatcgtcgagaccctgaaatcgatcctgaagatcgtgatcctgtcggtcctgctctggtacgtgctacgcgccgcgctcggccccttcgcggtctcgatcggctgcggcctgccctgccagatcaacctgacgcagacggtgctgctccagaccctgctctactcggggctggccttcctgatcgtggcgctcgccgacttcgcctaccagaagcgcagccacatcaagagcctgatgatgtcgaaggacgaggtgaagcgcgagtacaaggagagcgagggcgacccccacatcaagggcaagcgcaagcagctcgcccaggagctggtgatgagcgagggcggctcggccgcccgcaagggcacggccgtggtcgtcaacccgacccacttcgccgtcgtgctgcgctacgacgagacggacgccccggtgcccgtggtcaccgccaagggccgcaacctccaggccgtgcacctgcgcgccgaggccgaggggtcgggcgtgccgatcttccgcaacgcgccgctggcgcgccagctcttcgcggacacgggcgtaggcgagacgatcccggacgagctgttcgacgcggtggccgaggtgctggcctgggtcgcgcgcaaccgcgaccgcctctacgcgggccgcctctcccacggcgtgatcgacatggaggccggcgaccaccggccgccggggcagggctga

SEQ ID NO: 8618 - DNA, 186 bp, Methylobacterium sp.
gtggcggcgatgctcggacggatctgggaaggcacgaaggtgaccctcgcgctgctggcgatgatcgccgccgcgctgatctccgccaacaagctcgatcacggcaggcgggatgccgcccgcccgggggacgtcgcgcggcaggcggcggaaccggcggtgaccggctccgtcgggattcgctga

SEQ ID NO: 8619 - DNA, 318 bp, Methylobacterium sp.
atggtcgagaggatccgtgtggtcgccccgcccgcgctgccgcccctgcgggatatccgtccgccgcccgcctggcgcggccgaacccccgatgccgcgcgcctcgcacgcctcaccctgtgcctggccgccctcgccctgcccgttctcgggagcaaagccgcggacacggtccaccgcggcggcgcgccgggaccgcagcaggccgccgtcctgccgaccccctccggccggacggcggctccccaggcctcccgacgcgtcccggcgttccgggaggccgccctcgcccatccggacgcggagccgatccggtga

SEQ ID NO: 8620 - DNA, 153 bp, Methylobacterium sp.
gtgacgacccggacgacggctgccggacccgctcgatccggaccccgcacccccgacatcgcggagggttgcggcggtacccgggtcatcgacttcgcgatctgcctgatcctggcggtgagcgtggtcggcctgctgctcgcggcgctctga

SEQ ID NO: 8621 - DNA, 309 bp, Methylobacterium sp.
atgccacggtacttcttcgacgtccggtccggatccggcctcgtctgcctcgactaccagggcctcgattgtgccgacgacgcggcggccctcgagacggcgcgccacggtgcgggcttcacctcgcacgcggactgcgcccgcaacccgcagctcacccgctaccgcttcagcgtgcaggacgccgagcaccggccgctcttcaccgtacccttcaccgagctcgagcccgatgctccgccggcccgcaagcgaccccgcggagcggggcgcggccgcgccggccggagccgctccttcatgcactga

SEQ ID NO: 8622 - DNA, 279 bp, Methylobacterium sp.
atgatcgatgccgtacagagcgcggccggcggcatggctgccgcccaggcgcgcttcaccgaggccgccgtgcaggtcgcccgcatgcgggccggcccctccggcacagggcagcccaccgggcaagctcccggaaccgacctgccggccgcggcgcggatcgagctctcgcaggcggcccaggagatcgctgcgtcgcgggcggacttcgccgccaacgcggccgtcgcccgcgccgcggacgacacgacgcggcgcctgctcgacgtgagggcctga

SEQ ID NO: 8623 - DNA, 186 bp, Methylobacterium sp.
atgcaccggaccgtccagccgctcgagggagcccgccgccagggtgcctgcgccggcttcgccgcgagcttccgcacgcgctacagcgaagtcgccgccgagcccctgcccgcccggcacgtcgacctgatcctggtcctccggcggcaggagcgcgagcgcgcccggggcgcggatcgccactga

SEQ ID NO: 8624 - DNA, 294 bp, Methylobacterium sp.
atggcatggtgccgaatgatctctctcgaagactgcgcgcgcgatctccgcgcctacatccgagccggaaaccgcgaggacctcggcgcagcgcagaatctgctgctccgcttcgcgctggaccagaaggacctcgcagcacgggcggcggccctggacgacttgcagatagagctcacaggataccgcgtgcccgacatgacgaaccatcagcgggccttcgacacggctgtcgcgggcatgatcgagcagaccaggagcgtggtcgcgcggcagatcgggcccgtacggtaa

SEQ ID NO: 8625 - DNA, 129 bp, Methylobacterium sp.
atgccggatcgcgagacgtctccggaaggccgcgtggagcaccgggcgctcatcgacgacacgggagggcagatcgaacacccgcaggaacggctcgacgccgcgaccaggtcgcggaagcacgcctga

SEQ ID NO: 8626 - DNA, 114 bp, Methylobacterium sp.
atgatcgccgcctcccgcaccgtcatcctcgagcaccgcgagatcgcgggcgtgctcgcctcctccggcctgttcttcgccggcctgctggcgctggcctgcctggtcggctga

SEQ ID NO: 8627 - DNA, 132 bp, Methylobacterium sp.
atggttctggaagccgcggtcaacggtcgtgcggacgccatcgtgacgttcaaccaagcggatttcggcaccgtcccgacgtcgttcggcatcgcgttgctcggtccagcggacgttctgaggagatcctga

SEQ ID NO: 8628 - DNA, 258 bp, Methylobacterium sp.
atggcagccggcggccattacgcccttcgccttcccgcttccctgaagcaggccgccgagacggttgcgcgcgcggacggcacgagcctgaaccagttcatcgtgaccgcggtcgccgagaagctcgctgctctcaagacggccgattatttcgcggagcggtcgaagcgcggcgacccggtcgccttcgaccgcttcatgaacaggcaggggggtcagccgccagcgccggaggatcagtgggacccggccggctga

SEQ ID NO: 8629 - DNA, 267 bp, Methylobacterium sp.
atgcgttcgacagctctcgccttcgccgctacgctggccctcaccggcgcggccttcgcgcaggcgaccacgacgcccggcagcacggtcggcaacccggcaggcagtgccgagcggaacctcaacaacccgggcagcgtgaagagcaatgccgagaagggcatgccgggccgcgacatgccgggcgcgaccggcaccgtggcgccgggcagcaccggcaccggcacgacgatgccgcccgcgggcaccgcccccgcggcccgctga

SEQ ID NO: 8630 - DNA, 1221 bp, Methylobacterium sp.
gtggtcgcgatcatggtgtcggtcgcagcgatgatcatcatcctgtacagaagtgtcctgcacgtcgaatccgccgatgcgcactggtggtttctgccctggctgaggcatatcctcgatcacggcgtcgtccagacgctctcgatcaaccttccggtgctcgtgcccgaggccaataatgcgggaaactatacgcctccatacctgtatctgctatcggtcggcagttacgcgagcgcgttcgcggacgatctaaccgtcatcaagatcgtgtccatctcgggcgcgatgttctgtgccgcctcgctggcttacctgctctcgggctacgctcgccgcgagatcgcgctctgcggcgcgatcgcctacctgctgctcccgagcgtcgtctcgaatgcggcggcctggggccagatcgagtcgttctacaccgggttcgtcctcatcgcgatcgcccgggccggacgggacgatctcgtatcctgcatgatcgccttcggcgtcgcggtatccatcaagctgcaggcggtcttcatcgcaccgtttctgctctacctcgtcatatcgcgccgggcctcggtcggcctcctcgtcatacctccgatcgtctacgcgctgatgatggttccggcctggatggccggacgcccggccctcgacctggcgatgatctacgtcgagcaatcgcacgcctatccgtggctctcgatgaacgccccgaacccctggacgttcgtgcagtacttccgtctgatccctcagccgaccggcatggtcctggggatcggcgccggcttggtcgtcggcctgacgatcgccggactcggcttcgtgcgcagggattccgggcgcagggacgaggggcccgagcttctgctgatcgccctggcgagcgcgacgctgatcccctacgtcctgcccaagatgggggatcggtacttcttcatggccgataccctgtcctacgccctcgccatcgctcacacgcgccgctggtcggtcggcgcagcgctcgcgatccagatcggttccttcggcgcgtatctcacgcatttcacagggtatcgcgtcggaaccggcctgggtgtgctggcgatgacggtcgccgtcatcgtgatctgcaaccgagtgctcggcctctggcatcttcggcagggcgcgcgatcgttcggcatccggggccgcgtcggcgaagggcagccggtggtggagcgtatctga

SEQ ID NO: 8631 - DNA, 591 bp, Methylobacterium sp.
atgagggaggccgcggaacgccggatcgaaccggccctcggaacggcgcccgggacctctctcggattgacgccgctccagcgcctcgtcgccccgggcgatcacgagcggatcgtgcggatcttcggcgccgaggccgcacccgaggcgacgcccgaggtggcgcctgcggccacgttcgaggccgagacggaggtcgccgacccgtccgatccggaagccgacctcgactggccgtccgcgatccagctcatccgcgacgcgggcggacgcgtccggcaggtgcgcgcgggcgccgaggaggcgacgcgccgggcgcacgccctcgtcggccgcagcgctcaggaggccgaggccgccgagcagcgcgcccgcgcggcggaggccgcggccgcggcggcgcagcggcgggcggagcaggccgaggcggcgctggcggccgccgaggctcggatgcgccgggccgaggaggagaccgccgccgcccgcgccgccgaggccgaggtgcggctctggctccgtcgtctcgtcacctgcctgaagaccgagttcgcggagctggccgagggcccggacgccgcgcgggcctga

SEQ ID NO: 8632 - DNA, 102 bp, Methylobacterium sp.
atgctctcaaaggccttcacctacgcgatgatcggcgccttctcctgcggactgatcgcgaccattgtcggatcggccgacgtgctgatgagcgtgaactga

SEQ ID NO: 8633 - DNA, 267 bp, Methylobacterium sp.
gtgacgaagacccggacgatcgccctcgccctcgccctcgcccttccgtcgacctcggccctggccttcagcttcagctacgagaggccgcagcgccacgcggttccgtcgcccccctacggcagccccccctccgcgggcctgggcgtgcatgacggggcccattacgagcgctgcaccgcgagctcggcggccgagggcaatgccaaccagcagacccggcccgtgaagcagtacgggcagaccgccggcggctaccgctgctga

SEQ ID NO: 8634 - DNA, 162 bp, Methylobacterium sp.
atggccaccatgatcagtctcgcctgtctcgccggcggcgtgggtctcgccgccctgtcccttcgccgcccggaccgggcggccaccctggagcgctggagcggcgtctgcctgctggccgggctcggcctgctcggcttcgccctgcagggaggccgctga

SEQ ID NO: 8635 - DNA, 87 bp, Methylobacterium sp.
atgagcagattcgaagacctgaagttcctcgtgacgctgacgctggtcgtgctctgcggcagcggcctcgacgccctgctgcgctga

SEQ ID NO: 8636 - DNA, 282 bp, Methylobacterium sp.
atggcaccgggttacgagatcgcgctctggctcgaagggctgggccttgccggcctcgccgtcggtctctggcgcctgcgcgtcgaggaagcggcgcgggttcgcggcctgagaacggtattgcgcacgggatccgatgcgcgcatcgcggccggcgcccgccccagggcggaccggacccggatgattccacacgtgacgggccggggcggcacgcgcaccgggaccgtgcccagcgccgcggcccacgccctggcgcgcgccttcgcacgcggggcctga

SEQ ID NO: 8637 - DNA, 1317 bp, Methylobacterium sp.
atgcagtccgcgtccccgatccccgcaggctttgcaggcccgggctggcccgcgctggccgccgggcgcgcgagcgcggagtcgcgcctcgtgcatctgccgtattggctgatgctcacggcactgaccttcaacgccgcgctcgccttcgtcaacggcaacgtcaagccgctgacgcccagcgtcgtgatcgccctcgaagccgcgttgacgctcggctgtctccttgtcgcgctcctccatcagaagcgcgagatgaacctcgccctggcgttcatcgtctggctgttcctcttcatggccctgcgcagcgcggtcgttgacccggcgacgagcgtcaaatatttccgcgatctcttgatcgcgccgacattcttcatgctcggcctgtgcaccgatcgtcgatacctcaaccggtacgtcctgatcggccacacgatcgtattcctcatcggcgccctggaagctttccggacggacctttactccagcctgttccacgtcaaggactacttcatcgcgacgcgcgggctgagcgaggccgacttctggaatacggattccgatctcttcgtcagcgcgacgcgcccgaacgcccgcttcctgagcatcgcggacgcggtgatggctaaccatcgcgtttcctcgatcttcctggagcccgtctccctgggcacctactgcatcatcgtctcggcctatgtcttcgccctctggcgcagcctcggctggaagagccgggcctacctgctcttcaccaacctgttcctcatcgccgcctgcgacggacggctcgcgttcgtgaccttcttcgccacgctgttcgtctgcatgttctggcggcggtggtctcgctatctgcccgtactctaccttccgggcatcctcatcgcggcctttgccttcgtgtatgtcgccgatcccgtgcgcggcaatgatgacttcgtgggccgcgtcgcctggacgacggatctgctggaatcctacgacgtcgcggaatacctcggcatgtccgaagccttcatcgagaaggcggtcgacagcggcatcggctacatcatcacgacgcaatcgatcttcggcctgatcctgttctggatcctgtgctcgtgttgctcccgctacgagacccgcgagcagatctgctacaaccacgcactctgcctctacgtctgcttcaactcgctggtcagctacggcttcctgaccatcaagaccgccgcgctcctgtggctggtgaagggcatcctcgaagtcgggcagacgacgccgggcacgggcgatgcgcgcccggcggcccgatccctcgcacgatag

SEQ ID NO: 8638 - DNA, 282 bp, Methylobacterium sp.
atgctgctctttctcgttgctgtggcggtcgtcggcgcgggcttgagcattgcgatcctgtggttgccggtgctgttgctcggcatccttctgttcctggccgtgctcatctacatggcgccgaccgaggggatctggcccgcgctcggctccggtgcgttggcgctcctgaccctccagctcagctacatcgtcgcgggcttcgttctcggcaggtccgagcgcgccggcgcgacgtccggcctcttccggcgtgccaagcacgcgcattcgaagaagtag

SEQ ID NO: 8639 - DNA, 642 bp, Methylobacterium sp.
gtgacgggtgtcctgatcgtggacgatcacccggtgatcctgcagggcttccggcgggtggtcgaggatgctggcgtcgcgatgatcgtcgaggccggcgatccggtctcgggctaccgtctgttccaccggatccggccgctggtcgcggtggtcgatctggctttccggggcagcgggctcgcggggctcgcgctgatcaagcgcatgcgcgcgctcgagccgcgggcccgaatcctcgccttcagcatgcaccgtgatcccgtcatcgccgcgcgggcgctggaggccggcgccatcggctacgtcttcaaggattcgccggtccaggatttcctggcggccttcgacgccgttcgagaggggaaaccctacctgccccatctgctcgcaacgcagatcgcaggtcttggcgcggtgcccgagccgtcgcgctacgacgctctgaatgcccgcgagatccaggtctccatcctgctccgggaggggcgcgattaccggttcatcgccgacaacctgtcgatcggctaccggacggtggtcaacacctgcgcgtcgatccgcaagaagctcggtgcgcgcacgcaggccgagcttctgaggatgatcatcgcggtggagaaactggaatcgcacgggtga

SEQ ID NO: 8640 - DNA, 147 bp, Methylobacterium sp.
atgccccgctggttgttcgtcatcctcgccgccgccctcttcctgagcgtggccggcatcgtcctcaccttcctgcggaccggtccgacggatcatcagccgtccgccaagccgtccgcggcggccccgcgcggcgccgcgccctga

SEQ ID NO: 8641 - DNA, 246 bp, Methylobacterium sp.
atgggcaccgggaaacgatacggcacggatcccgccgcggacgcggccgagatcccgggcgtgacattgcagcggatcgccgccgctcttggcgttccgatcgcggtcttcatcgagggcgtcgcggtcgagccccgtctccatgagacgctcgagctgctgcgcttatggtccctggtgcgcgagccggagctcgcgcagcgcgtcctggccttcctcgcggccgtcattgccgagcagagctag

SEQ ID NO: 8642 - DNA, 510 bp, Methylobacterium sp.
atgcggatccggatcgcgctcgcctgcctcgccgccctcatggatctctcctggggcctcgcgacggccgcccaagcccgaccagctcaagccagacaggctcaaacccgacctgccaccagctacgtctccttccaaccccaggtccgcggcctcggctgcctgcagccgcgcacgcgcgcgatggtcgcccggctgaccgcccgcgtcggaccgatcgagatcacctccacctgcggcgggcgccacgcccacaactcgcagcactatcgcggggcggcgatcgatttccgcccccgcaccgcctcggtcgcgaggacgctcgcggtgctgcgcggcatgccggaggtcggcggcatcggttcctacgcgggcggcctgatccacgccgataccggcccgcgccgcctcgcctggcacgggagcgtccgccaccgcgtcgcccgcgcgcaccgctcctacgcccgctacgcggcgcggcgcggcgcgcaccggtcgggctccgtctga

SEQ ID NO: 8643 - DNA, 285 bp, Methylobacterium sp.
atgctcaacggaccgttccaaggcctcccgggctcgtccgagggctggaccgcgcacgaggcgtggctcctgccgatcacggacggcgtcgccgccaaggctccggccgcctcatcgcccgccgacacggtgcgcgccgccgcgcgcccgctcttcatggccgccaacgggctggccctggcgctggccctgctgctcgccgccgagacctcgacgggctggatgggcggacagcgcggcgtgcccgtcgccaaggccccggtcatcaccgcgagcgcctcgtaa

SEQ ID NO: 8644 - DNA, 189 bp, Methylobacterium sp.
atgacgaagaccgacgtcgatacgcgccacgcgagcctgcagcgcgccgagcgcgcggcgggcgaggccttcggttggccggagacgcctgtcgaggcagcgcgtcgctccctgctcttcaatcccacgacaatcgccgccgcaacggcggtgacgacggtcgcggcgacgctgacctacttcgtctga

SEQ ID NO: 8645 - DNA, 213 bp, Methylobacterium sp.
atgtacgcccccagcgagacccaggtcagcgcctccgagagcgagcgtcgccagatggaccagggcgagtcgctctacggtttccgccccctcgcgctgccggcgctcgccgccgcggcccgcccgaagaaacgggaatcccggcccgccgtacccgcgaccggacggcagggcatcctcagcctcgtccacgaggacgagccgctagcgtaa

SEQ ID NO: 8646 - DNA, 294 bp, Methylobacterium sp.
cgggagggcgccatgactgatgccgtggccaatccgcagcacgcccggatcagggcgtcgggggacgagcgcctcctgcggatcgcggaactcgtcggctgtcccgtcgaagcgttccgcacccctgagggcgacgcgctcagcgacgcgctcgaactggtgaagctctgggagcggatcgatggcacgggccgcgcccgtctgctcgcctgcgcccgcacggaggcggcgcgcacgggcgagttgcaaccgaccggacctgctggggcaggcttccacagtcccctgcgctga

SEQ ID NO: 8647 - DNA, 1050 bp, Methylobacterium sp.
atgccggccgacgcggtcggcgtctggaacgccctggtcggccggaccggcgtgcccctgccgctgcgcggccaggccgcggcggtggtggagctcgccgagccgcccccggccgatgccctctgcctcgacctgcggctcgggccggaccttcccctcgtgctgcggccggtcgcctacccgttcgcggccgccttcggcgccgacctcgaggtcgccgacctgccgctcctgccggacgcgctccgcgatgcgctgctggcgggcctggtcgcgacctacacggcggcgatgccggatcacgatctcggcccggtcacgacccgtgcgagcgggcctctcggcgacctcgtgcggccggaagcggccgagggcctgcgctggttccgcgccgcgctccacggcgtcgcgccggggccggtcgcgctggatgtcggcgcccgcctcgacacgctggcgcggatcttcggtcccctcgccccgaggccggtctggccgggcatccggcaggttctgacccgcgaggccgccgtcacgctcgggcgcctcgtcctgccgctcgggcacttgcgcgccctcgcgcccggcagcgtcgtggtgctcgatgcgcgcgtcggccccgagcgcgcgcgcctgcggctcggccctgccctgttcgcgttcgaggccgcgggcggaggctggacctgcacggccgtcaccgcggccgcagcaccgcccgatcgtccggacgacacccgccaggaaggccccatgaacacgcttgtcccgaccaccgagacgcgggaggccgacctcgacgttgcctccgacgttgcctccgacttggccctcgacgtggccctcgacctcgacatcggcagcatcaccgtgccgctcgccgagatcgagacctggcaggtcggcagcctcgtcgccctcgcccccgagacgccgcgcgacgggctggaggtggtgctgcgggtgaacggccgcgcggtcggcgcgggcgagctcgtgcggatcgacgaccgtttcgcggtgcgcctcgtgcgcctcgcgctgggctga

SEQ ID NO: 8648 - DNA, 741 bp, Methylobacterium sp.
atgatccggacgaacccgccgtcgaacccgcacgcaaccgccgacttaccgacgggatacccgagcgataacacgtcaaacccgcggcgcgacccgttccgccagcgcgatccccgcgagggggcgccgcgcgacggactcggccgcgaggaccggcccggcacggaggcgggcttcggccgctcgctggccttcggcgagcgcatgcgcgacgcgatgcgggatcccggctccggcgagggacaggaggacgggcgggagcggcggcgcgaggacgagccgcgcctgctcgccgccgtcgagcccgagccggtgggcgttccgttgggcgcgcccgtgcccgccccggcggcgtccgtgcgcgaggccgggccggcggagaccggcaccgccgagcgcgtggcgcgcctctccgagcggctggaggcggccatccgcgcggaactctcggcgggcgccggccggacgctcgccctgcgcgtgcccctcgacgggctggtcccgggcctcagcgccgtcacggtggcgctgacgccggcagggctcgacgtgacgctggtccgggcagccggtgccggttcggccgatctcgccgaggccgcccaggcgctcgccctccggctgcggaaccggttcggcggccggggcgtgcgcgtgctggagcggacggaggcggccgagcctccggccggcgacgcgctggcggcgatcggccgcctgctcgggcgctccggcccgtga

SEQ ID NO: 8649 - DNA, 489 bp, Methylobacterium sp.
atgatcggacagatgaccattctgctgcgcctgaagacgctcaaggaggagcaggccctgcgcgcccttcaggccaagcgccggcaggtcgccgagggcgaggcggtgctggacgaggcgcgcctcgcggtgagcgcgagcgccgcgacgctcggctcccgcgaggacgcgatctacgcgggcatcctggggcaggtggtcgatcccggcaccctcgacgagacgcgcggggccgtggtcgccctggagaagggccatgcccgcctcaccgattcggccgagcgcgccgcctacaccctgcaccgcctgaccggcgagtgcgaggcggcggccgaggggcacagggcggccacgcgggtgcgcgacaagtacacgatcctgcgcgacgacctccgcgcgcgcgccgccgaggaggcggaagcgcgggaggaaggcgaggtcgaggagctgttcggccggcgccggccgggtccgggagagcggccatga

SEQ ID NO: 8650 - DNA, 657 bp, Methylobacterium sp.
gtggtcgcctattatcgcctgagcgagctcggctaccgcctcgcgccgggcctacaggtgctgcccccggaggcgttcgagccggtcccggcggcggccgccctgctgcgcgacgccgaggcgcgcgctgcggcgatcgtggccgaggccgagcaggaatacgcgcgccgcagcgcgcagggctacgcggacggcctcgcccgggccgaactcgaatcggtcgagcggctgctgcgcgagggcgcccagctcgatgccggcctgaaggcggtcgaggccgagatggcgcgcatcgtcatggcctgcgtgcggcgcctcgtcgacagcttcgacgacgaggcccgcacggtcgcggccgtgcggggcgcgctgcgccagatgcgccgcgagcgccgggccgagctgcgcgtcgcgcccgcccactatgccgccatgcgcgaccggatcgccggcatcgtggcggatttccccgaggtcgagttcgtcgacgtggtcgaggacccggcgctcgtgcccccgcagatcgtgctcgaatcgagcatcggccgggtcgagaccgcggtcgatgccgggctcgacgccctggaggcgatcgtgcggggcgccgccgcggggcattccgacagctcggccgacccggccggggcggcggcgtga

SEQ ID NO: 8651 - DNA, 741 bp, Methylobacterium sp.
gtgatcccggccgtcgcgctcgacgccgatcccgcggccgaggtccgggcgctcggcctcgcggcgcagatcgcggcgcgactggtgcggccgatcggccatttcgcgcccggtgcctgcccgctgccgccgctggagccggacgcgctcgcggcgctcgctgcccatccggccttcggggttccggtccagcgggcggcttcgcacgctctggcggcggaagccgcggggatcgacgcgggcctgatccggcgcctgcgcgaggccgcgacgacccggctcgccgcgctcctcgtggtgcagccgttacccgttctgcacgaagccgcgcggctgctggccggcgccatcctgcaccggcgcatccttgccctggtgctgaaggccgaccgcgagcgcctgcaggccgcgctcggccccgccgctttccgggtcgccacccaggaggccgccctgctgcacgcgggcctcgccgaggccgccgagcccgccgcgcaggccgcctgcctcgcggcggggagcccggacgcgacgcggggcgccgtcgtcgctctcgggctcgggacgctcggccgcttcgccgcggcggccgagccggccctcggccggctcgtcgccctgcgcctcggcgccgagccagggatcctgaccggaccgcccccgctcggcccgggggcctgcgagcacgtcgtgaggctcctacggcggaggatggacgcgtggtcgcctattatcgcctga

SEQ ID NO: 8652 - DNA, 498 bp, Methylobacterium sp.
atgcccgcgttgagcatgcaccatctgggcgtcgggtcggccgccggcgcgctcggcgacgggctgcgcgaagtcggcggcgtacagcgcgcagcttttcgggatgcgatgacccgcaaatcggcgaccggcccggccctcgacggccccccgccgaccgagccggcatcggttgctcaacccgttgttccggtccagcgcgtcggctttgagaacgattctgccgcgcgcgaccgcgtccggcgtacccttgaactcgacggcgcagtacgaccgaacgacggcgacactatcttgggagggctgcagaagctgcgcggcgcctttgacgcccgacatgcgcgcgtcggcgagatcatggcctcgaagagcgtcgacaccaacgcgctgctcgccatgcagatggaggtcgcccagtacaccctgctggtcgacgtgtcctccaagctcaccggcaagaccacacaatccctcgacaccctgatgaagggtcagtga

SEQ ID NO: 8653 - DNA, 375 bp, Methylobacterium sp.
atgttcgaaaccggtcaacttctcgatgccggcgatgtgcgcctactggtcgagatgggtttcactgccctctcccgtgggcggctcgccgaggccgcgacgatcttcgcgggcgtcgaagcagcccggccccgtgaggaggctggcggcatcggccgtgccctcgtctgcctgcatcgcggcgcagtggacgaggcagtgcggatcctacgcgttctgccaccttcggatgctgcgcgggccttcctgggacttgccgtcgcgcgcagcggcgaccaagcggaggcccgcgcgatcctcaccgaagtcgtggagaatgcgtccggcaccgcctccgctgggttggccgcagatcttctggcaggtttgacgtga

SEQ ID NO: 8654 - DNA, 555 bp, Methylobacterium sp.
gtgcgcgacgtgctgacgctgcccgagagccggatgggcgtcctcgcggccggaggcgggtccgaggtcggacgcacgaccgtggccgccatcctgaaggccgtcggcgaggccgatgcggtggaggacgcgatcgcccggctcgtcgcccagcacggggcgcacgcctgcgaagtgaccgagctgggcgggtcgctctacgcgcgggccgccgcggcggtggcggagggccgcattaccgaagccctcgcccccctgtcagcgctcgcaggtacccccggacatcgggcggaggcgttgctcggcctcgcggtctgcgcgacccgtctcgcctgctacgaggacgccaagatcctcgcggaggcgagcagggggctcgggcccggtcatccgcgggcgagctgcgtggccggcctgtgcgaattggaactcggcaaccgccgcgccgcgcaggaacacctcgccaccgccgcgcgcctggcacggcgcgatgccgcttacggcgaagacctgcgcgttgctcagcgcgccctcctcctcatgcacctcgcctga

SEQ ID NO: 8655 - DNA, 399 bp, Methylobacterium sp.
atggctcattccggcgggcgcacgggcacggtgcgctggacctcgacacaggatgcaggcgatgcggccgaggtctcgtccgagatcgaggcatggctcgcccggcagcccgcggcggcggattgggcgggcgtcctcggtgcgctgcgcgacgggctgctgcgggccgggctcgagccgggactcgcccgcgacgccaccgcgcgagagatcatcgcgggcctagcggaggccgaggatctcgaggcgatcgatgccgctctggcgggcctctccgtacgggtggacgcgctcgttgcgccgcgagagcgagcgggccgcggccctgcgcgcccgctcgccgaactcatgaccgaagtacgcggcgccggccagcgccgcgaccggatccggctctga

SEQ ID NO: 8656 - DNA, 381 bp, Methylobacterium sp.
atgaagatccgcaacttcgacatcggcctggaagcctacacccgggttggtcccggggaggatccgcgcctgcccagcgagggcgcgccggggccgagcttcattcccgagccggctcatctcgacgccgtgctgcggcgcccctctctagacgagcggctgccgcaggtactccagcctcctgccctcgatgccgacctgctggagcccgcggtgctgagcgaggtccgccgcggcacgcgtgggctgttcgcggaggcggcgcgccgggccgtgggccagcgccgccgcatcctcgaggaggccgcgctcatcctcgacgaggacgccgtgctggacgcggacgtgcgcagcgcgctcgccgccctgctcaaggcctga

SEQ ID NO: 8657 - DNA, 426 bp, Methylobacterium sp.
atgagcacgctgccgcttcggccggattctggcctcccggtcgatcccggcgccccgaacctgcaccccgaccggcggcaacgcgacttcctgctcctgacgatcttcgtgttggcgcagcagggctatgtcgaccgcgccggcatcctggccgaatcgctgcacctcgtcggcgacgcctcggccgagacccagctggcgcgggcggtgttgcgcttcttcgcgggggatttcgctgccgcactcgcggtgctggaggacctcgaccgcctcgcgccgatcgagcgcttcggcagctaccgcctggacgagcgccagcgcatgcgccgctacctcaaggcgcgctgcctgcacgaggtcggcgagccgggccgcgcccgcgacgccgtcgagatctacctgcgtcaccgcgctgacagcgtctga

SEQ ID NO: 8658 - DNA, 564 bp, Methylobacterium sp.
atgccctcgatcctcgatggcctgcccaggacccaagccgaattgcagaaggcgcacctcgctagcgcgatccagttcggcgagatcgtcgcgcaggccgatctcaccgcccggtcgcgctcgatcatcgacgcaatgggggagggtctttccctcggcgatgtgctcgggatcactcgcgaggagcgcgacgcgctgttggtgcacggcttccggcaactccagcaaggcgacgcggccggagcccaggtcaccctgacgcagctctaccacatcgagccgatggacgagcgcgtgatctacgcgctcgccgccacctaccaggctcaggagcagtacgcggccgcggccaagctttacctttgcttcctggcctacgacgccaccaacccgcagggctacctgcgcatcgccgagtgcttcctggccgcgcgcgagtacccggaagcggaggcgtacatcgaggcggcacgggtgcaggccgccggctctgcgtgcgaggccgatgtcgatcgccacgctggcgccttgagcgctgcgatccccgcccgacctgctgcctga

SEQ ID NO: 8659 - DNA, 159 bp, Methylobacterium sp.
atgacgctgttgctcgtcgtccttctggccccgctggtcgccgcgatcgtcctcgcgggcggacggcccggcccgatcatcggctgcctctgcctgatggggatcggctgcctgatcgcctgctcgggcctgacgcgcctggttcgtcagcgcgcctga

SEQ ID NO: 8660 - DNA, 720 bp, Methylobacterium sp.
atgacggctacagggacagttctcaccgacctgtcggccaatctctttgcggcactgctactgatcctgctgatcctgcttcaggccggcgccgacaggtcggacgaggggccggcgcagccggtagaggcggcgcaactggcagcgcgggagcacacgccactggacgccggtgcactcgtcacggccctgtatgaccgcaggcctgaagcagccgggctctccatcgacctcaccgaagcggaacctccgccgctcgacgcggtcgtgcgcgggcttgatccggatctgccgatccgcctctatgtcttctcgcaccgtcactactccgcaaccgccgcgctcctcaggaagatgggccggcgctggcaggaaatctccgtaccgcccgtactcggcgatgcagcgacgggctggacgtcggctttttgcgccctgctggcccgcaggcccgccccaccgcagttccgcgcggacctcgcccacctgctcggcgccgctgccgggccaccgctccgaggttcaggtggcgcgtccgatccgcttacgtccagcatgctgaggaaccccttcggcggctggctcggcgcggttctcaccatcgcgaccctgctcctcggcttcgccgccgtgctggcgatcgagtggattgtgccgcgccggctgccttgctacgcttgtcggcttgacgccaagaggtatgagggcccccgaccgtga

SEQ ID NO: 8661 - DNA, 489 bp, Methylobacterium sp.
atgctgcctgagaccgcagtggaggagggacccgagatcgatcccttcgccgacctcctctttgccctgatcgcgacagtcctgccggcgatcctcgttctcttgcccgtgctccatctcgcgacaccgcgccggtccgcgccggcctcggcaggggtggctgtcgggggacgcgaggccgcaacgatcgtcgccgaggcggcaggcctgcgcctcgtctcggcggacaaccggcagatcgcgctgagcgcagtcccggttgatcctggcctacgcgaatcgctcatgtccctgcgcgcgacggagacgccgctgcttatcctgatcgagccggccggcctggaggctgccttcctgctggagccgatcgcggcgtcctacggcccggtccgaatcatgcagttgcgggctgcgacgcggtgtgtcgaagctcgagacccggcactggcccaggcttgcgccttgccggtcaggacgttcgtgcgatga

SEQ ID NO: 8662 - DNA, 1158 bp, Methylobacterium sp.
atgcggcctgagcgagcctcggtcctcacgcgggaagtaggacgctcgaccgagcggctgcgcgtcgtcgcctatgggatggctctctgcatcgcctttgggctctacctgctcgttcacggcgccgggcaggggccgaccttctggtcggcttcgcttttgtgcggtgcggccatcgccgcgggtcttgcgcgtggcggaccgagcgcccgagccttccgctggggtgctgccggcgcagctctcatcgccgccgctctgccgctgctgccggcgctggcggagggcgcaccgatggaagctgcggtgcgcgttcacccgctgtggccgcagatcctggtgactctgttcgccgcccgggcactcgaggaggtgaatgagcagcgcttcgcagcgttctggcgggcgcctctgcgcacccgcgaacccgtcgccagccagtccattgccgccgcgctctcgctcggagcgtgcttcgcgctcctgttctatcagggcttgacccttctggtgccggttcagcaggggggcggcaccggcctcaccgatctcgtggcgcatgcgcttgccggcgagagcgcgatccaccgggccatcgttgtgctgttctgcatcatcctggccttcctgtgcgaggctgtcctccagcataggcgcgatcgtgcggcacttgccgccctgcgacaggcattggcgcaggggcatcgcacgacgcctgaggatctgcacggcctgctcgctgggccgctcgccggcttcggccatacacgaaccgtgagggctctcgcgcagggtttacggagcggcggcggcgcgccagcggaggatgctttcacggcggccttcgcggcctttcatggcgcatcacgccgcttcgtgcgtggattgctgcccttcctcccgctgctcggattcttcggcaccgtcgtgggcctcgcgaccgcgatggccgcactgccgacggagggcggaggaggacggatcgacctctcgggcagtctctcaggcctcgccctgaagttcgagaccacgctgctcggcatcctggccagcatggtcgccgcgctcctccttgctctgctggagaagggggagcaggaactggccgcggaatgcgccctgctcgcagcagtcgcggagcgtggccatgctgcctga

SEQ ID NO: 8663 - DNA, 1188 bp, Methylobacterium sp.
atgatcggcgagacgttgggtgagataccggttgcggtaaccagcaccgcaggggttgcacccggcatcgcgttgacgtcggcggggctctcccgcagcttcggagccgtgctcttcacgggcggtgcctccgggctgcgccctccgcggaacgtcgaggacgcggcgatccttttagcggaggccgctcttatgattgacgcggcgcggcgtgcggcaagcgatgcccggatcactggggcgaccgcctccgtgcgaggcggactggggaccgccgcggcgcagatcgctgtcgcgaacgacgcgctctacggcgtcgacgaggccggtggcggcctgatcgatcagaaggccgcagcctcttccgatcgggataccgcggtggctcgggacgtcgtcctcggcagcgaggtcgcccggctggagggtaggatcgtaacccttgacggagagatggcggtggtgcggtcggaggccgacgcaaacatcgcgtcgctcacggacgacaaggatgcgaagacggcgcagctcgcctcccttgatacgcggatcgcggcggcgctcagtgccaatgacgcgggcaaggtcgcggcgctccgggcggagcgcgcgacaatcgccacggccatagcctcgatcaatgggcaaatccggacgacccgcgaggaagccaacacccggatcgccgcgctcgcagcgcagcgcagcgcggcgacggctgaactcgctcaggcgaaagccgaacgcgccgcggttcggtcgcagatcgtcgccctcgacgcgcgcatcgccgaattgggcatcgcgatcatcgaggtcgaaagcgagctcgccctcgggcggaccgcgctcgtgatcgccttcgcgcagatggcagtgctggtgcaggacagcggcggcgaccgggcgttggagaccatgcgcggcactgagctcgaccaccgtctcgacgagttggaggaggctgcgaaggatcttcgggcgcgcctgctggcgcatttcgaggcggatgcccgcttggccggcgatcgccgagacgcgcaagcggacgcgcgggtcatggcggttgtcctcggtcttttcaccgctctggtggacgtcacggatgtcctgcgccgtgaggccattccgtcctccgaagcggatgactccgcagggcgcgcccagcggcgccgactggccctctga

SEQ ID NO: 8664 - DNA, 594 bp, Methylobacterium sp.
atggttgggcgtcaactgtcggcgcagctcggtcgtgggggaccggagctgcgctcgaagctccccgcgctggaacgcgcgggcacggatagcgaacgcggcgctgcgcaacaggacgccggctctgcggccctggggagcgccgcacaggagcgatcactttcggacgcgcagggactgcccgccctcaacgcttggagccccgccatcggaatcgccgccgagcagcaggtcgagcgcgctggcatcatcgcttccttcatcctcaacgccgccacgatacctggctggccgccaccgcgacctttcgcggcgccagcgccggagtccgttcgtgcggctctcatcatgacgccgggcctgtccgaggccgggatcgaggcgcagatgcgccgggacggggtgcgccgcacgctgctcgcccgcatgcgggctctgctggcccgcttgacccattcgcgccgcctgcaggtgatgctgggtctcaccatcctgctcggagcgatcgcggcaatcgaggccgaactcggcgatgtcgcgcgcgatactgacacggatgatatagaggcgggacgccgcaagctcagcgtctga

SEQ ID NO: 8665 - DNA, 579 bp, Methylobacterium sp.
atggtggcttcagatccggcgcgccgagatccattcgggctcgacccggaagagagcgcacttctggcctcgctcttcgtggaggccgccgccgacctcggcctcgacggcgcccgcatctacgcggccctgcgtgcaggccagacgctcggcgcagcgctcggcctgccggacggcgtcgtcgaagtcctctatgcgcgcgctcacacttggttcgcggccgggcgcagcgaccgggcggagccactgtttcgcgtactctgcgcccttgatggagcctgcgccgatcactgggtcggccacggggtctgcctgcatctgcggggcgccgattccgaggcgaccatcgccttcgctactgccgcagcgctgcggccggactgggccgtgccgcacttccacgccgcgggtctcgcggtggcccaaggtggctgggacagggccgccgagcatctcttcgccttccgggagcggcaggaccgggacacgccggaggcgcttgtccgcgaagccggacggcttgcggcagccctggctcagcgtggagaccggagggtggcgaaccgggagcgcgcctga

SEQ ID NO: 8666 - DNA, 489 bp, Methylobacterium sp.
atggaagcactcagcccacccggctccggaaccgagaccgcagcgctcctgaacggccacctccgcgacgcgctcgggcttcggtcggcggatctcgcgatcggcctggaggtcgcccgcaaccttctgcaacgcggcgcgaacgcggaagcgctgcgggtctatgcaggcctgatcctgtgcgagccggcgaacgccgccttccagacggggctggcgaactgtgcgctggcagcagaggagtaccaccttgcccttcaggcggcttccgcggtggtcgcgctcacgccgcgcgacccgcgcggctatctgatttccggccgcgcctgtcttggactcggcgccctcgcagaggccggcgaggatctgcgggaggcggtcgcgcgcggccgagaggcgcgagatgccgtcgccgtggaggaagcgtgccggctgctcgacgcgctgccggaccctgctcgcgaagccgatctggccgagaccaactga

SEQ ID NO: 8667 - DNA, 456 bp, Methylobacterium sp.
gtgtcacgcgagaccttcgcgagcgtggcggcggccctgtgggcgagtctcgggctcgcgccgccgcccaactccggaacgccgaccctgcggatcgacgggcgggcggtgcggcttgcgccaagtccggacgggatgcaggcggtgatcgaggtggcggtcggcaccctcgcggtggttccgcaccggcgggaggcacagctgcgccagatgctgcgcgaggggctcgggctggtcctcgacaaccgagccgccctcacattcggcgcggacggcaccgtggtggccctagcggcgggcccctgccgggtaacggaggtggcgctgctgcgtgggctcatcgaggatgcgctccacctcgccgagatacacggcccgacgctcgccgacgcggccggacccgaaccggacggcgggcttccggaggatgctgggagcctgatctttcgactatga

SEQ ID NO: 8668 - DNA, 915 bp, Methylobacterium sp.
atggccatcggttccttcccgacggagctccgctcctacctcccggccagcctgctgcaggcggacggcgccacgctcaagcccggcatcgacttggcgcaggctgaggcgcttgccaagaacgtccaggcgcaggccagtgcgctgcccccggcggaggcccgcctcttcctggcgatggtgtcgcaggccgacctcgcgccgaacggccagatcccggccgatatcggcaagacactcgccgcgttcgagggcgcggcctcactgctcgcgcgctcgagcggcagcacgctcgactttttagcgcgggttatgatcgagcaggccgccgagcagcgcaagaacgccctcgacagccgcttgagcgcccgcgagcaggccaagagcgaactcatgaaccaagccgcgaagatggagaaggcagccgaggaatcgaagtcggcggcataccaagcgatgatcacgaccgtcgtgatgtcctcggtcgcgttggccgcctcgaccacgggcgcggttctgggtggcctttccgccgtgaagcagggctccgccttcaaggacgccatcgcgagcgggaagacgatcaaggaggcggcaacgagcgcctccaccggcctttccgccgggtggaccaaggtcggcaaggctgccgacggtctcggtggtgcccagcaaatgggccaactcggccaagcgggcgggggctacatcagcgcccagggcgaggccgtggcaaagacgctggacgccgagggccagcgcgaggcggctcgggcccaggacagccaaaccaaagccgacctgtcgaaagacagccaggaggcgctgaaccagatgatccagtcgatcatccagttcctgaaggacctgcaggaggccaaagccgagcagatgcgcgccctcacgcgggtctga

SEQ ID NO: 8669 - DNA, 945 bp, Methylobacterium sp.
atgagcggcgtgatggcgagcctctcggccatgatgccgaaggtcagcgctcaggataccgacgttttgctcctgcagatcacgaccaagctgaaggagacgaccgaggcgagcgagaaggacaagatccgggccgacacctcgaacaagaaggtccagatcgaagaaaaacagaggaagatggacgaggcccaggaaaaaatcaaagccgctgaagacaagatgaagaacctgtccatctgggacaaaatcaagatcggcttccagtttctcagcgccatcatgacgatcgccgcgggcgtcatcgccgcgctcgtcggcgcggcggcggtcgcgaccggcgccctctcgccagccggtgtcgccgcgatcgcgggcggcgtcatgatggtcactgcgggcgtgctgatgctctactcggccatcgacgcgtcggtcgcggcctcccgcgaggacgggctcggtatcgcgggcctcatcgagaaggacaagctcatggcgcggggcaagaccgaggaggaggcgatccaggggggcgccgagaaggacaagctttcccgcaccgtcatcggcgcggtcacggcggcgctggccattgcgggcgcgatcgcggcctttccagccggcggcggcgcggccatcctcgctcttgccagccgggtcacgggcgtcgtcagcgcgatcagcaccatggccaccagcgcgggcgacatcacgaccggcgtcctgaagtacaaggccacggaagagaagtccgagggtcaactgaagcaggccgatggcaagcggatggaagcgaccatccaagtgctcgatggcatgatcgaccaggcgatgacccgcctgaagggcgccggcgaccgcttcaacgcgatgctcgacagcctgaccgaggcgatccaggaccgcggcgacagcctgtcccgcgtcggtctgagaggttga

SEQ ID NO: 8670 - DNA, 396 bp, Methylobacterium sp.
atgtcgcgcctcccctcgccccaccgccggcgcaccttcgggctgctcgccctcgtgctcatcggcacttccgctcaggcggccgatttcgatggggcctaccggccgcgcccggatttcgggcggggcttcgaggaggattacgggcgccggccgcccccgcctccgccgccacgcttcccgcgcttctcggccggtcccgatctcgcgccctcgccgtgccgggtcttcgtgaagcgccgcttcgatgccgacggcgagccggtgatccgccgggtgcgggtctgcgacgagccggacgatctcggtcccccgcgccgcccgcgcttcgatccgcccccgccgcgcgagttccccgatgagccccggggccgctgggacggcccgcgctggtag

SEQ ID NO: 8671 - DNA, 120 bp, Methylobacterium sp.
atgctctcggttctcgtctcccagtgccccgcccccgagcaggaggcggtcgaccgcgatcccggcctgctgaccctcgccttcgcgctggcccgaagcctgcgccgccgcctgacctga

SEQ ID NO: 8672 - DNA, 1170 bp, Methylobacterium sp.
atgcgcgacgccggcggcgacaccccgctccccgacgagcccgccaccggcccgcacgtcctgctgatccagccgcaggcggagaatgccggcgcccaggccatcgcccgcatgctggcgacggccctggcggagcgcggctaccgcacgggccagatcttcttctaccgcaagaccggcgccttcgacgccgagccgggcatcgccttctgcgcggccgagcggccgcgcacgccgctggccttcgggcgcttcctcgtcgatctcgtgctgcgcctgcgccgcgcgcggccggacgcggtgctctgcttccagcactacggcaacatcgtcggcgcggccgccgcgcggctcgcgggcgtgcccgtggtgatcgccaaccagaactccgcccgcgacacgaccccgccccgcgcccggctggtcgaccgctggctcggcgggttcggcctctacggccggatcgtggtgaactcgcacgattcggcgggcgacctcgcggattacccggcgcgctaccgcgcccgcgtagtgcatatcgaccacggcttcgtcggccgcggcagcgacctcgccccggccgaggcgcgcgcccgcctcggcctcggcgtccccccgggcggccgcctgctcggctgcgtcgcccgcctgcacccgctgaagaacctggcggcggccgtgcggctgctccctcacgatcccgcctggcacctcgcgctggccggccagggcgcggagcgcgacacgctggcggccctcgccgaccggctcggctgcggcgcgcgcctgcatctcgtcggcgagttgccgccggaccgggtcggcgacttcctgcgcgccctcgacgccttcgtcttcccgtcgcgcgccgagaccttcggcctcgcggcggtcgaggcggcccaggccggcgtgccggtcgtcgccaacgccctgccggtgctgcgggaggtgctggcgacgggcgcgggtccctgcgcgctcttcgtcgataccgaggacgaggccgccttcgccgaggcggtgcgccgcctcgagcgcgagccggatctcgcggcccacctcgtgcgcagcggccgcgggctcgccggacgtttcccggtcgacgcgatggcgggggcctatgacgacctcctgcgcgcgcggatcgccgaggcgcgcggcgcgtag

SEQ ID NO: 8673 - DNA, 1362 bp, Methylobacterium sp.
gtgaggggcctcgccctgccgcggctgcgcgacctccgggcccgggcgggcctgcgcgacctcgccctggcgctcgtcctcaaggtcggcggctcgggcctcgccttcctgatgctgacgctcgccgcccgggccatggggctgcacgagttcggcgtgttcgcctactggttcagcgcgctctccttcgccgccgccgccgtcctgctcggccaggaggcggcgatcatgatcgactggcagcgggggctcgacgcgggcggccccgccgccgcccgggcggcgctgcggcgctccagcctcgtcgtgctgctcgcaggcctcgccgggggcgccgccaccgcctgcgccggtcatctggcgggggcgggctggctgttctccgggcttgccggtgccttcgcggcgctgctcgcgggcctcgtctacggcacccacgtggcccgggtcgtcgccggcatcgcgcagggcgacgggcagttcgagctgacctggcgcctgttcccgaccgcgggcgcggcgctggcgctcgtcgcgggcctgcccttccacgccgagaccttcttcgcctgggcggccggggggatcctggtggcgctggcgatccagggcgccgggatcgccgccgcgctgcggggcgtgcccgccggggcgggggccgccggcctcacgcgtgtgcgggcggcgcccgacgccacccgcgcctggatcgcccgctcggcccggctctggctcggcggcgtgctggacgcggcgaaccagtacgtggacgtcttcctgatcggcctcctgctgagcccggtcgaggcgggcctgtactacgcggccgcccgcctcgccgccctgttcgcgatcgtctcggcgggcctgcacgtcttctccagccgcgagatcgcgcgccacgccgccgaccccgccggccccggcatgcgcgcggccctgcgcctcgtgggtgccgcgacggcgctcgcggtcggcggcggcgtcctggtggtggcgacgggcggccagctgctcctcgacctgttcggcccggccttccacgcggcctacctgccgctggtgatcctgaccgtcggcgtggcggcgatggcgctcggcggcccggtcccggcggtgatgcggctcaccggccacgaggccgcctacgcgcggatcgccggcctcttcgttctcgtgcgctgcgcctgcgtcgccgccgccgcgctcgccgacggcctgatcggcgccacgctcgcgagcgccctctgctcgctcgcctgcgcggtcgtcctcaacgcgtcctgccgcaggcgggtcggcatcgacccctcggtgttcggcctcgtcggcgggacccgagcccgcggaacggtatcatga

SEQ ID NO: 8674 - DNA, 1548 bp, Methylobacterium sp.
ttgccgcaggaccggcatgcggtgccgcgggccgtgctcgagcatgcgctgttcctggcggtcgcggtcgcgctggtcggcgtgccgatcgtggcgcatctggccagccccgccgccgcgatcgtcctgtgcgccgcgggttccgtcgtcgcggcggtctacgtgcgggccgcgatacccgccctcctgatcgtcgccttccagttccagaacctgttcgtgtcgctggtctcgccctggctcgccgacacgccggccttcaacgccgcccgcggctacaacttcatcatcacggcgagcgtctggctgtggatcgtcggcggccactgcctcgccccccgtgcgcggagccggcagctcgacgccctgctccggccgagcgcgctcgcgctcggggtgatcggcctctatttcgggctcggcctcgcccgcgacccctacgcggcggtggtctacctgcggaacgccgtcacgcccttcctggtgttccagctcgcgctggtgatcgccgcggacgggccgggcgaccggctgcgcttcctgcgcgtgcccgtctacctgctcctcgcctacggtctcgccgagttcctggcgcgcgacgcgctcttcgagctgatccaggccaacggctacatgacgttcagcctcgccgacatcgcgcgctcgggcgagtggatcgagacgatgcgcaggacgggccgtgtgctgcgcgacctgcaggacacccagatcgtctccttcctcaacaccgacctgttcggcttctccgcgatccggatgtaccggatgctggggccgaacttccacgcgatcagcttcggctacggcctgctgctcgccgccttcctgctgctgcgctggcgccggcccgtcctgttctgcctcgcggtggcgctgctggtgctcgtcggcgccaagggggcgctggtctgcctcgccctctgctgcgcggcgctcctcctcgaccgcgtgcgcccggaggcgacgctgccggtcttcctcgcggtgctcgtcctctacgcctgcgcggtgatcgtgacggggcgcgcggggggcgactaccacgtcctcggcctgttcggcgggctgcacgccttcctgggcgcgccctggggagcgggcctcggggccggcgggaacctcgcgggcgacgccacccggatcgactgggagaaggcgcaggcgatcgggcgcaccgactggccggtggagagcgccttcggcgtcctgctctaccaggtcggccccggcgtgctcgcgctctgcgccgcgccggtctgcgccgcgctcgcggcctggcgcctgtccgggaccgtgccgggccgggacctgaggcggcatctccgcctcttcgccctcggtaccctcgcggtgacgctgaacggcctgttccaggaggaggccctattcgcgcccctcgccctcggcggcatgctgatcgccctggccgaccgcatgggcgagggcctgtcgcggcttcccgtcggcgcaccggaggtccgggccgcgcgcgctccggggcgctcggcgcaggggatcccggcgtga

SEQ ID NO: 8675 - DNA, 189 bp, Methylobacterium sp.
atgaacacggatttccaccgccccaccgccaagatctacaccttcccggtcgggggccgggccggccaggccgctcgcgcgacggcgcccgtccccgccccgcaggcctgcgccgccgacagcggcgggtaccacgaggccgcgatccaggaagaggccgagcgcaaccgcaccccgcgggggcggtga

SEQ ID NO: 8676 - DNA, 297 bp, Methylobacterium sp.
atggacgagcggcggcggcacgggcggaaccggacctatctgggcggcacgctcaccttcaaccacggccagcagaccctgccctgccacgtgcgcaacctcggcacggcgggcgcccggctcgatttcagcggcgccgtgccgctgccggacgaagtcgacctcgcgatcccgcggcgcggggagcaccaccgcgtgcgggtcgtctggcggcgcgaggacagcctcggcgtcgccttcctgccgcgcgccgccaacctgatcgccttcggcgacgcgcgccgcgcccggacctga

SEQ ID NO: 8677 - DNA, 216 bp, Methylobacterium sp.
atgtcggacgagttgtggcaacgcgcgatggccgccttccgcgagagccggcgcctgatgcaggaggcggagcgcacccgacgaagcggcgagtgcctgcgccacaccctcgccgacacgctgggggagatgcgcgatttcggagcgcgggcaacgatctggctccaggtcgaggcggcgcggccgagcgcaccctcgcccaaccggcgtctctga

SEQ ID NO: 8678 - DNA, 237 bp, Methylobacterium sp.
atgatgtcggccgctgacacactcgttgctaccttgtcgaagcaaagcggcactcgcgaggagctcgcaggcatcatcaccgggctcatggatcagtaccatatctcgccagatcgggcgcacatgctcatcgaccgcttcggccggactcagcctgctttggcgaatgctgggagcgagctcatggcaaggaagcagggctacagcgaaaggcagcctggctatatggcccagtga

SEQ ID NO: 8679 - DNA, 330 bp, Methylobacterium sp.
gtgatcacctgcttcatccgctacgccatcgatccgtgccggacggacgccttcgacgcctatgcccgccgctggggcgaggccatcccgcgctgcggggcggatctcgtcggctacttcggcccgcacgaaggctccgccacgacggcctacggcgtctaccatgtcgagaatctcgcggcctacgaggcctaccgggcgcgtctgcgcgacgacccgctcggccgggagaactacgccttcgcccggcgggagcgcttcatcctgaaggaggagcgtctgttcctgcgcctcgcctccgggccgcacgcggcgcgggtggcgccatga

SEQ ID NO: 8680 - DNA, 504 bp, Methylobacterium sp.
ttgttgcattttatgcgcctcccaaagggaaaatcctcatttgagctcgacagctacgatcttgccatcctgaagctcctgcagcaggacaacgcggtgccgcagcgtgccatcggcgaggcggtcaacttgtcggccgccgcggtccaacggcggatcacgcggctgcagcagagcggagtgattgagcggaacgtggcggtcctcaacccggcgcgggtgggccagcctatcaccctcatcgtcgccgtggagatcgagagcgagcgcctcgacctgctggaggcctctaaggccagcttcctggccgcggaggaggtgcagcagtgttactacgtgaccggggatacggacttcattcttgtcatcaccgtacagaacatgctagcctacgagcagcttacgcgacgactgttctttgaaaatcataacatcaagcatttcaagacgttcgtcgcaatggaccgcattaagacatcgacccatctggccctgccggagtga

SEQ ID NO: 8681 - DNA, 138 bp, Methylobacterium sp.
atgacggcacccgtgtcccccgaacccgcgcccctccgccacgcctcgctgttccgcagcggcctgggcgtccgcctcgccctcgcggccgggctcgtcctgccgctctggctcgccatcctgtgggcgaccgcgtga

SEQ ID NO: 8682 - DNA, 123 bp, Methylobacterium sp.
atggtgcgtaaagcagcgctcgccgcgctgacggccggcctcgtggccggatcctccggcttcctggccggctgctcggtcctgcccgcggcgggtccgaccgcgcgcgcggtcgtgtcgggg

SEQ ID NO: 8683 - DNA, 129 bp, Methylobacterium sp.
atggctggactgtttcaggcggaaacgatggcgttgagctgcgcggccctgaagctggccagttccgcgctcctggccgtgagcagcagagcgccgccactctgggcgttgctcagcctgcaacgctga

SEQ ID NO: 8684 - DNA, 291 bp, Methylobacterium sp.
gtgctgtcgctcctcctcctggccggcctgcccgccacggcggatgccgagatccggcccgtccgcccctgcgcggccgccaagctgcgcgatcccgcctgcccggcccagcgctacgccgttcaggtctcggccgatgccgacgagccggcgggcgagtcccgcacgctcgccccccgggcttcgacccggttgagcgccgaccgcaccccccgcttcgcgccgcgcaccgatccggtcccgccctcggccgccgcgcgcctgcccgagcgcccgcccaggcgcgcctga

SEQ ID NO: 8685 - DNA, 180 bp, Methylobacterium sp.
atgcaggaggtccccatgatcgccgtgacggcgcgacggattctcaccctgctggcgctcgtcgcccctgcgtccggctgggcctgccgggacgccggtccggcggacggccgcgcgaccggccgggaagcgggcggcacggccatccccgacgcggtcgtgttccggcattacctgtag

SEQ ID NO: 8686 - DNA, 192 bp, Methylobacterium sp.
atgtcgcggatcagcgtgaggctcgcgggtgacggcacgcacgcggtgatcgagggcaaggaccccgtggtgagcgggctgaccctcgacgaggccgagaactacctgaccttcatgcgcgcctcggcgcgggtacggcggacgcgccgcctgccggaggcgctgcgccgacggggcgagcgcccggtctga

SEQ ID NO: 8687 - DNA, 165 bp, Methylobacterium sp.
atgtccctgaagaccctgtccgccccgcttctcgccctggctctcgcggccggcagtctctcggccgcgcaggcccagagcagcaacgcgacccccggggctcctgccggcgacagcggcggcaatgcctcgaccggcagcaccgcggcgcctagcggcaaatag

SEQ ID NO: 8688 - DNA, 96 bp, Methylobacterium sp.
atgcgcaagctgctgctcgccttcctgctcccccgcgtcgtctcctggctgcgccgccgctacggctcgccgaaccaccgcacccgtccgtactga

SEQ ID NO: 8689 - DNA, 147 bp, Methylobacterium sp.
atgcatcacgtggcgatcgggctgggtgccctgtgctgcgcgggtggcgcggtcgcgcacttcatcgatacgacgcaccggcgcgagggcgcgctcggtctggcgggcctcggcttcctgctggccgggctgttcctcgaacggtag

SEQ ID NO: 8690 - DNA, 597 bp, Methylobacterium sp.
gtggccaacggggccgccgtgaagcggtcggtcgacgtgacggtcgcgctcaccgcgctgctcttcctggtcccgctcttcctcgccgtcgctctcctgatcaaggccgagacgagaggcccgatcttcttccggcagaagcgctacgggctgaaccggcagcccttcgagatcctcaagttccgcacgatgacggtactcgaatcgagcggtgccttcgagcaggcatgcgccaacgatcggcgggtcacccggatcggccggttcctgcggcgctcgagcctcgacgagatgccgcaactgctcaacgtcctcatgggtcacatgtccctcgtgggaccgcggccgcacgccacgatgatggacgacacctatgcggccgtggtctccgactacgacgaccgcttcctggttcggccgggactgaccgggctcgcgcagatcaccggataccgcggccccaccgacacctacgacaagatcgcccggcggatcggccgcgaccgcgtctacatccggcgctggtcgctcgccctcgacgtgatgatcgtcctgcagacgccgatccagctcgtgaaggatccgaacgcgctctga

SEQ ID NO: 8691 - DNA, 1005 bp, Methylobacterium sp.
atgaggctgatgcacgtggatcttacgcgacgacacgcactctcgggcctcgcgctctcggcggttgcgggcgcgatcgctggggcactcccgctccgcccggcacgggccgcggacctgacatatccgggcgtgaacctctcgggcggggagttcggcgatctcggccgcccgatggggcagggctacatctacccgcaggattcggccttcgcgtactacgcgagccgtgggatgcggctggtgcggctgccgttcaagatcgagcgcctgcaatccgagcccttcggtgcgctctcggagcgggacgtcgcggagctgcggcgctgcgcggcgacggccaagcgcctcggccagctgctggtgctcgacccgcacaattacggaaaacgcgacgaccggccgatggcggcggacgacctcgcggatttctggaagcgtatcgccgccctgttccgggacgatgccggcgtcgcctacggcctgatgaacgagcccgtcgcctacaagcctcccgagtggcggccgatcgtcgagcgcgtcgtcaagacgatccgggacctcggctcgacgcagctgatcatggtgccgggcgccggctggaccggggcacattcctggatctcagacggcaacgccgcggccttcgagggcttctcggacgccaacttcatgttcgaggtgcatcagtacctcgacgccaacagctccgggaccgatctgcagacctacgtgcccggcgccggagagggccgcctgcgcgatttcacggattgggcgcgcaagcgggcatgtcgcggcttcctcggcgagttcggcttcgcgctgcccgccggccggacggaggcctccgccctgctggcctacatggcggccaacagcgacgtctggaaggcctacgcctactgggcgggcggcccgtggtggggcgattacgccttcagcatcgagcccgacaagaacggcgacaaaccgcagatggcccttctgcgggaatacctgtga

SEQ ID NO: 8692 - DNA, 1527 bp, Methylobacterium sp.
ttgagcggcggcctcgcgcggcagtcggccgccaacgcggtcgccaccggctccattctgatcagcggcgccctgagcacgatcatcgtcgcgcggctgctcgggccggccgacctcggggtcgtgacctacgccgcctggttcgtcagcatcaccgtgatggtggccgacctcggcatcccggggtcgctcgcgcgctacctgccggaagtccgcgggtccggggacgcgagcgcctgcgacggcctcgccctctatctgttcaagcgcttcgtcctggtggtcgggctcgcggcctccctgctcttcgggctcgccctctggcatctggcggccggatcgacgttcgcgctccacatcgagccggggacctacaagacgtccccgctcttctggacgctgatcgccgcggccgtcctcgcccagagcagttccgccttcgcggtggggctcctgagggggcaccaggaattcggccggatggcgcgcatcatgctcgtctcggcggccgcccagatcggcgtcacggttctgggctcggtcgcgctcgggctcgtgggcgcgctgagcgccgcgatcgtcgtcggactcgcgccctcggtcttcctgctgcggaagctccgcggcggccgcgcggtggcgccggagctgcgcacccggctcgtccgttactgcggcgcgatctggctcgcctacctgctctccgccgtcacctgggcgcgcaccgagatcctgttcctggagcggagctggggcagtgaggcggtggccttcttctcggtggggctgacgctcgccaacctcgccgtccaggccccgctcctcctcacggggccgctgctgccggtcctggctcagaacatcgccgcgaagcagcacgcgacggcggtggagatctaccggacgggtatgcgctatctcgcgatgctcgtcttcccggcctgcttcgggctggccgcgatcgcctcggtcttcgtgcccctcgtctacggcccggccttcgcgaaagccgtggcaccggccgtgatgctcgtcgtcgcggccgccttctacgccctgacggcggtgacgcagatctacatgaacgcggccgagcgcaaccgcttcaacatcgtcgtcgggatcatcggtgcggtgagcatcatcgcgtccggcctgatcatcataccgacccacggcctgatggcggctgccgcgacacgcacgaccgttcaggtgctcaccgccgcggcgtcgatctggtacgtgcatcgtcatctgcgcgcaccggctcccatcggacagatcctccgcatcgtcggcgcggccgcgctgtgcgggctcgccgccttcgccgtgctgcgcgcctttccgggccccgtcgcgctcgcgccggcgatcgccgccggcgccctggtctacggaatcgccctgaagctcttcgggtgcgtcctgcctcaggatctcgaacgggcgcgcgcgatcggttccaggctgttcgcgcccctggccgccgctctgtccggcgccgccagggcctcccgatga

SEQ ID NO: 8693 - DNA, 561 bp, Methylobacterium sp.
gtggtgcgggcgggcgccgggccggtgcgggatcgctggctcgacgccctgcgggccgggctcgacgcccggcaggacgcgctgagggcccgccccctgcgccgcctgccgccggggaccggcgacgaccggctgatcggcgggctcgacctgcccgcgaccctggcgctcggccgtccggtgctcgggcgcggcctgctggcggaggccgatggcggcgtgctggtggtgccgatggccgagcgcctgagcccggcgaccgccgcccgcctcgcggccgcgctcgacaccggcacggtcgcggtcgagcgcgacgggatcggcgcgcgccaccccgcccggatcgggctggtgctgctcgacgaggggcagggggacgaggcggtgccggaggggctggccgaccgattggccttccggatcgatctcgacgggatcgggctgggggatctggacgcggggcgggcattgccctcgggcgatcgcgttccagcctctccggcggacggcccgcgcgctctccctcccccctctgcgggggagggtggcccctgcgtcagc

SEQ ID NO: 8694 - DNA, 618 bp, Methylobacterium sp.
accctggtgttcttcggcatgccggccccgcgcatcgccaagatgctgccgctggggagccaccgctacgtctcgggcaagatcgagctctgggacgggcaccgccagatggtccaccccgcccgcatcatggacgcggagggcttggccgccctccccccggtcgagccgatctacggcgcgacggaaggcctgacctcgcgcgccatcggcaagctggcgatcgccgccctggagcgcctgccggtcctgcccgagtggcaggaccccgcctggctcgcccggaacaactggccgcccttcgccgaggcgctgacggcggagcaccggccgagggaagcgccgcccaaggccaccgacccgctccagccgcccccctccacgccgacccggcggcggctcgcctacgacgagctgctggcctcgcagctggcgctggccctgctgcgcgcccgccagcgccgcaaggccggccgcgtcaacgcgggcgacggcaccttgagcgccgcgatcgaggccggcctgcccttcaggctcaccggggcgcaggcccgcgcggtggccgagatccgcgcggatctggccgccgaccgacgcatgctgcgcctgctccgggtt

SEQ ID NO: 8695 - DNA, 360 bp, Methylobacterium sp.
atggctgagacccgcaaacccgccatcgtgcgccagcccagccggaagtactggcgcgggcacgtcgcgatgtaccgcaactcggtctcgttctgcgtcggcctgccgagcggcgagcggcgatgcgtcgtcctgccgacagctcggttctggtcgcgcgagcgccgcgaggcgcgggcggagagcttggcgcacctccacctgcccggcacgaaggtcccgcgcccggcgaaccactcctactggcttacggtgagcgtgccgttggtcctggccgaggtcgagtgccgcctatggcgctcgcggcagccggtgcggcgctaccctccgcggccgatccgggaggtacggcatgggtga

SEQ ID NO: 8696 - DNA, 309 bp, Methylobacterium sp.
atgatccagtcaatcctgaccagcgggcggcgcgcccgcaccggcgggcggcgcgcccgcaccctcttgatcctggccgcgctcgccgcgccgaccggtgcctgggcgcaggcccagacgggcaccggcggcggcccgacctcgacggtcacggcgcccaacgcctcctcggtcggccgcgtgatgccgcgccccggagcgggtggtgccggggccgacgcgcagctcgaccgcaccgagcggacgccgcagatgaaggccgacgacaagatccagaagggcatctgcatcggctgcggcgcgaaatag

SEQ ID NO: 8697 - DNA, 360 bp, Methylobacterium sp.
tcctcgcccgtgaacggccgctcctgcgcctgccagagcccctggcggcacagcctcgcgatctacctcgtgcatcagccgctgttgctgggcgtcctgaccggcgtggcggcgctcaccgggccgcatccgcgtgcgggcgagcggacgttccgcgcggagtacgtggagacctgcacgcggaccggcggcgggcgcgaagcctgccggatcgcggcccgctgcaccggccaagtgctccgccgcgaggggctctggcaggcgcaggagcggccgttcacgggcgaggagcgcctgcgggcgcaggcgctgtcgcaggcctgctacgaggccgcggagggcacgcgggggccgccctga

SEQ ID NO: 8698 - DNA, 963 bp, Methylobacterium sp.
atgctgtcgcttcgaccggccgccgcccgcctgggcgcggctttcgccgccgtgctcgcgctgtcgggcgcgccgcgggcccacgagggccacgaccacggcccgccgcccccgccgccggagcgcgccgccccgcgggccgccgcggtctcggaggatctcgagctggtcgcaatcgcccgcgccggcaccctgacgctccatctcgaccgcttcgccagcaacgaaccggtgacgggcgcgaccgtcgaggtcgaggcgccggacggcccgcgcgccgcccgggagacggaggccggcatctacgccctgcccgcgccctggctcgacgcacccggccggcacgatctcgtggtcacggtgacggccgggtccgatgccgccgtgatgagcctcgcgctcacagtcccggtcccggagaagccggcgccggccgggggcttcggccagaccctgggccaaaccttcgcccccgtcctcgacggcctgcgccggcacctcgcccggcaggacccgaccctgccggcgaccgccggtgcggccttcctgctcggggcgctggcggcggggctgctgcgcggccggcgcgcgggcatcgccgtgctggtcgggctcgccgcgaccctggcgctcgccctcggcggcggcgccctggcgcacgaggcggccggccgccacggcgggcgcgtcgccgatgccggctcctaccatgtcgagctggtgacgcggggcccggaggtcgtggtctacgtctcggacgggatgcagaagcccgtgccggcagacggtttccgcgggacggcgatcctcgtggtccagggcaagccggcccgtgtgccgctggagccgctgacgggcgaccgcctcgccggccgcgccgcgagcgatctcggcgccgccccgaagggcgtggtgcagatcaccgcgccggacggtgcgcgggcgagcgggcgattcgagtga

SEQ ID NO: 8699 - DNA, 393 bp, Methylobacterium sp.
gtgctcgaccgcaacgtctctcaacagaagctgctggtgacgctcgatgccgtgatgatgggggcggtcgtgcgcgacgcccccttctttcgccccaaccgggagccgggcgatatcctgttcccgccatcggcgccccgaccgcgctcgtccgtcaagcttccgctgcctttgtccggatcggacgcgcgcatctgtcccttctcgatacgggagcaggaaatcctttccgtgcttgccgagggcgtgtcgaacaagcacatcgctcgcaagttcgacatcgccgaatcgacagtcaaagttcatgtcaagcacatcttgcggaagctcaacatgaacaatcgcacgcaggccgcgatctgggccaagagttacaggccgattccggcctga

SEQ ID NO: 8700 - DNA, 240 bp, Methylobacterium sp.
ttgttcgatgcgctgaggctgaggatgttggaccgtgcgaccgaaactgagccgacggaggcagaacgcatcgctcacgcgtatcgggttgcaagcggcggcaacgcctgggccgcgctcgtgcgggtcgtcgaggatgcgctcacggatctggcggaggctgagcggcgctcgctgcgccgtgaccggctgatctcgcatgggtacgttcgtggtcgccacgacggcggcggtcgctaa

SEQ ID NO: 8701 - DNA, 1029 bp, Methylobacterium sp.
atgacccgccttgccctctggctcgccctcgcgggcgccctcctcttcggcggcctgaccgcaccggcccgggcgcaaggccccgagaggctgccgatccggatcggcttccagtccggcgaggtgaacgtcctgctctcgcacgccgtcgccgccggcctgttcgagcgcgcggggctcgccgtgaccctcgcgcagttccccgcggggcccgcgatgctgccggcgctcgccgcgggcgaggtcgatctggcctggatgggcgagttcccggcggtgacgggctacgccaacggcctgccgatcgagatcctgttcatggagcggatcgacgccaccaacgtccggctggtgggaaaccccgccgccggcatcgcggcgcccgccgacctgaagggcaagcgggtcggcgtcgcggtcggctcgaccagccactaccacctgctgcgcgcccttgcgcaggcagggttgagggcggacgaggtgcgcctcgtgaacctcacccccgccaacatgccgcccgcctacgcggcgggccagatcgacgccgccttcgtctgggaaccgaatgtcggtgcgctggagcgtcagggcgcccggccgatcgcctcgacgcggagcctcggcatgatcaccggcggcgtctgggtggcgcgcaagcccttcgtggcgggctcgcccgagacgctgcagcgcttcctcaaggcctgggacgccgcgcaagccgcctacgccgcggaccctgcgggcgtgcgggccgcggaggccaggcgcatcggcatgagcggggcggacttcgatgccctggtggccggccagagcgtggcccatccgagcttccgccagacgctgaccgcggatttcctcggcgcgccgggccaggaggagacgtcgcggctgatgaggcacctgcacggcatcgcggccttcctggtcgccgagaagcgcatccaggccccgcccgccgactggtccggcctcatcgacacccggccgatccagacctacctcgcgggcgcctcgcagtga

SEQ ID NO: 8702 - DNA, 915 bp, Methylobacterium sp.
atggcccgcgcatacgcctccaccatcatcgatgctccggtcgagaccgtgtggtcgctcatccgcgacttcaacggcctgccgtcctgggtgccgggcatcaccgacggtgagattgaggacgggctcgacgccgacgtggtcggctgcgtgcgcgccttccgcctccccggcggcatcttggtacgcgagcggctgctctcccttgacgaccatcgctacagcttcagctacaacttcgagacgcccgccttcccggtgacggactacctcgcccgcgtcacgctgattccggtcaccaacggcgacggcaccttcgccgagtgggaggccaccttcgacgaacggcccgaggatgccggcaagtacgccagcatcatcgctgagggggtcttcaaggcgggatgggatgccctgaaggcgaagatcgcccgcgagcggcccccgacacctgcgggcgccgtgcgctggcggggcctgccgccccacaaggtgttctgctcctcggtggtcgacgcaccggtcgcggccgtctgggcgacgatgcgcgacttcgccggcatggcggactggcacgaggacatcgcgcgcatgcacatgctgggcggcgtgcgcccggacaaagtgtcgggcgtgcgcgactttctattcggcgaggggcacctcaacgaggagctgatccagctctgcgaccgaacgcgctcctacacctaccgcatcaccaagagtccgatgccgtggctgcactacgtctccggactgcgcctgcggccggtaacggacagcgaccgcaccttcgcaacttggttcggcgactggacggccgcgcccgccgacgacctcgtgctgatcccgcaggttcatcacggcgtctaccagaaggcgttcgacaccgtggctgcgcggctcgcctga

SEQ ID NO: 8703 - DNA, 639 bp, Methylobacterium sp.
atggacgccgtctatgtcgggatcgatgtgtcgaaggatcggctggacgtgcatgtcctgccgagcggtgaagcctttggggtgacccgggacgggtccggcttggccgacctctgcggccgactgcggccgctggcgccggtcgcgatcgtgctggaggcgaccggcggcttcgagaccgtggtggcggccggtctggccggggccggtctgccggtggtcgtggtcaaccccgcccaggtgcgcgccttcgcccaggccatcggccagcgcgccaagaccgatccgatcgatgcggccgtgatcgcccgcacgctcctggccgagctgcccgaactgggccgcctcgaccggcgccagatcgccgcgctggccggccacgcgccctggccccgccagtccggccagtggcgcggcaagagcttcatcggcggcggccgggccagcgtgcgcgccgccctgttcatgggcgcgctggtggcagcccgccacaaccccaccctcaaggccttccgcgacaggctcgtgggcagcggaaagcccaagctcgtcgccgtcgtcgcgaccgcccgacagctcctcaccatcctcaacgccatgctcaggagcaaaaccccatggcagctgcaaaacgcttga

SEQ ID NO: 8704 - DNA, 2304 bp, Methylobacterium sp.
atgggacgcgggcagggcgcacaggcggggcagggcgcgcaggcgaccggcccggggcgccgtccggcggccctggcgcaggtcgcacacggcctgcgccagcaccaggccggcgacatcgccgcggccgaggcggcctaccgggaggcgatccggctcgcgccgggcgaggccgccgcgcaccacctgctcggcctctgcctgaagcggaccggccggatcgcggaggccggcgccgcgctgggccgggccgccgcggccagcccgcgcgaccccgacatcctggccgacctcggactcgccctgcgcgcggcgggcgaccgcgacggcgcccgcaccgccttccggcgcgcgctgaagatccggggcgaccatccgaaggcctggggcggcctcctcgatctcggaggcgtcggcacggacgcggtgggcccgctgcgccgcctcgtcgccgcgcagccggcgcggccggaaggctacctgagcctcgcgggcgtgctctcggcgctgggcgaggcggccggggcgcgcgacatcctggccgacggcctgacggccggggcgctcaccgaggcggcgctgcagagccacggcgccgaagcccacgcggccggccggcacgcggaggcgctcgcggtcttcgcgctccttgccgagcgtcggccgcaggatccccacgcccagatcgtccacggctgcgccctgttcgaccggggccggatcgacgccgcccacgccgccttccggagcgccctcgcggccgatcccgacaacgtgaccgcccacgtgaacctcggcgcgatcttctcggagatccggcgcccgaacgaggccctggagcattaccggcgggcggtcgccctcgatcccggctcgacgctcgctcgccacggcctcgtcgaccagcagcaccacgcctgcgagtgggccgacatcgcggagaacgagcgggtcctgctccgcctgctcgacgagaccggcacgcgggtcacgcccttcaagctcctggtggccgagcaggcctcacccgccgcgatcctgcgcgccgcccgcatctgggccgcggggatcagcgttcccccggccgacatcctcccgccgccccgcccggcctcccccggccgccggatccgggtcggctacctctcgaacgacttcttcgagcacgcggtctcgatgctggccatccgcctgttcgagcggcacgaccgggcccgcttcgaggtcttcgcctactcgcacgtccgggacgacggctccgccctgcgccgacgcctggaggccgccttcgagcacttcgtggacatcacggacctcaccgacgcggaggccgcgcgccggatccgggcggacgggatcgacatcctggtcgacctcaagggctacacgctgcgggcccgtaccgagatcttcgcgctccggcccgcccccgtgcaggtgaactacctgggctatccgggcacgatgggcgcgcccttcatcgattacctgctgggtgatgcgatcatcacgcccgaggcgcaccagcccgattacagcgagcgcctcgtccggctgcccgattgctaccagccgaacgacgaccgccgcccgatcgcggccgagcgcccgagccgcgccgcgtgcgggctgccggacgacgccttcgtgttctgctgcttcaacaacagctccaagatcgcgcccgcggtcttcgcgatctggatgcgcatcctggcgcgggtcccggattccgtgctctggctcctggaggccaacccggccgcgcaggacaacctgcagtacgaggcgggcgcgcagggcatcgatccggggcgcctcgtcttcgcgccacactggcgcaccgaccgccacctcgcgcgcatcggccacgccgacctcgtgctcgacacgctgccctacaacgcccacaccaccgcgagcgacgcgctctgggccggggtgccggtgctgacctgcctcggcgcgacgatggcgggccgcgtcgcggcgagcatcctgcacgcggccgggctgcccgacctcgtcaccacgagcctcgacgcctacgagtcccaggccgcggcgctcgctgccgaccggccgcgcctcgacgcgctccgggcgcggctcgccgccaaccgggcgcgggcgcccctgttcgactccgcgcgctacgcccgcggcatcgaggcggcctacgcgcagatgcacgacctgcgctgcgctggccggccgccggaggccttcacggtcccgcgcgagccgttccaggacggcttcgatcccggtttcgatcccggccccgattccggccgcccctga

SEQ ID NO: 8705 - DNA, 372 bp, Methylobacterium sp.
ttggctacaaagaagattgtcttcgtcgcattcgcgatggaggacgaacgacagcgggattttctcaaaggtcagtccctgcaccctcgggcaccatatgagttcatcgacctatccgtgaaggaagcctacgagacggattggaaggacaaagtccgcacccggatacggcgttgccatggggtgatcgcgttggtgagcagaaactcgccgcagtcgaccggccagaagtgggagatcgcctgcgcgagggaggaaggcaagaagatcatcggcgtctgggcctacgctggcgaccggaccgagatcgccggcgtgaggactgtcgcctggagcgatgccaacatcgccgcattcattgactctctgtga

SEQ ID NO: 8706 - DNA, 822 bp, Methylobacterium sp.
atgattgcgtttatcgtcgccttcattctctgcctagaggggtcggcccaggcacgaaaggagttcctcgccgatgagtactggattggcaagccgcattcgccgaaggagaagaacctgacgcggctagctgcgatgtacatgctcggggtgaagcagagctatggcgccctgtacgtgcaagcccttcagtacacgaaggtgaccgagtacttcctggaaagagacatagaaccggaagagattcccgattggctgcgccgcacgccgatctacaagctccttgataagcttgacccgccgcagaaggtagcgtgcgatgatgacggcccggctacggccccctcacgggtacagccgaaagctgcgctggccgatacgacagtcaatacccgcgaaaagcaggataagcgcgacttacacggcgtcgatgatgacgccgatgaggcggtggggcacgacgccgatgactgcgacgacgaaggtgactgctccgacgaaaacgatgacgacaatgacgccagcgggtccgggagcaccgacaaccattctgatggtcccaacagggtgggtcgccgcgaccgtaccgctagccccgaaggcacgcgcacgaagaacgccaagcgttacccgttcaagcaggatcgtgagttagccgttatggcagaaggctaccagaagcgattcttcgatgacatgaaacccaacgaagaggttccagtgatgatccgccggttgcctgatgaggatggctgggcgaagtttgagatctgtggcctgcttagcccccgggagtaccgtaccacccggaccgccgattga

SEQ ID NO: 8707 - DNA, 1194 bp, Methylobacterium sp.
gtgaccgccctgccgaaccgccggaccctcgcgaccgggcgggagccgcgcccggaaacggccatccggccctccttcgacggtcaggatcccgcggctctcctggagcaaattccgcgtcacgagacaatcctgccgcgggtcgatgtcttcacccttcccggcggctatatctggttcggcgacggcgtcgacgggatcgccctcaccgccgatggccagctggccctggaaacggcaaccttcgcccgcggttaccagtctcttccgccggaggcgttgcgggcgcgcgcccgcgagatcgacgaagactgggtcacgatcgtcgattgcggatgtcacaattactaccacctcctgatgctggcgatgccgcggctcacctatgcccgggcgcatctgcccgaggcctgggcggccgtgccagcccaccgcccatcccccgacggccgcccgccgctgctcgatcagctcatcgccctcagcggggaaggtcaccggattcgacgcgtcgaagacgggctctaccgcccgcgcaacctccacgtcatctggacgaatttcatcaacccgcccgcgctacacttggtcgacgaaaccttcgcctgcttcgacatcctggcccggaacgtccccccggcaccggagcggcgattcccgaagcgtatcttcatcgagcgcgtgggcgacatgcgcctgagcgacccgaacgcctgccgcagcctcgaccgttacctggctacccacggtttcgggaaggtgcggctggagacgctcgacataggcgatcagatccggctcttcgcaggggcgagccacgtggtcgcggcccatggcgcgggcctgagcaacatcgtgttcggctcgccgcaactgcgggtgctcgaactgaatctcgacctcgacgggcggggtacgctgcggccttggttcctgctgctcgccgccgcccgggggcagcactaccagtacctgaatacctcggcctgcgaactggccgacctgccgatgggcctcgcgttcgaccggctgatggggacccgtcggcaggctctgcgactgcggctcgcccggctgcggggccgcctggatcgtcacctcgtccgcgcggcaattctggcgcgccgcctcagatccggccgagcactgcggggaagccgatttcccgggcgcgctcccccacctcattcctaa

SEQ ID NO: 8708 - DNA, 648 bp, Methylobacterium sp.
atgtccgacggcgccgctctcctggccatcctgggggccgtgctgctcggcgcgatgagcccggggccgagcttcctcctgatcagccggatctcggccgcccgctcgcgctccgaagggctcgcggccgcgctcggcatgggtctgggcgccgccctgttcggaacgctcgcgctcgtcgggctcggcggcctgctctccgccgtggactggctcgccgcgctcctgcagggcgccggcgggctctacctgctctatctgggcctgcgcatctggcgcggggccgccgcgcccctgccggaggccggccgggcgggtggtccgcccgcgggcggatccctggcgcgcgccttcggcgcggccctgctgacccagctcggcaacccgaagaccgccctggtctacggcagcctgttcgcggccctgctccccgccgcgcccgcgccctggctgccgctcgtcctgcccctgctgatcctcgcggtggagaccgcgtggtacgggctcgtcgccctcgggttctcggcgccgcgcccgcgggcggtctatcggcgcgcccggatctggatcgaccgcgccgcgggcgccgggctcgggctgatcggcgcgcggctcgtccacgaggcgctgagcgggcgccgcgcctga

SEQ ID NO: 8709 - DNA, 2499 bp, Methylobacterium sp.
atgatcaaagttgaagagcttcatatttttgagttcagaggcatcaagaagctggctttaaccttgaaccgaaggaactttgctgtctgtggccctaatgggacgggcaagagcggcgtcgtcgatgccttggagtttgtgctggctgggacgatctcgcgcctgaccgggaagggtcgtggcgacatctcggtgaaggggcacggggcccatgtcgattgtcaacatgacctggagaaagcgtccgtcgaggccgtcatatggatcccgtcgctgaacaggaccgtaagggcgcaccgcaccgtcaaggccccttcggtactgaagctgacgcctgacagccctgaggcgcgggcggtgttccgaaagctggaagcgcatccggagttcgcgttgtcccgccgggagattatccggttcgtgctggctgagcccggccaacgtgccaaggatgttcaggcgcttctcaagctcgatgagcttgaagcgctacggttgcgtcttcagcggatcgccaatgcggcggctttggcatccaaaagggccttaaccgaccgtaacgcggcagacgccgacttgggtcgagcgatggacattgccgaggtgacggacccgttggtccttgcagctgccaatatacgacgctcggtcctgggactggcaccgctatcggagctgggctcggaggcatccctccgtaagggaatggcggccgtgaatgacaaacaggcctcacgcgtcacaaaggccgtcgccaaggtcgacgttgcagcggcagcggcatcaatcagatcacgtgtcggcgacgatttcgcgacgctggtggaggaggcaaaggcggcgacgtgtgcgctccaagtggatgaggcgatgctcaacgccgttgttcgcgacgacttcctcaagaccgccctggagctctacgacggggaggtctgccccacctgcgataccccgaaatcgctggaagaattcggtgccatcataggtcagaagcgcgcgaagctcgaagaggtcagatcgttgcgcgatagggcggagcgggcaattgcgccgttaagtgccgctatcgaggatgaccttgctttcgcccggaccgtctacccacatgccaagcttctgcttgacgaagctgaactgaaggtcctcactgaccacggggtagcgctgaaatccgctgcggcccagctccgagccttccttcctttgagcctgacactcggtgtccttgaggacctagcgtcgcagggggcggccattgaaatcctcgtgcggctcgaaacgctcatagacgagttgcccgagccgtccgaccaggatgccgcgcaagagtacctcatcgccgctcagcacaggctggaagccttccgaaaggcgaccgctaaggccgaggcggccgaggatcgggccgtcaaggctcggaaggtgttcgacctgtttaagctgacgtcggattccgcgctggagggtgtctacgcggaagtccagcgcgatttcgcggatctctataggcggatcaactcggacgacgaaggcgcgttcgaggccaagctggatccggcgctggggcggctgggcttcggcgtcgacttctacggtcgcggcttcttccctccgggggcgtatcatagcgaggggcatcaggacagcatggggctgtgcctctacctagcgctgatgcggcacctgctcggaggtagtttcacattcgcggtccttgacgacgtgttgatgtcggtcgacgccggccaccggcgggaggtgtcgaagcttcttcgtgccgagttccccgatacgcaattcgtcctgacgacgcacgacaaagcgtggctcaagttcatggggacgaccaagctcgtcgagccaaaggatacagtgcacttccggaaatggaccgtcgccgacggcccaaccatctgggccaagggggatgtctgggacgagatccggagtctagccaacggcgacgacatatcgggtgctgcggcgctcctcaggcgttctctggagcacatggcgtccgaattctgccaggcgttgcgggtcaaggtcgagttcagcgtcgacgggcaccacgacctgggcgacctgctcgatccggcgatcaaccagttgaggtctctctacaaggaggcacgactggccgcggacagttggaaagcttcggagcggatcgaggccattcgacgtctggagaaggcgtttgatgatgcggcaagcctggcgaaggtcgagcagtggcagattaatccaacggtccactacaacgaatgggcgaatctgcaccgagacgagttcatcgctgtagtgaatgcctttcatgcgctgtgcgttctgttcgaatgcagtgcgtgcggcgtcccgatcaaggtaagcccctcgcgcggcagccgcgagtacatccagtgcccgtgtggtgaggtaaagttttctttcatgaagaggcccagggagaaacctgccgctccatctgctcctgccctacaaacgctgtcttga

SEQ ID NO: 8710 - DNA, 504 bp, Methylobacterium sp.
atgtccgcctccgaccgcgccaatatcaccctgcccttgccccgcttccaacaactcggcgccatcgccgagcggcgcggcttgcctagcgcatccgccgtcatcgaggcgtggatcggccgcgcgatcgaggaaggcgagattccggcgagcccgccgggctttatggccttcaaggacgacgacggcttcctcatcgaaatttgcggacacatgcttccgctgatgaagcccgaccgggcgcgcatgctcgcggccgtgctctcggcggccgccggcgacaccgaccccgatttgccgatgcagttcccggccggacgcccggtcgtgctggaccttggcgaggtggcgctggtggtcgggaaggctgggcggggcatccggttcatcgtgaagaccaagggcgccgccgagggcgagggcatccacctcgccacgtcaccgaccttcgttgccggcctcgcgcgcgagatccgcgccgagttcaccccggccgccgcctaa

SEQ ID NO: 8711 - DNA, 102 bp, Methylobacterium sp.
gtgagcatcgcggagatcgccgaggcaggcggcttcgtggccgaccgcaatcagacggtgcggccgtcaccgtggcggctcggccgtcgcgatctggcctga

SEQ ID NO: 8712 - DNA, 219 bp, Methylobacterium sp.
atgagccacattctcagtctggcatcggcgagcgccgcgctcaccactgttctgagcctgctcgccgcagtcgcttcggagcccgtgcccgcggcttcggccgcgcggtccccgcaggccccggccgtcgtggccgccgaagcggtccccgtccgcacgatcaggacgatccccatcgacggtcgctacgactccaccgtccgtccgaccctgcgctga

SEQ ID NO: 8713 - DNA, 210 bp, Methylobacterium sp.
atgcacatctcgcccgacggcctcgacaagctcgaggatctcgccctgctccgagccgtgctgcggacgaacgctcgctccgccggcaccgccgaacgggcgctgccgacgctcgcggaccgcttcggcgtcgcgccgacgggatcgggacgccggaaggctgaggtgcgcctcgatcacgcacctcgaaagatcgcgacggggtcctga

SEQ ID NO: 8714 - DNA, 93 bp, Methylobacterium sp.
atgtttcccgggcgaagtccggccgagttgcgcgtcggctcccggttcatgatcgcccgcaccgcgatttcgagcttcgggttccgctcgtag

SEQ ID NO: 8715 - DNA, 135 bp, Methylobacterium sp.
atgatggcgaccacgacgaggactcgagacatgatcccgaccgatcgcatcatcgtctgggcattgatggcggggctggcgatcgccctcctgcaatatgccgagtccgcggccctgcccgcgcacttcgtctga

SEQ ID NO: 8716 - DNA, 591 bp, Methylobacterium sp.
atgactgagcatctggctgcaggcgacgcgccgatgccggggtcgacgcacgctggatccaggcgagatcgcgagacggacgaacctgctggcgcacgacgccacgatcaagcggcgcgggccggcggggccggctgcggctacgcggcggtggctcgggaggtcacgcagtcggccgagcgggccggcataaccgcggagcaggccatcggggcgattcagggcacgatccgcaccctccaccaatcagcggcggcgatcgcctcgaccgtggaggagcagtccgcagtgacccacggcatgttggccttgatgcagaccgcggcgcccgcacggctatcgccgggccggcaccaccgacccgttcgccgctctcgacgtccaatccggccgcgtgatcggacgcggcaaaaggcgccatcgccccaacgcggcgtgttcgagaccattgtcgatctggagcgggcgatctacgcctccattgatgagaccgacgccgagccggagccgttcgtctggacgaagtccgccgacaatatcctcgccggcatcagacacttctgccaacgaaattcccactcgaaccactag

SEQ ID NO: 8717 - DNA, 144 bp, Methylobacterium sp.
gtgcgcttcagcgtctggaccagcctggccgcgcacccgcccctcggcaacatcaaccgcgcccgcaacgctccctgcgggcattcggcggcgttccgacagcgcttcgacggctgcccgatccacgagccttcaggcggctga

SEQ ID NO: 8718 - DNA, 90 bp, Methylobacterium sp.
atgcacgcgcgcggcctcgtcgaggcggtgctggcgatccgcgccggccgcctcgcgcccgaggcctacgccgccgccctcgacgcatag

SEQ ID NO: 8719 - DNA, 105 bp, Methylobacterium sp.
atggcggcgctgatcctggccatgattctgatcggcgtggcgatggtgaccacgctggccgacgaccaggtgctggtctcgctccatcggccccgggcatcgtaa

SEQ ID NO: 8720 - DNA, 195 bp, Methylobacterium sp.
atgagagagaagccgctggagcaccgcggcatctacgtcaagccgatcaacgacccgcccgtgccgcgcggcggcgagcggctgagcatcaccccgactccgctccataccgaggagcacatgcgaccgctcatggaggcgctcgtcgaggttcgcactcgccaggcctggggagaggtctcgcgggcgacatga

SEQ ID NO: 8721 - DNA, 378 bp, Methylobacterium sp.
atggccgtcatcccaagggatgccgtccagaggatgccacgcgtggcatccccagggctcccgcccgtggacccgatgacacggcccgccgcgttcgatggggcgcgggacgcccggatgctggcctcggtacgccaggcaggggcgggcggaggggcccgcacggacggggactcgatgccggccgggagcgccggaccggtcgatggcggcgacctgcacggggctaccagttcatggagatcacctaggacctgccacggccggagaaggcccgaggcattcattctggacggcttggcctctggagccccggcgccggtcatcggcgagaccttcaagctcgatgagatcgtggaggctcaccggcccatgtag

SEQ ID NO: 8722 - DNA, 1095 bp, Methylobacterium sp.
atgaccagcgtcctcacgaacaccgcggcggccgtcgcgctgcagaccttgcgcgcgaccggccggaatctcgacgcgaccgcgcggcaggtctcgaccggcctgcgcatcggctcggccggggacggggcggcctactgggccatcgcctcgacgctgcgcgcggacaacgggtcgctcgccgccgcgcgcgacgcgatcggcctcgaccgcaacaccgtcgaggccacggcccgggggttggaccgggtcatcaatcaactcggcgccatcggccggacgctggtctcggccgcgagcgcccagaccgaccggaccaagctccagggtgacctgcgcaccgccctcgacgccatccggatcaccgcggacaacaccgtgatgaacggcgcgaactggctctcggtcgattcggacgcccccagcttctccgcgacccggaacctcgtcacggccttctcgcgccaggacggcagcgtgtcggtcggcaccaccgccctcgatacgtccggcatcgtgctgttcgacaccagggcccgggagggcggcgggagcgccttcagcctcacgccggcgaccggttcgatcccgtccctgacccgggacatagcccgcgccgcatcggtggcatcacccgacggctaccagatccagacctgggacgggccgagccagcgtggcggcgagaccctctacctgacctggaaccagggcctgctcgacacgcagtattacgtccgggacgcgagcttcgggcaccagcccttctcgatcgcctcgatggacctgacctcgcggtacacggacgccaagatggtccaagcctatgtcaaggtcgtggatgcgacgcggcagatcctgctcgacggggcggcgaatcttggcgtgatttccgccctcctcacggcccagcaggatttcgcgggccggttgatggacatcaacgcctcctcgatcggcgctctggtcgacgccgacatggaggaggccgcgacccggctgaaggcgctgcagacccagcagcaactcgggctccaggcgctgagcctcgccaacggtgcctcgcaggccgtcctcgctctcttccggcagtag

SEQ ID NO: 8723 - DNA, 180 bp, Methylobacterium sp.
atgaagcccgccgagcgtgccgccctgaaatcggcgatcaagcgctacacccgagccaagacggcctcgaaagccatcgccctcgcgaccctcgtcaaggagggtacgcacacgcccaagggtcagatcaccgtgcagtatggcggacagcgcaagaagaagtcgggttcggcgcaataa

SEQ ID NO: 8724 - DNA, 567 bp, Methylobacterium sp.
gtgggtctcaaggcactgatccgcggcttgccgctggagccctcggacaaggatttcgactggctcggccccggcgtgtacttctgggagaacgacgcgcgccgagcctacgaatgggcgcaggccaaggtggcgcaggggcgctacaaagatcccttcgtgatcggagcgatcatcgatctcgggaactgtctcgatcttctgcaacgcgagaatatcgacctgctcacggatgcctacgggagcctacgggagatcaaccggaaagccggcacgaagatgccgaagaacaaggacccgagggcagtcaacaagggcgacaagctcctgaggttccgcgattgtgcggtcatacggcacgtgcacgaagtcatcgaggacgaagagttgaacgatccggacggcgagcattacatcgcgcctttcgacacggttcgggggctgttcgtagagggtgcgcgcgcttatcccggcggtggcttcttctcgaaaacgcatacccagatcgccgtgagaaacccttgctccatcagaggcgtgttcctgcctcgcgacgcctcggcctga

SEQ ID NO: 8725 - DNA, 243 bp, Methylobacterium sp.
atggctctcgacgctgtgcccacgtgctgcccgttcatccagaagctcatcatgcttgttctggactgctcatccagaacgggagcggccaggaagcaggctctgttcagcgaaacacttcgtcttgagatggacgctgttcgtgcgcgagcgcccgagggttcgctgaaggtcatccgaaccatcagggagatcgccgagggagccctgaacctgccgcgacctctgcaggggcggctgtag

SEQ ID NO: 8726 - DNA, 285 bp, Methylobacterium sp.
atgagcacgcgccagcactcccgccgcctcatcgacgaggacaccaccgactacgaatggtccgccacgaagctcgacgagctactggctgatccggaggtcgaaggacttgctgcggacatgctgtcctacggcttcaggaacggcgagttcgaccccgatccggtctaccgccagtgccgggaggagtaccggcgcaaggagccggccgcgctgctgttctttctggccgcccgtctgttcgagcggcttctcgcaacgcaagcagcgaggcgtctgtcatga

SEQ ID NO: 8727 - DNA, 207 bp, Methylobacterium sp.
atgcaggtcgctctgcgtcggatcgaagccccctacggcgatgagcttcaggtgaccgtcgatgccgaggcgctctccgtccctcgtgtggtggccgtcgtgctcgcgaatgccgccggtgaggacgaggcggaccgcatcggcaaggccgtgctgaaggcactccagtacgcggagagcctgacgaccagcacaccgggaatgtga

SEQ ID NO: 8728 - DNA, 225 bp, Methylobacterium sp.
atgctcggtgccgtcctcggcgcagcgctgccggccctcgtgcgcccggcccaagccgagggctacgtggcccggacgcgcccttgcgcgcccgccccgtgccgccgcccgcctccgccccccgggttcggctacggcccgccgcggatcgtcagcggctacctgccgcgcaacaacaccctgccgatgtacaacgagcccccggcgcgcccgccggcctggtga

SEQ ID NO: 8729 - DNA, 1161 bp, Methylobacterium sp.
gtgatcggtgcccacacgccgcagggcgtgcccttcgtggtcggatcgcaccacctgcatcgggaattcggcgccctgggttacgcggccacgcacgttcccgtccccctcggtgccgaggacgtcttcaccgccgatcacctcaacttcaagcgcatccgggccgtgtcctggcaacggaccatgacccggcggcgcgatgcgcattccgatcgctcggtcgtctcactcgtgccctgggcggccgtcaggcggttcggcatggcgcggggctaccgtctcgggtacggcaggatgctgctgcccggtttcggagaggacgaccggtcgcctgaacttctgatcgtggatcatccgcggcaattttggctcgtccggcagttgaagccgaaaaccctgctctacagacccaccgacgcctactctcatgccggccacaaggaccatcgcgtcacgctggagatcgagggatggctgctcgagcgggccgacgggctcgtgctcaccgcgcggcagatcgaggaacggatgcggcagatcgggggcggacgcctgcccctgcccatgatcgtcgaggagaacggggtcgatctctcgatcttccgcgcgaagcgggccgtgacgtcccggacgtcggcgagggacggcggcacccgcctgttctacgtcgggtctctcgatgcgcgcttcgaccacgccttcgtggccgaggccgcgcgccggaaccccgattgcacgttcacgatcgcgggaccgccccacgccgatcacggcgcgacatacgaggaaatcccgaacgtccacctgctcgggcccgtccgccaccaggatctcccggatctgatgggccgtgcggatgtgggtctgctcccgctgagcgaccatccgttcaacgccacccggagcccgatgaagctctacgagtacgcggcggccggcctgccggtcgtctaccgggcgagtccggaactgtgccggcgcggcctcccgttcgcctttccctaccggggaccggacgatttcggcgcggcagtccgggcagccgccctgtatcgggagacgggcggcgccgagatgcgggcattcgccgaggcgaagtcgtggagaggtattgccgagcggatcctggatttcgcgcgccgggtcggagcgcgggtctga

SEQ ID NO: 8730 - DNA, 294 bp, Methylobacterium sp.
gtgctggtgcgctcggcgttcctctacgcgtcgcatacgagcgcgctggcgagtttgggtaaggttgccctgctgctcctcgtggaactgccggtcgtgacgctcctcgtcgccttcgtggtcaacgggttcgtcctgcacatcatcggcggccgcttgcggcggatgcgaccggggcggatgcccgtgggactcttcgcgcgccacaggtccgaacgggcggacgagctcgagcattatccgtcgcaccccggcggcgagccatcgagccggcagcccgatcacgagcgctga

SEQ ID NO: 8731 - DNA, 279 bp, Methylobacterium sp.
atgagaacggcaacgctgatcctcgacctcgcctcagcgatgctcgccgttggcggcgccgcgcaggcacaaggcatcttccgcgcggcggagcagggcgccgcccgcggcaacgcggtcgcgaggcctatcggcggcctcgtcggcgctggcgtcgggggcgtgaacggcgcacttggcatccatccgagataccggcgggtccacgccttgcgcggctatcacggttaccggcatcggcactgctaccggcatcggcatcactatcactgccgctga

SEQ ID NO: 8732 - DNA, 219 bp, Methylobacterium sp.
atgtcggctcgcaccttaccgagtgtctgggtcgcggcgacgcttgcgattggcctgatcggcgtcacgcaggctgcgcccctgggcgctgcccaacccaacgttgacgtgacccagctgtccactggcttgatcgtgaagagcgtgaccgcggtcgggatggcgcatcgatcggcccgccggacggcacgacgcgttggccggcgacacggctattaa

SEQ ID NO: 8733 - DNA, 276 bp, Methylobacterium sp.
atgttcggtctgaccgcacagatccgccgcgctgcgacctccgtcgccgcgaacatcgcggaaggccacgggcgtgagaccggcggagccttcgtccagttcctgcgcatcgcacagggctcgctcaaggagttggagacgcacatcatcctgtcgggacgtgtgggtctcctggcatccacgccggtcgccctgctgctggggcgctgcgaggagatcggaaagatgctgcgcgcgctgatccgcgcgcttcagaaacccgagggaggccgatag

SEQ ID NO: 8734 - DNA, 717 bp, Methylobacterium sp.
atgctccgtctcagacgttcggacccgcggggccgggcctcgctgctctgggtgctgatcacctgcgcgctgctggcgctcgtcgccgtcctcgtgctcaggctcggcaacgagcgccggagctacgccgaggcgatccgcaccctggagaccggccgggccgcgctccggcaggagatagcggaacggcaggcggcctccggctccctggcagacctcaaggccgagatcggacgggccgagacgcgggagcggacggtggcgcaatcggcgcgcgagaccgaggcgcaggtcgcggggctggaggcgcgccgcagggccgccgaggaggccatcgcggcagcggcgacgctccggaccgatctctcgcaggcgcgcgccaaggtggatggcgccctgcgcgagagcgacgacctccagcagcaactcgccgcctcgcgcgccgaccgcgatcagctgtccgccgcgatcgcggcgctccagcagaagcgcgccgaactcgcggccgaggtctccgcgctcgacgccgagcgggccgggcgcgtggcggaattggcgaagctcgacggtcttctggagaggacccgccgggaagtctcccaggcgcaggcgcgcgcggcggacggccaccgcaaggctctcgggcaggtcgaaccgtcggcgaccgatccgcccgatgcgtcgggcgaggaaccgggtgcgcccggcacccggtag

SEQ ID NO: 8735 - DNA, 132 bp, Methylobacterium sp.
atgcgcgcgtacgccggctcgaccggcggtgcctctgcccagctgctgcgtgctgcgcgggaactctcgcaccattcggagaacctgcaccgggaggtgggcgtgttcccggccggcgtgaaggcggcctga

SEQ ID NO: 8736 - DNA, 324 bp, Methylobacterium sp.
atgcgtctcgtcccgttgttctccgcgattggccttgcggccattgccgcggtgactgttcagcccgcgccggccaaggccggcccgctcgacgggctggccggggcggcggtcggtttcgcgctcggcgcgatggtggctggccagcgcccggcctacgccgccccgcgcgggcgccgcgtcgtctaccggcaagccccgcggcgccacgtcgcccagcgcagccgaccggtcagcccgcgcggcgcggcgatcagcactgtgtccgacccgtttgccggtgctggcggcggtgcgaaaccgatcccggtcgcaggcaactga

SEQ ID NO: 8737 - DNA, 438 bp, Methylobacterium sp.
atgtcgcgcttcatgactctcgctctggccggcgccacggcactcgggacctcggtcggcgccgtgcagaccgcgcaggcggccccgctcccggccctgtcgggcaaccaagtgggcggcgccaacaccgcggtcgaccatgtcggctggcggcgcggctattacggcggcggctacggctaccgcggcgggtacggcggatacggctacaggggctacggctatcgtcgcaacgtcggtggtgcgctcgcggccggtgcggccctcggcctgatcggcggcgccatcgcggcgagcgcggccccgcgctacggctattacggcggcggctacgggggttacggcggctacggctaccccgcctacggttatgcgccggtcggctacgggtacggttatccggcctatggcggctattacggatacggcggctggtaa

SEQ ID NO: 8738 - DNA, 108 bp, Methylobacterium sp.
gtggcgcagctgatggcgggtgcggacccgacgctgctgccgtcgcggatggagcgggcccggcgggccgccgcgctctacgcggaggcggcgcggcgggtcgcctga

SEQ ID NO: 8739 - DNA, 1386 bp, Methylobacterium sp.
gtgaagtcgatgtcggagtctttcgagagcgtacgcgatccggtgctgtcccttttccagtcggcggtggcggaggtcgccgaacgcatcgacgccaagccctccggaccgggtgcacggcggctggaacggtcggcctcggcgacgttcaacgatgaggcgaccgcaatcgcgcgacgggagtgcgggcgcgacgcgggtatcgggtccggggtacggccttcctcgccggcggcgcgggatctgtccccggtcgatatgggaaaggtgtgcgtcgaactggccttgcgctacgttagggccctcgccagtgggaaccagactgcgctcgccgagatcgaggacgaatacaggaccgggacctgcgacgtggaatgggtgacgaccctgcgcgcctacgcggggtatttcggtccggacgggaagcggaagccgatcccgtacgtccggccggcgtcggccggtccgggaacgcacgagatcaaggccggttcgcgccttgcgctcgtaagcgattggggcaccggcgcacggccggccatagaggtcttgaggtccatcgcaggggtgcacccggacgtactggttcacctcggggacatctattattcgggaaccgagaaggagtgcgaggacaacttcctccgcccgataacgcgggagttgcggaccaagcgaccgaccctggtgtacacgctgtccggaaaccacgacatgtactgcggcggggtcggatattacgacctgctgccgaagctgaacgaggaatccctccgacagcgcgcgagtttcttctgcctgcgctcgacggacgagaggtggcagttcctcgccatggataccggcctgcacgacgacaatccccgctcgattgccgatgccctgacccacctcgaagacgacgagctggaatggcattgccagcggatcgaggagtttggaggtcggaccatactcctgtcgcatcaccagccgttctccgcgttctcggctatcggcgccaagccggcgcaaggcaagcggaaggcgagcaacccccacctgatgcgtgccttcgagcgcatgaaccgagagggccgcgtggcggcttggttctggggccacgagcactcgctggggatctacgagccgttctcggggataaaagtcggtcggtgcatcggtcacggcgccgtcccggtatccgtcctcgacgacatctacaagcctctcgacgacctggagcagacgcccgccatcatagagggcacgaggcttcagacgcgcggcggggtcttcgcccatggctacgccgtcatcgacgtcggggtcggctcatgtcgggcccgatacctgcaggtcaccgatgccggcacggaggaaatattctccgaagagatctcatga

SEQ ID NO: 8740 - DNA, 285 bp, Methylobacterium sp.
atggctcgcgaccgtgcggatgatgacgcgctcatcgaggaactggcggccatcgagcacgagcggtggtcccactggcagcgttacgtccacggcaaggcggcccgccagccggacggctcgctggtcctccccgccgaattggtcgagcgatgggagcgccaattcgactcgcagtacgaggatctgcccgaggacgagaaggagagcgaccgggagcaggtccgacgatatctcccggtgctgaagcgctggtcccaggatgacgaaaaaaggagcgggtga

SEQ ID NO: 8741 - DNA, 984 bp, Methylobacterium sp.
atgcggaaggccttgatcatcggcatcgaccactacgaccgcctcaagccactgaagggctgcgtcgccgatgcgaccgccgtcgccgacgtcctcgaaaccaatttcgaccagtcggtgaacttcaccacgcccaggctcctgacggcgacggacaggggcaacccgctcgaccgtcggcaactgcgcacggaggtcgaggccgtcttcgcgagcgatcccgaggtagccctgttctacttcgctggccacggtttcgtcgacgagacgggcggcttcctctgtgccagcgacagccaggacggcaacgacggcctcccgcttagcgaaatcatgacgttcgccaggcagtcgaaggcgaagaacaggatcatcatcctcgatagttgctacggtggcatagccgggaaccgggccggcggcggcggcgtcgccgagatagccgagggtatgaccctccttaccgcttcgaccgagaaggagtacgcgtacgaaggcgggaacggcgcccccggtgtgttcactaacttgctagtccacgcgctcgacggagcggccgcgaacctcgtcggggatgtgacgccgggcagcgtctacgcccacatcgaccagtcgctcgggccgtggggcgggcagcgaccggtgttcaagaccaacgtgaagtcgttcgtgtcgctgcggagggcgaagccccctatatccctcgcagacctgaagaagctggccacgctcttcccgaccccaggtcacaggatcaggctcgatccatcgttcgagcctgaaagggaacggccagatacgggggtggcgcccgatcccgcaaatactgagatctttgcggtgctccaaagctttgtgaaggtgaacttagtccggccggtcggggcgccccacatgtggcatgccgcgatggacagccaaagttgcgaactgaccgtgctcggcgagcactacaggcgactggtggccgagaagctgatctga

SEQ ID NO: 8742 - DNA, 213 bp, Methylobacterium sp.
atgacgaagatcaaaggtcgaaacgacggccccggggggcgtaacgagcattacgacatcgggtcgcgcaagaacgtgcctcgccgcaatgtcgtggctgagatcaagcgcggcgaacaccccggcgcgcacgtcgtgacggtcaatggccgggagtacgcgcgggacaatcccgacggctcgacccgggacaacgtgaacagggatccgtaa

SEQ ID NO: 8743 - DNA, 396 bp, Methylobacterium sp.
atgaagcgcccgcggatcgaggcggtccccaagcaggtcgatgtcgtcaccctcgcggatggccggttcgcgaccaagccgggcattgagctggagcggttcctcgacaacatcctcgacatccgcgaccacatcgtggccggccggccgctgcccgagcattactatcggcgcagcaccggacgcgactacctgctcgagacacggggatggctgcacctgcacgtcgggcacgacatcgacgacgatgtcctcctcatcgtcgagcagacccccgagagggtgatcttcatcggcctcaccgatcacggtatcttccgggagcgcccggccggcaaatctttcgcccggctcggcagccgcatcgcgaaggccaagctgccagccaaacggtga

SEQ ID NO: 8744 - DNA, 198 bp, Methylobacterium sp.
atggcactgccgaaatccgatcgcgagccggcagcacggccggagcgtccccgcgacggcgatctgatcccgaacgagacgtcggaatccttccgcttcgtcaggcgcgcgctccgccagggccgggtcgtgagcacgcagggtctctcggatgcggaggttcgagccgttctgctcggtcagcgcaaggacgcatga

SEQ ID NO: 8745 - DNA, 225 bp, Methylobacterium sp.
atgaagctccgcatcgcaggtctggccgccgctgccctggtgctgctccccggcgccgcctccgcgcagtggtacgagcgcgagccgcgccatcatcaccatcaccactgggaccaccaccatcaccatggcgaccgccacggtgacgagcggcatcaccgccacggctacgaccgccccatccacttcgaccgaggccaccatcatcaccatcacgggtactga

SEQ ID NO: 8746 - DNA, 552 bp, Methylobacterium sp.
atgacctaccttcgctacgcccccgacatcgagcggcctgccccggacgagcaggagaccatacacggcatcatcgagacagcccatccggtagccacgctccgcctgccgcgccaggacgcctacgggccggaccgggttcgcgacttcgacgaggtgatgaccttccgcctcgatggccgagcggtcgctgaggccccggtcgttgccctgccggttcggggtggtcgggtcgtggatctggaagaagaactccaagatgcgccggtaactcgtcctggccggatcgaagacgatctcgatgccttcggcatgcgtcccgtggtttcgataggtggcatccggcacgtcgccacccgtgtgccgctgagcccaattgcgagtgacggtttcgtgcggcattggccgacattggcgtcggcaggcctggatcgcagctctcgaccctttgaggacctagcgtcgcaagtcatccggatactcgttgacagcgatcatagcctgatctgcgagaccgccctgtgcctccacatactgatgacccgcggctga

SEQ ID NO: 8747 - DNA, 114 bp, Methylobacterium sp.
gtgacctgcccgcacctgcaaagcacggagaccttgatcgccctcgatctcaaagatgggacgctcaccccggcgaagttccaacaggccatcactcagacgtgccatgtctga

SEQ ID NO: 8748 - DNA, 432 bp, Methylobacterium sp.
atgaccaaggccccgactcaggccatgcgcgggatggcgctcgctctggcgctcgccctgttgccggcgcccgccgtcgcccacggcgacgccgcgccccaacccatcgacacgaagggtctgccggagcttggcgacgacatccgcacggcgaatccctacgcgggcaacgcgctcgcgatcgagatcggcgccaatggctacaaccagaactgtgcccgctgccacgggctcgacgccaagtccggcggcatggcgccggacctgcgcgaggtcgaggcgggcgaggccggcgacggctggttcatcacccgcgtcctacacggcgccaagaaagacgaccgttaccgaatgccccccttcgaggggatcctgagccaggaggcgatctgggcgattcggacttacgtcgagagccagccgaagagctga

SEQ ID NO: 8749 - DNA, 258 bp, Methylobacterium sp.
gtgtccggggccgtctcctcgttgaggtacggcttcaccgcgggcttgccgggcttcaacgtgtccgacccgaccgacggtgcggattgcgggccgggcgccgcggtctcgggcggcgcggcgggcttcggtggctcggagcgggccggtcccggtgccagcacggacgccgtcccgagtacgagggccagaagcgccggcgcggcgcgcgtagaggaggggcggagcatcgggttctgcagcgtcacgatcctgtaa

SEQ ID NO: 8750 - DNA, 225 bp, Methylobacterium sp.
gtgagggcgccgatctcgcgtcccgcacagggcgagaccgcctccggcaccgacacgctggcccgggcgatgcgtctggcgacgcaggccgccgatgacacccagggcgcggcgggctcgatgcttgccgtgtccgacggcctcgggcgtcagagccgcgcgatcgagcagcaggtgcgcggctctgacgccctgcgcgagccgcgcccgcgcgcggcggcctga

SEQ ID NO: 8751 - DNA, 1194 bp, Methylobacterium sp.
gtgatcgagcaggcgttccgcgtcgacgagcgcgaccgtcgccgccgggagaccgtcttcggcctagcgcttgggaccttcttctacgtcgccgtgctctcgatcgactggatcacggtaccggacgtctgcgagctgaacctcgtcgtgcgcctctgcatcggcgtgccggtcaacttggcgatgatcgggctcgtcgcacgccgcgactgcggcgatgccgcccggcaatgggccgcctgcattgtcggtctcgcctgcagcctgaccatatccgcggtgatggcgctctcggtctcgccgggggcgatcgtctacgtcagcgtcaacctcgtcatcctcggctttaccatcaatctggtcgcgctgcgcccgggcgtggccgcgctcctctgcgtcgtgatcacggcgatcatggtcgccgccgctgcggcctcgccgttcgggacccccggggtggtgctgatctacgtcgtcctcggaaccatggtgacgatcgtgtgcgtcttcgcgaattggagcctccagaacgagcgccgccgcaccttcctgacgctgcggcgggacaagatccggctgcgtcagatctcagcgcagcgcgatctgctcgaacggctcgccgcgatcgaccccctcacggggctcgccaaccgccgcggcttcgacgcgatgctcgacggcgatatcgcgcgggcgagcgccggcatgggcatcggcgtggcgatgatcgacatcgactgcttcaaagccttcaacgacacctacggacatccgcgcggcgacgcggtgctgcgcgcggtggccgccgcgctcgcggaggcctgcggcccgggcgtgcggctcggacgcatgggcggcgaggagttcgcggcggtcgcggtgggggccgaaccggccgccctgcgcgccctcggcgagcggctgcgcctgggcgtggagacgctcgccctgccgcaccggcgcaactcggccgggcgcgtggtcacggtcagcgtcggcctcgcctggacctgttcggcgggcaccgccgaccgggccgcgctgttcggggccgcggacacggcgctctaccgggccaagggcgcaggccgcaactgctcggttggggcggccgatgagctgtgcgcggcatccccccgcggacctggagatgcccggacttgcacggagcccgtggtgcgaaaagccttctag

SEQ ID NO: 8752 - DNA, 477 bp, Methylobacterium sp.
atgaagcgggttcttctcgcatccagcctcgcgctcggtgcgctcgcgatgatccccgccgccgccgacgcgcgcgggttcggcggcttccacggcggcggtttccacggtggtggcttcggcggtttccgcggcggcggcttcggcggctggcggggtggcggcttcggataccggggcgtcggtttcggcggcggctggcgagggggctacggcggctggcgcggcggctattacggcggtggctggcgccgcggttacggctacggtctcggcgggctcggcctgggcgtcgggctcggcctcgcggctggcgggctctacggtggctacggatatccgggttacggatacggctacgcccccgtcggctacggcgcctacgattacggctacggcggcggctgctacaccgtcccgcgcgtgcgctggacgccctacggctaccgcagggttctggtcgagcgctgctactga

SEQ ID NO: 8753 - DNA, 351 bp, Methylobacterium sp.
ttgaacgcggcgattcagcgggaatggaccgtcaacctcggacgccgcacggccctggaacgcctggcacatctgttctgcgaactgttcatccggttgcgcgccatcggccacacggacggcaattcctgcacgttcccgatcacgcagatcgaattggcggacgcgacggggctgacgagcgttcacgtgaaccgcaccctcagggaaatgcgcgccgctgggctgatcatcctcaagggacggcaactcacggttccggacctcgcggccttgcggaaggcgggcctgttcaaccccaactacctccacctcgaatgcgacggcgcgcatctcagcgcgaatgcctag

SEQ ID NO: 8754 - DNA, 117 bp, Methylobacterium sp.
gtgccggtccatcagatcgagcagcacctcccggggaacctgcgcgaggcgcacgggcgtgatcgcggcgatcacgtgatccatctcgcgcaggatgaagacgtgcaggtcgcatag

SEQ ID NO: 8755 - DNA, 111 bp, Methylobacterium sp.
atgacccgcctgaagacccgtctgaccgccgtcgccgttgctggcctcgccgccgccgtcgccctggccgcctacgcgcagactctcgccctgccgacgcatttcatctga

SEQ ID NO: 8756 - DNA, 348 bp, Methylobacterium sp.
atggctctgccactctgcgttgtacggtggctgcgctccgcccgtacctggatcgccctgggcatcttcgcgccgctccgcatgctcgtcatgtcgtggacgatgctgaatgaggcgatcacccaggaggccgcgtgcggtgtccgggtcgatgcggtacgcttggaacgcgtggagggggttctcggcggctctgccgcggcatcatgcgcgggacactcaagggcgttctcagcctacaacctgcatatgctgcgccgccgcactcatctgagcctctgcatcgcggtcggttcgacgctgattctgactacggtcgcggccgttgcgctgtgctggccatcgtag

SEQ ID NO: 8757 - DNA, 504 bp, Methylobacterium sp.
gtgccgagccgggctaagcccgcgccggtcgccaacggcccgcgccggagtgtctgcggccgatcgcggcggcggtcacatcctcgttttccgcttcgggcctcaacccgtcggccctctcacggatcggcgtggcctctagagcgctctccgccgaagtggacgccggttcggcgcaagagagcgcgttacaacaacggctctgagcggatcgacgcgatcatcgaccggctgctcgaggtcaccgagcaggcgcgggcgctgacggatccatcggccatcgaggcgctcaacgtcgagatcgaccgtctcgccacggaggtcgtgcgctatgcccgggagcgggagcgggagccggacgggcggacgatggcgagcgtatcgatcgccatcgatacggccaaggcgacggtcgccgactgccgcaacctcgtcggcagtcccaaggaacagagcccgcttcggatcctccggcccgtccgcgcgcccggaccggacgcctga

SEQ ID NO: 8758 - DNA, 90 bp, Methylobacterium sp.
atgccgggctgcgggcacttcccgcaccgggagaagccggacgccgcggcgcaggggatcgcccggttcctcgggcaggtgacgggatag

SEQ ID NO: 8759 - DNA, 963 bp, Methylobacterium sp.
atgttggcgctggctgccgtcctcggcgccctgctgcccgcggcagcgcagacgagctatcccacgcggacgatcacgctcgtcgtcccgttcgcggcgggtggaacgacggacatcatcgcgcgcatgatggccgaccatatgagccggacgctcgggcagtcgctcgtggtcgagaacgtgacgggagccggcggcaccacgggcgccgcccgggtcgcgaaggcggatcccgacgggtataccctgctgatgggcaacctcggcacgcaagccgccagcgtcggcctctatccgcggctgtcctacgacccgcgcaccgacttcgcgccgatcatgaactccgcctcgacgccgatgctggtcgtcgccaagaaagacctgccggtaaaggacttccgcgagttcgtcgcctacgccaaggcgaacgcggccaagctgaactacggctccggcgggcacggctcgacctcgcacctgacctgcctgttcctggacacgctgatcggggcgagcccgcagcacgtcccgttccgcggatcggggccggcgctcaacgcgctgctcggcggccagatcgactacgtctgcgaccagacggtcgccatcgtaccgaccgtgcaggcccgggaggccaaggccctggtcgtcgccgtgaagaaccgacttccggtcatccccgacgtgccgacctccggggagcagggcctgccggagttccaggcgacgggctggaacgcgttgttcgcgcccaagagcacgcccaaggcgatgatcgacacgctcaacgccgcggcacgcgccgcgctcaaggacccgacgacccgcaagcggttcctcgaactcggcgccgagttgcccgaggaggcggagcagaccccggaggcgctcggcaacctcgtccgcaccgagatcgacaaatgggtcccgatcatccgcaaggccggggtgaccgtgaaatag

SEQ ID NO: 8760 - DNA, 324 bp, Methylobacterium sp.
atgtcgaacgaacagcaccagggcctacctgtcgccggctaccaagcgcagacctcggacaaggtcacggtcgtgaacgcgaacaaggaactcgaggagcgctgcatccgcgcggccgagagcatccgcgacacccccggcatggacggccgcatggccgccctcgcgatcaccaacctgcagcaggccttcatgtggctgaaccgggcggtgttccagcccggccgggtggccctgccggaggacgccgccgagccccgcgtcccgcgccacgatcccgaggccgcgcccgccaccgcgctcggcggtcgcccgcacccctga

SEQ ID NO: 8761 - DNA, 939 bp, Methylobacterium sp.
atggagatgatcgccaacgccggcaccaatccggccgaccccttcgactggtaccgcgccgcgctcgccggccagatccacgagctgcgactgggccacgcgccctgcggcttcttccggttgcgccgccgcgacggcacgctggagccggtcgcggtgtggcccgacgagggcggcttccgctgggccaaggtcggccgtgcgggcgagcccgagtgcttggtcgaaccggaggcggaggccgcgttctgcgagcgcgtcatcgcgcattgctggcgctcgcccgtcccggaggaggtctacttctccgtcgtcgagaacgacgcgccctggcccgacatgccgccggagcgcacgaccgattacgccaacatgccgagcgacccgctcgaggccctgcgcgtcgagctggagggcgagcgcgccgaggccgaggcgtggctggccgcaggcccgatcgccgatcaggctgccgctgaccgcgccgcgaactgggcgctccgcttcgccgacatggaaaagcgcgcccaggacgggcgccgcgccgagaaggtgccgcatgagaaggccgccaaggcggtcgatgcgcgttggcgcccggtgcaggacgatgccgccgccctgaaggctcgcctgaaggacgcgcagacgccgttcctcgtcgagaagcgccggcaggaagccgaggcccgcgctgccgcggcccggaccggtgatgcgctcccggccgccagcaacgcctcggccggcaccgccggacggaagaccagcctgcgcaccgtccgcaccgccgtcattgaggacttcgacgccgcgctgatggcgctgcgcgagaaccccgagcttcgcgagctcgtccagaagctcgccaaccgcgtcgccaccagcggaggggccctgccgggctgccgcatcgtcaccaccgacaaagccgcctga

SEQ ID NO: 8762 - DNA, 225 bp, Methylobacterium sp.
atgaggcatgatgcagtcccgacggctcgctacgtcatcaccgccacagcgcgcgaaggcatcgttcagcagacgcgggtgatggccgcgagcgccgtcgtcctggctcggtcctggcaggatcgcggctacgccgatgtgaaggtgatcgacccgaagggcgatccgctcagtcccgaggcgttcaggatcaagttcatggacggcgtcaaacgcttccgttga

SEQ ID NO: 8763 - DNA, 177 bp, Methylobacterium sp.
ttggacgtgcggaagtatttcgggaccgacggcatccggggtcgggccaacggcgtgatcacgcccgaactggcgctgaaggtcggtcaggcggcgggcctcgtcttccagcggggcgagcatcgccaccgggtcgtcatcggcaaggacacgcggctctccggctacatgatcgag

SEQ ID NO: 8764 - DNA, 201 bp, Methylobacterium sp.
gtggaacgccgacacgccgagcggggcatccgggtgaactgcgtcgcgccgggcccgatctggacgccgccgatggtgccgatgaagcgtcccggccagccgagggggctcgcccccgtctacgtgatgctggcctgcgaggcggcgagttgcgtctcgggcgcgaccgtcgcggtcacgggcggcaagccgatcatctga

SEQ ID NO: 8765 - DNA, 180 bp, Methylobacterium sp.
atggaacgcctctatcgcggcctcgagaccggcctgctcggtctcggcctctgcctcggtctggcagccttcgcggcgatgtccaccccgcgcgacgccctgatgccgcgcgaggcggcgatgccgctcgccgtgacgctgccgatgctcacggtcgtcacagagcgcacgccgcggtga

SEQ ID NO: 8766 - DNA, 276 bp, Methylobacterium sp.
atgccgagccttcgccacctcctcgtcgatgccgcggccgtcgcgctggtgggcatcggcctgaccgccgccgccagcgggtacctgcacaacctccccgacccggcggcggcgagccctcccgcctgggacgagccgctcacgaccggctcgatcgccccacgcggcgcggcggtcgagaccgaggcgtcggcgcccgcggaggccgagagcccgcccgcctggatcgatccgccgctgcgcgcgtcccggctcagccgccatcgcccgtcctga

SEQ ID NO: 8767 - DNA, 96 bp, Methylobacterium sp.
atgttcgcgtgcgccttctgtcacgtctcaccgcagagcccagggcacggggacttcgccgggctcaggctctcgacgcaggagcgccagatgtag

SEQ ID NO: 8768 - DNA, 522 bp, Methylobacterium sp.
atgctggtggatgacacgcagcgcgccgctgagccgcttgcccgggtgatccgcaagctcggcgtcgtgtcgttccacgacgagcagcctggcgacgtgcattggtgcgctgaggcgcagcgcttcgagtaccgcgaccgggccgacccgagcagggtgctgttggagtacgaggagggtgggttcatctactatctgccggtcgatgcctcctcgcttcgccctggcgagactccagcccgggtgcgcgcgccgacgacgctgatgacggctggcgaagccagcgagtggctcaacgctaccagagacaacggggacggcgccgacgtgggtcctgactggaagccgctggacatcatctgcgatgcctgcggcgtggctcagctccaggcgcgcagtacggctggccgcgtggattgccgctgccctgcctgcgaggacagcacagcggcgcggcggccggttgcggcgggggcgagaggatcgggtttcggcgggatagagggttcgcgtggtgagtga

SEQ ID NO: 8769 - DNA, 135 bp, Methylobacterium sp.
gtgggcaaaggcccgcgcttcatcaagatcggcggccgagtgatctacaagctgagcgacattgagcagtgggagcgggaccgccgcgtcaaaagcacgtcagagtatgagggtgagacgtttcagggcgcctga

SEQ ID NO: 8770 - DNA, 1104 bp, Methylobacterium sp.
atgcacgttccgctgagccaccagagcgcaatggaccagctgctggcggcaatggctgctcaaggcatcgagccgacacatccgctcctcgccaatggcaagcttgagcgattccacgtcgaaggcgatcacaagggcagccgcaacggttgggcatgcatccacttggatgccgccccggccggccaatttggctgcaaaaaacgtcacggggagcacaagttctcctggcgtgcggctggcatcacgaagccgatgaccgctgccgagcgcagggcgcaacaggccgagtgggatcgcaagaaggccgagaaggcggcggccgagcgcaagcgccatgctgatgcagctgagcaggccaatgccaagtgggtcgccgccgccgaggccactgatgaccacccgtacctggtacgcaagcgcgtcaaggctcacggcttgaaggtcgggacgtgggaattcacgaacaccgacactggcgagatcttcacgctcaccgacaacgctctgctggtgccgatctgcgacaagagccggaaaatccacagtttgcaggccatcttccccgacaagatcctgggccagggcaagggggcgcgcgacaaagacttcaccaagggcgggcggaaagctggcctgttccatgtgatcggccgcccgcagcaggttgacggtcgtgccgtctacattctggcggaaggctacgcgactggcgccaccatccatgagctcactgggaattgcgtcctggtgtgcttcgatgcgggcaacctgctgccggtggccgaggcgatccggtcgagcaagcccgacgcaatcatcgtcctcgcggccgacaacgatcagtggaccattaccccgatcgagaaccctggcgtgcaccatgccacccgggctgctgccgccgtcggcggtctgctggccatcccgccattcgcctgggaggacggcaagcaggacgacgagggcaagtggtctggcccgtccgacttcaacgacctgcgcgcactcgacggcgtagaggcggtgcgcagggcaaggtcgcagccatcaagcagcgtcgtgctgctggcgacaagcgcgatgacgacgccggggcgatga

SEQ ID NO: 8771 - DNA, 132 bp, Methylobacterium sp.
gtgagcgcgctggcggctctgcgccgcgacctccgcacccttacccctccgcaggtcctcctcgtcgccctgactccgctaggcgcctttgcgctgggcatgctgatcgtgttccccgccagcttcgcctga

SEQ ID NO: 8772 - DNA, 120 bp, Methylobacterium sp.
atgacgaagctcgacgcgaagaccctgaaggccgtcaccggcggcaccgcctgccctccggccaaggacccctgcgcccccgcctgcaaggacagcggcggcaagtccaagaagtgctga

SEQ ID NO: 8773 - DNA, 117 bp, Methylobacterium sp.
atgacgaagctcgacgcgaagaccctgaaggctgtgaccggcggcaccgccaagtgcgacccgaccccggcctgccccccggccaaggacaacggcggcaagtccaagaagtgctga

SEQ ID NO: 8774 - DNA, 252 bp, Methylobacterium sp.
atgaacgacgatccgctcctcgcacggctggacgccgctctccgagaagccgagcatctgcgcctcgaggcgctgcgggtgcagcgggaggccgccgtgcgcctggccgagatccgctggtcgggcatgggcctgagcgacgcgatggaccgcagcctcgcgctccgcttggggccgcgcccggcgcgcccgggcggcgagaccgcgccgacgagatcggcgatcccggccgggctcctcccgcacgcgtga

SEQ ID NO: 8775 - DNA, 99 bp, Methylobacterium sp.
atggaagacatacccgaatcccgcatcgagcacgtcgcgatgatggagggcatcctcatctcgcgggcgaccggtggctcgcccgacaggcatgcctaa

SEQ ID NO: 8776 - DNA, 864 bp, Methylobacterium sp.
gtgacggtggagatccagaccttctcggatgctgctgagcttgaggccgatccgctctggcaggaggcgcccatcacgaagagggtccggccgatgctgttggcccgccccttccgcgggacgcgcatccgaccggtcatcacgaacggcggagacgcgctagtcctgcattttgctacgcccgacccggcgtttggcaaaggcaccgtggtatcggcctcaccgacacgacagatcatgaggcgccaggatcgcatcctcatcgtatgggcggaccgggtggaggtcatccatcgcggcggctccgttgacttcgccaagcgacgtgcagtggacgaggcagccaaggatctcctggcacacatgtactcggcgacggcccgggccaacgaggtgcgacagcaggttgcagtcgaacgcatcagaagggctcgagtccgtctaactgcctcagaaagccttctgcgggcggctgtcgaggcggtcgacgaaatggagccgggcgatccgtttctcggcgtcgccgtcgaccacttcgtggcatgtgcccggcacttggaggtcgaccgacagatgctcggggagatctgcgaccgcgtggccattgagccggggatgccagacgatgtcgtggtcgagatgttggggcggcgcctcgaagtgatgacgccggaagtatggtgcgggctggcggctgcggctggcgccggagcattcgaaccggtgcggatcgagcaacatgtgaacaggcttatggaggggcctgacgagctctgcctgtatgaacaagtccgcgtagcagccgagatggtggatgcgcatacgaacgacgcagccgctggatttccggcgcgaggcagttga

SEQ ID NO: 8777 - DNA, 657 bp, Methylobacterium sp.
atggcccgaggccgcgccgtcccgcacgccgtccgggagcgtgcgctcgacctctgggccttgaccaccggcatgtccggcgtcggcatcgccctcgccgtcggcatccgccatggcaccctctccaccatcgtcgcccgggccagggcagcgggcgacgcccgtgcgatccaccggcaggccgggcccatcctcggctcgaagaaccgcgcggctaagcccaggccggaacgggccctgaacctctggtcgaccgatcccggcatgtcggcgccggagatagccgcggcggcggggatgaagctcgccggcttcctcagcctgctgaaccgcgcccgcaaggccggcgacccgcgcgccgtctaccgggacggcaagccgatgcggacgccgcgcgagccaggggcggcgtcgacccgcaggcagccggcgttcaggcgcgggccctaccggacgcgcagcgtcgcccgggcgctccgggacgacatcctgacctcgtgggccgagggcctcgacggcgagacctgcggcgcccggtacggcgtcaccccggactacgtcctccaggtcgtggcacgcgcccgcgaatccgacgacccccgcgccctctggcgccggggcatgtcgcctacccttcgagctctgacgccggcatga

SEQ ID NO: 8778 - DNA, 99 bp, Methylobacterium sp.
atgaccctcctctccgttgaactcctgcccatctggctgctccccctcgccgtcatcgccttcgcgatgttcgacttcgaggagggcatggacccctga

SEQ ID NO: 8779 - DNA, 87 bp, Methylobacterium sp.
atggcggacgtctgcctcgcgtacgggcgggaagtcctcatcgcgcggccgacgacgcgggcgtgcccccgggccgatgccagctag

SEQ ID NO: 8780 - DNA, 171 bp, Methylobacterium sp.
atgcgcgacctgctgaagatcctcgccgccggcagcctgctgacggtctacgccctcgcggtgccggcgctgatcggtgacatctccgccgcgccccggcgtcccgggacggcgatggtcgcggaggcgcccgagccgttcctgccggccggtgcgccgcgatccctgtag

SEQ ID NO: 8781 - DNA, 495 bp, Methylobacterium sp.
atgggagaggggggttggcgcggttcaccccccacggacgaaccaatcaaccggagaccgtccatcaagggcgaagacggtcgtgtcgtcttcgacggcctcttcgatttcagcggggcgaacgaggcggccttcacgctcgagacgaagctcgacggggacaccacgcgcacgggcacgatcgtgctcaacgccgagaccctgggccgcctgcaggcgaggctcggcttcgccgacctgtcgaagctcacgggcccggatctcgtgcggtcgatcaacgcccagatcgaggccacgggcgagaccgggctgaggggcacgctcgcggcctccctcgatcccggggcagcggcacggcttccgccgacgcgacccgcctcgtcggcgcccgcaccttcgcgccgaccgacacgttcgatttcagcggccccctcgacgcgagcaccgcccgggagctcgactatatcggcgcccaagagatcagcttcgatctga

SEQ ID NO: 8782 - DNA, 1197 bp, Methylobacterium sp.
gtgacgccgcgcaccggccggatcaccctcaacgcggagatcctcgacgccttgaagacgcgcacgaaggtcgaggcgctcgcctcgatgacgttgtccagggtgacgccggacgagctcgtcgccgcgatcaacgcgcagatcgaggccacgggcgacgcggggctgaagggcaccgtgcgcgccgccctcgacgcgacggggcggatcaccttcacgaccggcgactatggcctgtcgggagccgcggacgggacgggcgcccgcaccgaccgggtctacgcggcgtccggctcggaacggacgatcgaggtccggagcgccgacacgagccggctcttcacctccggcttcgacatcggcttcggcatcgaccggaagcgcgacgcgagcggacagggaagctggcgcgacggaacggcggccctggtcgccggatcgcgcgcctacaaggccagcgacacgatcgacttcagcggcacgaacgaggtcgccttccggctcgcgacgcgcctcgacgcggcgacggagcgcgcggggcgaaccggactgcagggaaccgtccgggcctcgctcagcgcgaccgggcgcatcgtcatccggacgaccgactctctcgatctcggtgcggacgggacgttcggcggcttcggcaaggacggcgacaccgcctattccggggtcgggagcggacggacgctgtcgctccagaacatcgaccggacggccgcgacgcagaccgggatcgatatcggcttcggcatcgacaacggtcccgatgcgaccgcgcggaacgcgacgcgggcgtacctgcgcgaagccctggaagcggatgcgggcgaggacgatgccggcgtgcgtctcgccctctatttcagccgcatcggtccgagcatcaggtcgggcttcgacatcctggccgacaaggcgttgtcccaggtcatcgcgacggttctgaacctgcccgagaccaccggctcgtcgagcgaggcggtcacggcccgcgccaggctgatcgagcgccggatcgacatcaaggcgttccaggaccccaggaagctcgaagcgttcgtcggccgcttctccgtgatgtgggacatcaggaatcgcgcgccatcgccggccctgtcgctcttcggcggcaccggcggagccgaaccgctctacagcgcgatgagccgacgaagctggttctga

SEQ ID NO: 8783 - DNA, 99 bp, Methylobacterium sp.
atggtgcggacgggcggcatcgacgggcaggccatgacttcgctcgagctccggagcgtgcgcgggccccggccggaccgctcggccgatcggggatga

SEQ ID NO: 8784 - DNA, 939 bp, Methylobacterium sp.
atgatcgagtatggaaagttcctgacgggcggcggtcgcatggccatcaagatcatggagcacgactggggagcctcggcactgggtctcgtcgaggcgtggccccgtgccttgcggtacaccttgagcggcatgctcaactccgcctttccgacctatctcgcctggggccccgaactcatcagcttctacaacgacgcgtatcgccccatccttggcatcaagcccgaggcgctcgggcgccccttccccgaagtctggagcgaggcatgggagcagatcgggccgctgaccgaccgcgcgttgggcggggaggccagttacctggaggattacaccgtcacggtggatcgccatggagcaagggaacggaccctctggacctttgcctactcgcccgtccgggacgaaggcggcagcgtgcgcggcgtgctctgccacgtgcacgagacgacggggcgagcccgcacggaggagcggctccgatccgctctgcgggagatcgaggtgcaacaggcacgcttcggcgccctgatcgagcatcttcctttcgcagccggcctcttcggggccgacggaagagcattgctcgccaatccgctttgccgacggttcttgccgagcggcaaggcgccctccgtcgatccggacgcgcggacgcagtggaccggcttcgacgcagagggccgcatcgtgagcccggacgactacccgctcgcgcaggcgatccggggcgaggtcgtgcgggacatgagttttctgcaccgcaccagggacggtgacgcgtgctggatgcgggtcagcggcatcccggtccggcaaggcaatggcggtatccagcaggccatcgtggtgctgcgggacgtcgaccgcgagacccgcgccgaggcggccctgcgcgagagcgaggagcgcttccggcgcttcgccgagcattcg

SEQ ID NO: 8785 - DNA, 87 bp, Methylobacterium sp.
atggccaccgtcgcccccgccgtcagcagcgcagcagtcatcgtactccggatgagtttgttcatggggcgcttcctcgtcctgtga

SEQ ID NO: 8786 - DNA, 354 bp, Methylobacterium sp.
atgccgagatcgcgctggctgccgggtctcctcctgtgttccctgaccctgtcggccgcgcacgcggcaccgtccggcgggccggtggcggagcatgaccggacgatcgcggacgccgccctgaggcggcagatgaaggccccccggctcggcgagatctggtatcgccgcgaagggcggacgctgtgcgggttggtacggaacacgccggggaccgacgaggccggctggcgcatgttcatggtcgtgctggagtccggccagagcctcgtcgagccgtcgcgcgaggaggagcgccgcgacaagcgtctcgtgctcgagaaactgaagcttctgagtgccgagtgcgactga

SEQ ID NO: 8787 - DNA, 816 bp, Methylobacterium sp.
gtgatcgccgcggcgctccgggtggcgcgggcggcggagccggaggccgtgcgccaggcgccggcgccaccggtcctgagcttcgaccgggtcggcttcgcctacgacgggcggacggtgatgcgcgacgtctccttcgggatccgtcccggcgagatcgtcgcgctactcggtccctccggctgcggcaagacgacgatcctgaacctcgtcgcgggcttcctcgcgccgaccgaggggcaagcgctcctcgatgggcggccgatcgccgggccggggccggaccggggcgtggtgttccaggccgccgccctgttcgactggatgagcgtcgcggagaacatcgccttcagcctgcgctgcgcgggcgcgggccggcgcgcccggcggcgggccgccgaggagatggccgcgctcgtcgggctcgcggggcgcgaggatgcctacccgtacgagctctcgggcggcatgcgccagcgcgtcggcctcggccgggtgctcgcggcccgcccgcgggtgatgctgatggacgagcccttctccgccctcgacgtgcagacccgtgagggcctgcaggaggaggtgctgcgcatccgcgaccgcaccggctgcaccatcctgttcgtcacccacagcatcgacgaggccgtgttcctgggcgaccggatcttcctgctggaggacgtctcggccggccgcttcgagaccttcggcgtcgacctgccggggccgcgcgagcgcaccgagaaccgcctcgcgccgggcttcctgcgcctgcgcgagacgatctaccgccgcatgcgcgccccgcgctga

SEQ ID NO: 8788 - DNA, 1389 bp, Methylobacterium sp.
atgagtctcgaacgtatccatctcgacttcgcgacgatccgcaccgccctcgcggcaggcgtgtcggcattggctctcgtcgcggaaagccaccgccgcgccgcggctagcgccgatgacggcatcttcaccgcgctcgtcccggccgacgcggccctggcgcaggccgagcgccagcaagcccgcgcggcggcaggcgagagcctgccgctcctcggcctgaccttcagcgtcaaggacaacctgcacgtcgccgggatggtgacgacctgcaactgcccgggtttcgcgatccaccccgacgagagcgcaccggcggtcacccggctggagcgggccggcgcggtgctcgtgggcaagaacacgatggaccagttcgccacgggcctgaacgggacgcgcagcccggagccgctctgccgcaacgccgtcgatccggcctacatccccggcgggtcgagttccggctcggcggtcgcggtcgcgcgcgacctcgtcgccttctcgctcggcagcgatacgggcggctcgggccgggttccggcagcctgcaacggcatcgttgggctcaaacccacgctggggcttgtcagcacccgcggcctcgtgctcaacagccgcctgctcgactgcatcccggtcttcgcccggacctgccgggatgcctgggagatcctcgacctcatccgcggccacgacccgcaggatcccggcagccgccccgacgctgacgcgatcgcccgcggaccggtctccgcggaaccgtccgtcctcgcggtgttccggcctgccgagatgccgttcttcggcgacgatcacgcccgcgccgcctacgaggccggtctcgcggtgctcgcgcgcctcggccatacctttcgcgagatcccgttcggtcccttcgccgaggcgggccgcctcgtgttccagtcggcgctggtggcggagcgcctcgtgtcctacggcacgatcctggccgagcgtccggaggcgatccatccggccgtgcgctcggcgatcgcggcgggcacggcctattcggcgcgcgacgcgttcgaggccctcgacgcgctccgggcgcttcggcgccgcgcggccctcgaactggcgggcaccgccaccctcgtggtgccgaccgttccgacgatcttcaccatcgccgagatgctggccgagccgatggcccgcaacacgcagatgggcacctacacctacttcgtgaacccgctcgatctctgcgccgtcacggtgcccggacggcgccgccccgacgggctgccctccgccctctgcttcgtcggacaggccggcaccgatcacgtcgtgagcgcgctcgccaccgctttcgaggacgcctcgcgcgccgggtcggtgctgggccgcgcgctctga

SEQ ID NO: 8789 - DNA, 171 bp, Methylobacterium sp.
atgagccccgccgataccccagagccgaatggcgagccgacaccgatcggcgatccctcgccggagccgcagacgcccgagggcgatccgccgccgaacccgcccgccccgcagccgcccgggccgatccccgagagcgatctcgagcaggtcgaggagcagccgagctga

SEQ ID NO: 8790 - DNA, 1341 bp, Methylobacterium sp.
atgccgacgccccgcccgcgccccttcttccctgccctcgttgcctttgagagcgggcgcgacaccccccgtgccttcctggaaggctgcctggaggaactgacgcgctgggagccgacggtcggcgccttcacgcatacggacctagagggggcccgccgcgccgccgacgccgccacctcacgctggaaggcgggccggccgctctcgcgcatcgatgggatgccggtgggcgtgaaggacaacatcgacaccgacgacatgcccaccggcaacggctcgccgctgtacgacggctaccgaccgcgtttcagcgccgcctccgcccaggctctgcgagaggccggagcggtgattctcggcaagaccgtgacgaccgagttcgcctccacccaaccgcgcggcacgcgcaacccctgggatctcgcgcgtacgccgggtggcagcagcagcggctcggccgcagcggtcgcagcagggatggtcgcgggagcactcggcacccaggtggtgggttccatcatccggcctgccggcttctgcggcgtgtacggcttcaagccgagcttcggcgggatcaaccgcggcggcagcctcgacttcctcagccagagctgcacgggctctatcgctgcgagcctggaggatgcctggatcctcgctcgcgccgtcgcggccgaggtgggtggcgacccgggctatcccggcctcggcggcccgttgctgccgcccgcagcccgcgcaccgcgccgcctcggcctgctgcgcaccgccggctggcccgtcgcgagcgaggaagcccgcgccgcactggaagcggcggctggcgtgctgcgtcgggcgggtgtcgcggtctcgacgccggagacgagcacgtcgctcgccgcgctggaaggggccgtggcggaagcgttaccggaaaccctgcatatgctcgcttgggagtggcgctggccgctgaacgccttcgtcgcgcggaatgccgaagccctcagcccctcctcacgcgagcgcgcggcggtcgcccgggcggtgacgcgggaggcatacgtgtccctgctccaacgccgccgcaaggcgcgcgcgctcttcgccacggtgatggacgatcatgacgccctcatcggcctcactgctccgggcgctgcgcccgtaggtctggagacaacgggcaatcccatctgcgtcgtgcccggctcgtaccttggcggaccggtggttgccatgccgctgttgcgggacggagggctgccgctcggcttgcaggtgctgggcaagtctgacgaggacgaggtgctttttacgcacgcctcgtggatccgcaacactcttcggagttga

SEQ ID NO: 8791 - DNA, 129 bp, Methylobacterium sp.
ttgatcaatgctctggccgcggtcttcaccgttctcgccgtgctcctcctgagagccgtgctgaagctggcgatccttcccttccgtgccctgcgtagcctgtggcggcgacagacggcaccggtctga

SEQ ID NO: 8792 - DNA, 237 bp, Methylobacterium sp.
atgcgcaccatccagcgtctcgcccttgccgctctcgcctccgctgccgctgccggctccgcgatggccgaggaccggatcgacctgacgcccccgctctaccgtgagcaggctcgcgttacggcggctgtgcggccggcttccgagctgaccaccacgccgaacctgaccgctgccgccccggccgctccgcaggccccgcgcttcgtcgccgaggccggtgcgctgacccgctag

SEQ ID NO: 8793 - DNA, 84 bp, Methylobacterium sp.
atggtctcctcgaccgggccgacccgggtggtcatcatcgtcgcctacgccctgatgaaggggtggggccaaggggagtcctga

SEQ ID NO: 8794 - DNA, 1062 bp, Methylobacterium sp.
atgctcgacgaacgcacgcgcaagagctttcccatcgcggacccggaaccgtccgccttcggggccgcggcggggacgcgcgactgggtcgcggagttccggcgcgagcaggcgcacctgatccggacggcgcccggcgacggcgcgtcccggctcctcccctacggcgtcggcggggcgctggccctggcgctcaccgtcgcgctcaccaccgttctgcccacgcgcttccccggagccgcggcaccgggggacagggccgcgtccgccccggccgtgccgcgcatgccggcaagcgagctcgccgaggcgcgggaggaagggctgaccttcgatctcgcccgcgcacggcaggaggccgaggcggcccgggcggcgcacgcgcaggatgccgagacgctccgcgcggcccatgcccgggagatcgaggcgcttcgggcggcggccgccgaggcggaggccgccgccgaggcgaagggtggcctgctcgcgcgcgacctcgagagcgcgcgcgccgggctcgccgcagctcggcgacaggccgcggacgccgacgcgcaggccgcggagagccggggccggtccgagcgcctcgccgggcagctcgccgaggtggaagcgcgggcgcgtgcggaacgcgcgggcagcgaggccgcgctcgcgcaggcggcgcgggagcgggacgaggcgcgcacccgtctcgccgaaacggcccgggcgaccccgccacccgacacggacgccacgacggtggagcccgcggccacgccgcagcccgtcgactggaccctcttcagcctgcgcctcgcgccggccgaggaggcctcggcgaccgcacccctcgtgcgggatccgcagcgggcgggctccgatcagaaggggcccgagcggaaggccgcccggcgggcacgggcgagcacgcccgtgcggaccgattcggccccgcgcgcggaccggcccggccggaccagggccggcacggcgcgggcacccgccgcgaccggcggcccggagccggcgccgccccttcccggtgtcgggctcgccgaacccgacgcgtga

SEQ ID NO: 8795 - DNA, 246 bp, Methylobacterium sp.
atgcccgatctcctgatcaaagatctcgatgacgcgaccttccggacgatcgctttccaggcggaggcgatgaaccgatccgtcgaggatgtcttgcgcgagctgatccggatcggcctgctgcacgacgtcgaggggcgtgtcgccgttgcggacagaatccggtcgatgtcgcggccgcccccgcctggaaccgtcatcgaggacagcacggagatcatccgggccctgcggggacggatttga

SEQ ID NO: 8796 - DNA, 1032 bp, Methylobacterium sp.
atggagggcttctgggcccgtgagggcgagggggaatggccgatgcggtcggtgccggtccgggcggtgacgctgctctgccccgcgatggtgacgggcggcccgcaggccctgcaccagctcgccttcgcgctgaaccggcgcggcctgcccacgcggctggcctactacgccaacggcggtcggctggtgcgcgagggcgacgcggtccgctgcgtggccccgccgcagaacccctgcctcgtggcctacgacaagtactgcccggtgccggccgagcgcttcgccctcacgcccgaccacctcgtggtgctgccggaggtgctggcccacctgcaccgcgactacgcgccggcccaggcggcggtctggtggctctcggtggacaacgccttccacgagcgctccgccctgcgggacgcgggcgtgcgcgcggccctgttcgcgaaccgcgagttgcggcactgggcgccgaccttctacgcccgcgagttcctgcgccgcgagggcgtgctggagatcgcgatgctctccgaccatgtggacgaccagttcaccacctggcggccggaggggccggggcccgacgcggtggtcgcctacaacccgcgcaagggcggcgcgctggccgaggccttcttcgcccgccacccagacctgacaccgcgcccgatcaccggtctcaaccgccgcggcgtctgggaggcgttccgcagggcgcgggtctatctggatttcagccacttcccgggccgggagttcatgccgcgcgaggcagcgggttccggagccgtcatcttcgtgcgcaacgtaggcgcggcgcagcacttcgacgattaccccctacccgatgcctaccgtttcctcgatgccgctctcgaggacggtacgctgcacgcgaaggtgatgtccgccctcgccgagccagagccgcactgggcggttcaggcaagcctgcgccagaacgtgcgttgggaggcagagacgttcgatcgtcaggcggatcgactggtcgagcaactcagcgcctag

SEQ ID NO: 8797 - DNA, 1338 bp, Methylobacterium sp.
gtgatcggctacgggttgaatgaagtcgagggtaagagtcaccgcctgttcgttgacgcggcaacggtcacggaggcggaatacgcgatgttctgggagaacctccgcgcgggtaattacgtgtccggtgaatttatgcgtgtcgcgaaaggcggccggaaagtttggctcgaagccagctacaatcccgtccgggacgcggacggacagccctacaaaatcatcaaattcgcatccgacatcacaagtcggaagaacgaaaacatcagacagagcatgatgatcgacgaggtcccggtcggcgtcatgacggccgatccgagcgatgatttcaaaatcaactttatcaacaaaacttcgctcagtactctggagacgattgaggaacatctgccgatcaaggcctctgaattgattgggagatcttttgatatattccataagaaccctggacaccagcgcaggatgctcgccgatgcaagccgtctgccgcatcgggcaaagatcaaggttggacccgagacactcgacctgaaggtctccgcgatccgggatgcggaagggcgctacgtcggcccgatgctgacgtggtccgtggtgacggcccaggtcgcgatggtggcggaggtcacgcgcgtcgtcgatgcgctccggcaggcgatcgaggaaatgcggagttcggccaagggtctcaacacctcggccgatcagtcgagtgagctcgccgcctcggctgccgccggttccgagcagatggccagttccctccaggagatctcgagccaggtcggccgggtgtcggagcgggccaaccagatcgccgaccaagccaacgcgactgtggggacggtgcggatcctcgccgagaacgccgtcaagatcgatgcggtcgtcggcatgatcaagttgattgccgatcagaccaacctgctcgccctcaacgccacgatagaagcggcgcgcgccggtgcggctggtcgcggcttcgccgtcgtcgcggccgaagtgaaagaactcgctggccagaccgcccgggcgaccgaggagatcactcggcaggttcaggccatccagggcatcacgcagcaggcggtctccgcaatcgacacgatcacggccgcggtcgacgagctatcgagactgacgctgaccatggcgagttcggtggaggagcaggcggcctcgtcccaggagatggcgtccaacatccacggcgtctcctcggccgctggcgcgaccggccaactcgcggagagtgtccgccagatctcggagcggctcgcagactacccggccggtcttacgcagagcgtagagaccttcctgaaggcgagctga

SEQ ID NO: 8798 - DNA, 846 bp, Methylobacterium sp.
atgacgaaaatcacttctctctcagcacttctcgcagttctcgcatcgggcaccgcgctcgccgccgatctgccgcgccgcgtcgcgccgccgccgagcttcaatcccatcccggtcttcacctggacgggcttctatctcggcggaaacgccggctacgccttcaccacccgcgagagccgcaaccgcaacgcggccttcctgatcgacgatcgggacatcggcacggtcgggggcacgttcggcttcaacaaccggggccagaacggcttcagcggcggtctgcagatcggcgccaactaccagttcacgccgggctcgggcttcgtcgtgggcgtcgaggccgacgcgcagtacctcgatgccggccgccgccgctcgggcgtcgtcgcgggcgccggcaccgtgctgaacccgaacgccgtcttcttcgacccccgcgccaccgccgggctcgagtatttcggcaccgtgcgcggccgcctcggctacgccttcgaccgcacgctcgtctacgccaccggcggctacgcctacggcggcggcagcgagcagcgctacttcggcgcgaccgacaacgcgcagatgcgcacgggctggacggcgggcgccggcctcgaatacgcgctgccgaccgagtccttcctgaacttcttccgcgcctcggcggtgacgatgaaggtggaaggcctctacgtgaacctggagcggaacaagggcctcgccctgctcgccgtcaacacggtgacgggcgacgtcttcctgcgcacccccgaccgccgctcgctgggcgacgacttcgcggtggtgcgggccggcgtgaactacaagttcggcagctactag

SEQ ID NO: 8799 - DNA, 96 bp, Methylobacterium sp.
ttgatcaacgcgaagatcgagagtgaactcttgtcgatgtcgatccttaccgcgaggcgggtgtggagggtctccatcgtcccgatggacgactga

SEQ ID NO: 8800 - DNA, 1680 bp, Methylobacterium sp.
gtgcgtcagatcatcctggccctcgtcgtcagcgtggtgatcgtggccggtggcctcctcgcgggggtcagccagtacgccggcgcgcggcgcgcgctcgtcgacgacgcgcggacccgggcgctgcgcttcgacgccgtctatcgcgaggcctcggaggcgcggctgcaggcgctgcgcctcgccgccgagatcgtggcgcgcgacacgctcgtgatcgaccccctcgcccggcgcgaccgggccgagctcgcccgccgcgcggtgccgctcttcgagcaggtcctgaagccccgcttcggcgtcaccctgctggggttccagggcacggacgagaccaccttcctgcgggcccaccggcccgagcagttcggcgacagcgtcgcgggccgcgcgatgggggccgccgtcgccaggggccgaagcacggtggcgggcctggagatcgggcgcgcgagcgggccggagctgcgcgcgatgagccccgtcgtctccggggagaccctcgtcggaaccgtggagctcggcagctcgctcttcgaggcgctgcagatcgccgcccaggcgaccggcctcgatttcggcttcgccatggagcgccgcgccgccgaggcgctcgaccgtccgccggggccggaggcgctgcagaagggcgatgcggtctatatccgcttctcccgcccggaggtccgggacctgctcgccgccgccccggtcgacctcgccgagcaggccccccaagtggtcgacggcgcgggccgggagatcttcgcccgcacggccccggtcctcgacgtgagccgccagccggtggtccgcatcacgctggtggaggacctcaccgacccgctcgccgagcgccgggggcgaatcgtcctctacaccgcgctcggcaccgcgctcctgctcgccctggtccttgccggactgctccagttccgcgccctgcggacccggctggagcgcagcttctccggacgcctgcgggaggtccacgccaaggcgcaggcctacgaccggatcagccagtcgctgcgcgacctcaccgcctggaagctcgggctgctgggcgagctggtcctgctgatccgcgatcccctcaccgccgtccagggcgcgctggagaccgccgggcgcgcgggcgagccgtcggcgggcgcggccctcgccttcgcggccggcgaggtccggcgcctcaacgcggccgtggccgaccacacgaccatgctggcgatgcgcgaccgtctgcggcgggtcgaggcggggcccgtcgatctggccgcgctcgcggaggcggtcgcggccgatgccggcggggcgcccgcgatccgggccgccgtgccggcggacctgcgtccggtccaggccaacgcggccctgctgcgggcggcgctgcgcaccctcgtcctgacgcttcagcgcggctcggacgcggcgcccatcgtgatcgaggcggcgaccgagggcgaggggatcgtcgggcgcatcgcgggctccggcgggtggagcgccgggccgccggggctcgaggaggtggtggccttcggcagcgccatgcaccagccggcgggcagtcccctgatcctggcgcgcctcaccgtcgagcatttcggcggcacgctcgcgttgctcgacgagccgggcctggccggcttccgcctcacgctgaaggccgcatga

SEQ ID NO: 8801 - DNA, 1467 bp, Methylobacterium sp.
atgggcgcgcgcggcgtctcgcggccctcgcccgccctggtcctgcccttcctgacggtcgccggcctcctcctgttcgaggatctgttcaacgcccccctggccttcctcacgggcatcgacccggagacgatccggcgctgcgaggcggcgcttctggtggcgatcgcggcgctcctggccgcccgcttcgtccggcgcgacctgatccacggcctgctggaggcccgcgccggcaaggcgctgccccacctcctcggggacgtcgccggcctcctggtcctcgtcctgggcggtaccgtgatcctgaccggggtgtacggccgggacatcggcaccgtcctggcggcgggcggcctcagcctggcgatcctcggcctcgccctcaaggacgtgatcctggccgtcttcaacggggcggcactcagcgccgagaacgccttcacggtcggcgaccgcatccgggtcggcgaggtcgacggggtcgtggtgcagtcgacctggcgcagcaccaccatcctgaccaaggcgcgccgcctcgtctcgatccccaacgtcgccctgggcaccgccgcgatcaccaatttcgaccggccggacaggagcgagcagcgcatcctcgagatctgcctcgactacgacgtcaccgccgagagcgcggagcggatcctgctcgcgggcgtgatcggcgcggcgggcgtggtcctcgtcgacgcgccccgggtgcacgcgatccggctggagcgcgacggcgtgctctacgccatccgctacgtcatcgccgaccacgacaacggcctgtcctcggaccacgcggtgatccgcagcatcctgtcccatctgcgcgatgccgggatcggggtggcctacccgaagcaggaggtggtcgccgccgagcgccgggtccgcgtcgccgaccggaccttcgaccggcgcgtcctcgtccagcaatgcgcgctgttccgcggcctggagccggccgcccaggcgcggatcgccgaggcgctgatcgagcggaatctgcaggcgggcgccctgttcatcgcggccggcgaggtgcgcccgtccgtcttcatcgtcggcgaggggctgatccggcgcacgcgcgtccggcccgatcaggtcggtttcgtcgaggagcgctacgtcgcgacccagaccttcgggcgccgcgcgctgctctccggcctgccccaccccgcgcccgtccgcgccgtgacccagagcctcgtcctcgaactgacccgggaggcgctggccgcggtgctgcgggcgcatccggagatccgggcgccgctcgcgggcaacctcgcgcgcgcgccgctgcacgacgtcgcgcacgcgacggaggtcagcgcgctggagagccgcacggagcggccggtggcgttctacctgggccttctggaggccgtcgctcccgaggcgcccccgccggacggcggcgcggggcccggccgatcctga

SEQ ID NO: 8802 - DNA, 162 bp, Methylobacterium sp.
atggccgagatcggccgcgggccgcccgcggccgagcggccgaacggatacggacatcccatgctcgacatcgtcttccttgcgggcggcctcgccgtcttcgcgctcgccgccggctacgccgcgctctgcgagcgccccgcgctctgcgagcgcctctga

SEQ ID NO: 8803 - DNA, 240 bp, Methylobacterium sp.
atgacgctggccctggccataccggtcgtcgaggctgccgccttcacggcggggtgcgtgctcatccacggccatcgccacaggccggaaccggtgaccttcgccctgctgggcctgctctgcctcgtcgcgctcggcggtttcgcgctggtcctcgcgcatgtcggccctgacgacccgatggcggcgaccgcacagctccccttcgagaaccatgcggcgggagccatccgctactga

SEQ ID NO: 8804 - DNA, 270 bp, Methylobacterium sp.
gtggctgcctggttctccgaagaggcgcaccgccagcaagcgcggaatcttgccagtcagcgggctgcggccctggtcaggtccaaggctggctccatggccataagggccatggcggacgccctcatgcagaagggggaaattaaagcggacgagatcgcagggctctgccgtgaggcctatggcggccgtcagtgcgagttcggcgcctggaacgctcactggccgcctacgctggaacagctgcgatcaggctacatccccgactga

SEQ ID NO: 8805 - DNA, 231 bp, Methylobacterium sp.
atgtcctcaagcgtgttgctgcgactggtgcgtaccgagatcaccgcagcggaaggtcgcgcgtcggctcttgccgacgcgatcagggggcgcctgaaagccggcgccgacagcactgacgtggagcaggccctgttccacgttctggacagcctgacgctcctgcgtgccaagcaacaggccttgcatcgggtcgcgatcgaacagcagcaaggttccgcagcggcctga

SEQ ID NO: 8806 - DNA, 177 bp, Methylobacterium sp.
atggccgttgttctcgatattgcgaagagcctccataatcgtcacgcgatgatcttctgtgggcatgggtccctcctcggagcccggctcgctgccgcgctccggcgcggggccgaccggcgctacgcggagcagcgcgatcgcatcgagcgcaccgggtgcgcgggaatcttctga

SEQ ID NO: 8807 - DNA, 216 bp, Methylobacterium sp.
atgggcggcggggggcatgcgggagatgcggcggccgaggccgagcccttcgtcgcgcgtggcgacgatcctccacagcacctcgatcgtcgtgccatgccgctcgacgccgtcatcgccggcgccatggcggtgctggccacggaggccgagagacgctgcccggggccgatgaccgggtgggcgacaatcccggcgcgaacgggcacgcgatga

SEQ ID NO: 8808 - DNA, 174 bp, Methylobacterium sp.
gtgaggccaatcctggacgagcccgtccctgcgggcagcgcgcgcacgcggcatcgcctcatcgtgcccgggccggaggagccgacgtcgaagcgtcgtcagcggacgagcgcggagccggccgtgctcaagctgcgccagatcgaggtgcagatggcgcaggcgaggcgctga

SEQ ID NO: 8809 - DNA, 1569 bp, Methylobacterium sp.
atgatcgacacgcccgcacttcccaacgccataacgatcacgtggatttcccgaggtcttctcgttcttgccctgaccgccttcggcgactggctgttctacgatcgcatcgtaggcctgtcgctggccctcttcctgatcgcgcttgccgccacggttccgctcaccaacacggtgcagacggattggcgcgcccgcggtctcgccttcgccgtcctgatcctcggcctcctgccgctcttggaggatgtcggtgtcctcgccgtcctgttcggcatcggcggtctgctcggatccatggtcctgatgaccggcggcctcgctcccggccggctggcgaccctcggggccgtacggcggatgctggttgccggaccgttccagatcgtaacggatctcacggccggcatgtcccggcagcttgccgccggtgcgccgcgctggcgctggcagccgatcatcggttgggtcacgcccatcctgctcggcgcgctcttcgccctgctgttcgccgcggccaatccggtgatcgacgcgtggctttccgcggtctcgtggtcgagcctccagcctcgaatcagtgtcgggcgggccctgacctggctcattctggccgccctcgcctggcccttcgtcacggtccggcgccgctaccccgcacggacagcatcgccggaggccgacgcgccgtccgctgtcccagtcggcatcgcggcggccctcggcctcggtcccgcggtcatcctgcgctgcctcgtgctgttcaacctgctcttcgcgctccagagcacgctcgacatcctgttcctctggggcggcctcgccctgccggccggcgtcacctacgcggcctacgcccatcggggggcctatccgctgatcgtcacggccctcctcgcggccgccttcgtcctgaccgtgatgagcccgggcggccccggcgagcgcttgcccttgatccgccgtctcgtctatctctggatcggccagaacgtcctcttggtgatctcggcgatcctgcgcctcgacctctacgtcgcggcctactccctgacgctcgtgcgcgcggccgccctcatctggatggggctcgtcgcgggcggcctcatgctgatcgtcgcgcgcatcgccctgcgccggtccaacggctggctcctggccgccaacgccgccttgctcaccctcgtcctctacgcctgtgccttcgcgaacctcgcggctctgattagcgactacaacgtcgcgcacagccgtgaactcggtggcggaggcggatcgttcgatctcgcctacgcgatgaggctcgggccggacgcgctaccggccgtcgaccgctacatcgcggtcgccaccggcccgaaccgggccgccgcgatccactggcgcgtgcgggccgcccgcgagaccgcccggacgatgcaggactggcgcggatggacgttccgcaactggcgtttggcgcgctacctcgccgcgacccccgcacctcccccggccccgacgcccgatgtcgccctcccgggtggggacggcgcgctgccggacggtggcgcagccggcccgcgctga

SEQ ID NO: 8810 - DNA, 1038 bp, Methylobacterium sp.
gtgccggagcgggcgcatcccggaggccgcggcatgcgcccgctgaagccgatcccccggctgcacggcctgaggccgttcgggctcttcatcgccgcggagacggccggcctcgccaccgcgatggccggctcgctcgacatggcctggcttccgatcgggcacgggctctgtctcgccgccaccgccgcagccgtccgcgcggagcggagcggcgagtgcaccttcgcggtcctcctgctgctgctggccgcctgcacgggcccgatcggcccagcgggcctgcttctggttcagtcggtcctgacgcggacccggatctgcacgaacgagctcgacgcatggtaccgccgcctcgccggcgacacggcaaccgatccgtcggtcaccctctacgaccggcttctcgatgggcgcgcgcgccggacagggcggggcgggcccgaccatttcccgaccgtcctgcacggggacctcgtccgccagcaggcgctgctcggcctgatcggcctggcctaccacccggattaccgcccgatcctggctcaggccctgtgcagccaggaaccatccatccgcgtccacgctgcggcggtctccgtcaagctccgggcccgggccctggccgaattcaagcgcgcgcaggaggccgaggcggacgggccggccgcggagtgcgccgggctggcgctgcggctgctcgaccttgccgacggcggcttcctcgacgccgagaaggcgggcgtggccaggacccaggccctcgctctcgtggtgggcgccggccggcccgacgtggccgcgtgcgatgtggccgcgcgcgacccgatcgggcgccgggccctggcgggactggagcgctgggaggaggcggtcgcggatccggaagcagccggccccgtgcgcgaccccgaggatctccggctgcggatgctctgtctgatgcggtgcgggcaggcgcgcgcgctccacgcccttctcggggcgcgagatgcccgcgccccgacgaaacgcggagggctgcaccatgtggtttga

SEQ ID NO: 8811 - DNA, 1086 bp, Methylobacterium sp.
atggcgacagacaagtccgctgaggcggtacggccccgacggttccggctgcacggcctgcacgagaccgcgctgatcttcctcgtgctgctcggtatcgagtggatcgcgccggggccggccttcctcgcgcggctctcgccgcacccgttctggatcccggtgatcctggtgagcgtgcagtacggccgtgtcagcggtctggccgcggcggcgctggcgaccgccctggccagcctcgcgggttggcccgcccagacgccgcaggaagatttctacacctactcgctgcgcatctggcgcgagcccgccctctggattatcggggcgctcgtcatcggcggattgcgcagccgccagatccgcgaccggcaagccctcgaggcggatctccaatcggccgaggtccagcggaacgcgctcggcgctttctgcgaggccctgcaggcggagctcagccagttcgagcgcgctgcggcgaccacgacggccggatcagtcgcggccgcgctggaggccctgcacgcattgcgcagcggcggcgcctccgcggccgtcgaccgcctgccggccgctctcgcggcctggctgggcgagacgcgctggtcccttcaccttgcccgagaaggatccctgcaccgggccgccccgacgccgcgagagggcggctgcgaggtgacaggtgccctggccctggcgcgcctctacggcatcgcccgccgcacgccgcgcacgctcagcgtgttcgaggaacgcgacgcggaggttctggacggcatcgggatcttcgcctgcgcgatccgatgccggtacccggccggcaccctcggccttctcgtcgtcgagagcgtcgagccgggccggctcagccccgcgctcggtctggcaaccagtctcctggcggacacgctcgggatggtgctcgatccggcccgggcaccggcagcatcgcccgtggaggtgccgcccgtggatgcgctgctcgcggacgcgccgtcctcgggtggcgagatgatggccttcgcggcgatcgaccccgcgtgccggagcgggcgcatcccggaggccgcggcatgcgcccgctga

SEQ ID NO: 8812 - DNA, 2289 bp, Methylobacterium sp.
atggcgggatcgatgcgcaccggcccggatcagcgcccagccccctcgccccaccgccttgccttcgtgctggcggtcattggctctctctgtgccgccgcaccgtggccgttgccggcgctgtcggctgagaacgggagcgaggagcccatcccgcgcacgctcctcgtcctctacgacggtgcgcgcgagcccgagccggccgatacccgcgtccaccgctacgcggaagccgtcctcaaccatctcggctttgtcgttgcctatcgcgacatccgcgggccgctgcccgatcccgaggccgtgcgcgcctatgcgggcctcctcacctggttcgccgcgcccccggcggcgcgtgggcgctacctcgcctgggccgagaccgcggtccggtccgcccggaagctcatcgtgctcggcgcgacgggcggcgagttctggggcacggacgcgcgcgggatccaggcgattctgggcgagatcggcctgacgcacgatcgacgggcggtcgaggtgacgctcggtacccgcgtcgtcgcggagcagcgcggtctcacccgtttcgagcgcgccccggacccggtcgtgccgggctacgacgtcgtgcatgccgccatccgggcggaggtggatgtctggctggaactcggcgtgccggaccgggccggcggcggcaccagcatcgccgtggcggtgacgcggcgcggcggctacgcggcggccggcttcgagttcgccgaggatcggggtctcgacaaggcgcgctggctgatcgaccccttcgccttcttcggccggatcctctcacccgattcctggcccgttcccgacgtcaccaccgtgtcgggccgccgcctctatgtcagccatgtcgagggcgacggcctcaacgacgtcgtcggcgaggggcggaaccggatgctcgtcgcgcagcgcttcctctccgacatcgtggaagcctatcccgatctgcccttgaccttcggcctgacgccgggcgacctcgacccgcgcctcgggggcaacgagacgccgcgcgcgctcgtcgcccagatctggggggccgcgcaggtcgagccggccatcgcatcgtacacgcggccgttcgactggcccttcttcgcgcattacagccgcgagcgggagatcgcgcgcgccgccgcggtccggcacgacctgcccgcggacatcctccgcaccggggatccggacccggccgtgcaggcgcgctggagcgtgagccggggccgcgagttcccgcgccagtacctcgcccgtcccttcgacctcggcacggaggtcgacacggcggcggacgccgccggggtcctgctgcccgacggcaaggccctgcgcctctatctgtggaccgggaacgccaagcccttcgaggcggcggtggcggccacgcgccggcggcatctcctcaacatgaacggcggcgagagccggctcgacgcggactacgcctcggtcgcgcatctcgcgccgctcgcgcgcccggtcggaacggaacggcagatctacgccgtcgccgcggacgaggtgccggtcgagaaggcttggcgcccgatccggacgggactgcggggcttcgcccccacgctcgcgaacaccggatggccgcgccgtctcaagggctacaacctgcgctaccatctcgcctccctggccgatccggaggcgctccggatcgtgcgcggatacctggacgaggcgcggacagccgcgctcgccccggttccggccagcacctacgcggccatggtggagggcttcttcgagaccgcggtcacgcggatcggccccggccgctggcgcgtcgcgggacggggcgccgtccggacgctgcgcctcgacggccccggcgaccgccgggtcgacctcgaccgctcgcgcggggtgatcgggcagacccgctacgcggacgcgctctatctcgcgctcgacccggccgtcgaggcggtcgaggtcgtgctggcggcaggccccccggcgatagccgcgccggccggtctcgtggagagccgctggcagctcgcgcatctgcggcgggacgcgcacggctggcgcttcgaggcccaggggttcggagccgggacgtttcgctgggagaacgtggccgccggacgctacggcgtgacggcgcgccgtggcggcgcgacggcctggcacggtatcgcggaggcggacggcggcggcctcaccttcacgatcccggacgaagcgggcacgaccctcgacgttgaggtcgcgcgcctcccccccacaggccggggcgcggaatga

SEQ ID NO: 8813 - DNA, 162 bp, Methylobacterium sp.
atgatcaccgtgacgatccccctgacgacgatccccctgacgacgatctccccggctctgagcttcgccgccgtcgtgctgacctgcctggttctgcatgcggcgtgccgcgcggcagccctccggccgcagctgaggccggtgcgggtgcgcaggcgctga

SEQ ID NO: 8814 - DNA, 396 bp, Methylobacterium sp.
atggagatgatcaccgagcagcaggtgcgcgagcgcgcctactacatctgggagggcgagggccggatccacggccgcgccgaggcccactggctgcgcgccgagaccgagctgaaccgcccggtcgcggcgatcgaggcgccgaaggccgcccggaagagccgtgccagggccgcggcgcccgtcgtcgagaccgtcgcggcgccgctcgcggccaagcccgcagcccgcaagaccgtcgaagcggctccgaccaaggccgccaagccggttgccaagccggttaccaagccggccgccaaggcggccgggaagaccgccgcgaagaccccggccgtgcccgccggcctcgccgccaagaaggccgcccggcccgccgcgatcgccctgcactga

SEQ ID NO: 8815 - DNA, 159 bp, Methylobacterium sp.
atgagaaacgcctccgcgctcgccgcacgcctcgccgagacggtcaccgatgccctgacgcgcgcgagcgagcggctgctcgacctcgtggggccgcagcggcaggcacagctcattccggtccgggtgcgccgtggcccgcaacgcgcgcgccgttga

SEQ ID NO: 8816 - DNA, 237 bp, Methylobacterium sp.
atggacctctgcctcacttggtttgcccgggcctggatcggcctcgtcctcctgctcagcctcgccgacatcgccgtgatggcccttcagagcggcggcggcgcagcggccgcgatgtacaaccccttcgacctcgcgaacttcctgatggaggcgatcctgctctcgcccgccctcgccgtgctgatctggcgcgaccgccgccgcctgcgcggggcgtgcgagacggccctctga

SEQ ID NO: 8817 - DNA, 216 bp, Methylobacterium sp.
gtgggcgggggcgccctgcccgccggagggctagcggccgccgcgctcgcgccggcgatgggcctgctctcggggctcgtcaccaccctgccctaccgcctggaggacctgttcgaacgcccgccgctgcacgggatgtggtggccggcgctcggcggcctcgcggcggccatcgacctgatgctcttcgccgcccaggcgcgcggctcgccgtga

SEQ ID NO: 8818 - DNA, 393 bp, Methylobacterium sp.
atgccgcccggcagcaaggatatcaaacccgacgtgaaatggcaggccggcgcgccttacggcgatcccacgaagtccgatgcgctcttcatccgggatctcgctctttcgagcatcacgatggattcggcaggctggccacccgagatcggtcgagctctcgaacaggcgatcagaagcgggtccgtcaagatccagaaggcatccgaggtcgaaggcctgaacttcaaatcgtggcacacctttaccccgaaccggaacaatggtgccgggtacgattcgatgggcggcacgacgcagaatccggtcggagcggtgaagacggcgatcgattccggccggggcctggcgatgtggaccgcagaccggggcgatgtctatctgagctggtga

SEQ ID NO: 8819 - DNA, 657 bp, Methylobacterium sp.
atggtcaagaatgctctcctgttcgcgtcggcgctcgccggcgcgctcaccctggttccggccgcttccgaggcccagaacatctcgggcttccgtggcggcaacgcgctcgcgggcggcttcagcggtccggccccaggcggcggcttcggcggcggcatcggcggcggcggcttcaatcgcggcggtgtcggcatcggcggcggcgggttcaaccgcggcggcgtcgggatcggcggtgggggcttcaatcgtggcggcttcgggggtgccggcctggccggccgcggctacggcttcaaccggggctatgggttcaaccggggctattacggccaccgctacgggtacggctacggccggcgcggctacggcctcggtggcctcggcgtcggtgtcggactcggcctcgcgggcggccttgccgccggcagcctctacggcggctacggctatccgggctacggctacgacgatggctattacggcggctacgcgcccgcgggctacggctacgccccggtgaactacggctacgccgagaccgtcacctccgacagctcggccgaggaggcctgcgcccgccgcttccgcacctacgacccgcggacgggcacctacgtcgccaagggcggtgtgcgccgcgcctgcccctga

SEQ ID NO: 8820 - DNA, 366 bp, Methylobacterium sp.
atggaggttctgactctccgcgccaccatgcttcgcgcatcatggacatcgggggcctcgatcgagacgatgctggaactgtgggcgtcgtcgctgcgggaggtgaaggggcgcatgcgacctctgttcacccacgagcgggtcgccgcctcggcgggagcattcctggatgggttgctcggtgcggagcggcgcaagaccggctggatgcgggcggaagctgcgggcgaccccggcccctggcgccagcaggccgtgctcgggcgcggacgctgggaggccgacgccctgcgcgacgtggtacgggactacgagcgcctaacagaacgggcacggaccgctcggtcaggcgttggtgtgaatggc

SEQ ID NO: 8821 - DNA, 513 bp, Methylobacterium sp.
gtggtgatccgctccagcgactgtcatctgctccttccgaccggaccgcaggcggatcgcgagcgggtgcgtgaacttctcgacgttgcgggcgtctcgcattgggtcgagccggccaagggaccgggagcaccgacgcaggtcgacggcatcacggttgagggctatgatgcccctgccatcgccgcccctcttcgaacggcgcactacccggcggtcgccgatctggcccaggtcgacacggtcatggttaccccgatcctgttcatcatggtgctgttcgtctgcatcacctacggaccggtggcgatctacctcgtggaactgttcctggcccgcatccgcgctcccgcactcggcatgccctatcatattgggacgggcaacttcggcgactgcatggtgtacttcgcgacgccgatatcgacgaccgcgggcaacatctacgatggcctctggtacgccgtcttcgctttcgcatgtacggccatcgatctctggaaactgccctga

SEQ ID NO: 8822 - DNA, 225 bp, Methylobacterium sp.
gtgacgctgggtgccatcctcaccgtcattctcgtcgcggcctatttcggcttcgtcgggatgggcgccttcgctcccgcactcctggccaagcccgtgctggccggcggcacggtgacctgggccttcgcctacggcctgttcgtcatcgctctcggtgtcgtgctgacgggcctctacgtgctcctcgtcaaccgcgccgaagcgcgcctctcgggggagtga

SEQ ID NO: 8823 - DNA, 150 bp, Methylobacterium sp.
ttgacctacgaccgctggcgcaaggagttcggcggtctgaagacggatcgggtccggcgggtgaaggatctcgaggtcgacaaccagcggctccgcaagacggtggccgatctgacgctggacaagctgaccctgcaggaggcggcttga

SEQ ID NO: 8824 - DNA, 891 bp, Methylobacterium sp.
atgatcgttgccgtgctcatgggcggcatgtcccgcgaacgggaggtgtctcttgccaccggccgtgcctgtgcggcgggcctcatgaaggccggttacgaggtggtcgagctcgacgtcgaccgccgggtagcggagcacctcgcccacctgtcgccgaacgtttgcttcaatgctctccacgggccgctcggcgaagatgggtccatccagggcatgctcaacattctcggcatcccctacacccattcaggagtggccgcctctgcgttggcgatggacaagctccggaccaaggcggtcgcatctgcactcggcttcgccaccccccgaggcggcaggatcgggcgtcgaacgttcgaggcgacgcttccaacctcaccctacgttctgaagccggtagccgacggctcgagcatcgacaccttcgtcgttcgggatccgacgaaagctccgtttcccacagggtgctggccgttctccgccgatccactcttggaggacctcgtcgaagggatcgaggtgactgcaaccgtcctaggcgacagagcgctgaccgtcaccgagatcctcccacgatctaatttctacgactacgccgcgaagtacacgggcggtggttccgagcacgtcctgcccgcccggcttccggccgccactttcgacctttgcctggaacgttcgctcgcgatgcaccgggccatcggatgccgcgggatctcccgaagcgacttcatcatctccgcctcgaccggcgagcccattttcctcgagattaacacacagcctggaatgacgccgacgtcgctcgcccccgaacaggcggcgcatgtcggcatctcgtttccagaactcatgcacctcttggtcgaggccgcatcgatcgattga

SEQ ID NO: 8825 - DNA, 165 bp, Methylobacterium sp.
atgcaggtgcttcaggatcctggccggaccggcgctccggccgaggcgcgcgacgtgcagcacgccgagctcatgccgcgccttcaggatgatcttcaggaacgtgtcccggcccggcgcgtagggcaggcccagcgcccgcccgtgggtggccagctcttgtag

SEQ ID NO: 8826 - DNA, 171 bp, Methylobacterium sp.
gtgcgggcggtggtggtgatggtggccccagccgtactgcacgggggtgaggccgtccgctgcctcgatcggcgcggcggcgagcggcgcggcctgggcggcgggcgccgccgcgaggagcccgccggcgagcgcgagggccgccagcgcgcggcggccgagggaacgtga

SEQ ID NO: 8827 - DNA, 201 bp, Methylobacterium sp.
gtgatcgaattcagcgagcgggatcgtgatctgatcgaggatttcctcaaccacgtcctggatcgctacaaggccgggtcgatcggacggccgatggcgcgcgcggagctgagcgaggccatggcgctcgccgccgccgatgctgggccgctgcgccgccacatgcgcgagaccctgcatcgcccgggcgaggacgagtag

SEQ ID NO: 8828 - DNA, 507 bp, Methylobacterium sp.
ttgcgggcgacgctcaatggcctcgcgccgagcgagcgggcccagacgctgttcctgccggcgcttgccggggcacccgaggcgctgttcgacctcttggccctgctcccggtctgcgacgtgaacggcgccctgaccgcgtgtctggcggccggggggatcggcgatggcccggcgcccgtcgccgcgctgttctgcgtcgatcccttcctgcgcgtccccgaccttgccgaggccgtgctcgccgccggcctgcggcgggtcgccaactatccgagcatccaggctgtcgatggggagaccggccggaccatcgcggcggtgggatacgggccggaggaggagatcgccacgctgctgcgtctgcgggctgcgggccttgagcctgttggctgcgccgcctcggcggattttgcggccgcgctcgccgccgccggcatcgcgccggtcctcgccatcccggcgctgggctcgggcagccggaccttcgcgcccttcactcggtaa

SEQ ID NO: 8829 - DNA, 1701 bp, Methylobacterium sp.
atgccagcgccggccctcttctatggacgacctgccaacgacctgctgatcggtgcggcaatcgggctcggcatgactgcgcgggcgagtgtccagggcggggccgatttcctgcttgtcctcaatgccgggcgcctgcgggtgatgggcgcggcctcgatagcggccctctttccgatccgtgaggcgaacggcttcacggacgccttcgctcgcggcgagatcctcggccgggtgccggtgccggtgttcttcggtgcggccgcctttgatccgcggctcgacatcccggcgctcgccgcgcagctcgcccgggcgggctacgccggcatcgccaacttcccgaccgcgatccatttcgaggggcggttccgcgcgacgctggagaagtccggcctcggctacgcgagggagatcgccctcctgcgagccgcccgcgcggccggcctcgccaccttcggctacgccaagacccgcgaggagatcgaggggctgctcggcgccgaggtcgacatcctgtgcctcaacttcggctggaacgcgggcggctcgctcggcatcgacggcgtgcctctggacgaggctgccgaccgggcgcggcgggtcttccaatgggtccggcaggccaggcccgggacgatctgcgtggtcgagggcggcccgatcgtcgattccgccagcatgatccgggtctgcgacgaggcgaaggcggacggctacgtcggcggctcgaccctcgaccggctgccgctcgagatgtcggtgatgcagacggcctccgccttcaagaccgcgagcctgctgcggccggcccgggacgaggcgcagcgcgagcacgcccgcatcacggctctggccggcctcgtcggccagtccgaggcgatcacccgcatggtcgagcggatcgcccgcctcgtcgccaccgacctcgccgtgctggtgcgcggcgagccgggatcgggccgcacgacggtcgcccgcgccgtccacgtggcgagccggcggcccggaccgttcttcgtgctcgatgcggccgatccggagatcggcgaggcgctgttcggcgatggcgccggacggcgcggcgcgctcgaggcgggcgacgcgacggtggtggtggaggcgatcgggcatctctcggtcgcactgcaggagcgtctcgcccgggtggtcgagcaggcgatcgtcggccggttcgggcgcgaggagcagcggcgcgcccgcctcgtcgtcaccgcccacgaccaggccggcatcgtcccggcgctgctcgcgcggatcgaggccgggcaagtcgacgtcccgcccctgcgcgaccgcccggaggacatcccgcttctggcgcgggcgatgctccggggcctcgggcggcgcgaggcgcggccggcgcccgccgccatcgagcccgccgtctaccgcctgctgatgacccgggactggccgggcaacctgcgcgaactgcgctcgttcctcgcccgcgccgccgccgagagcccggacgggacgatccggagcgactgcgtcgcccggctctgccaagcggccgccgagatccggcgggggccggtggccgacgagcgcgcctggatcgtcgacgccctgcgccgcaaccgctttcgccgcaccgagaccgccgccttcctcggcctctcccgaaaaaccctctacaacaagatgcgccgctacggccttaccgagtga

SEQ ID NO: 8830 - DNA, 138 bp, Methylobacterium sp.
gtgcgggtaccggccggactggctgagcggatcgagaagcggcgccaggcgctgcagaaggtatttggcctgccggtcagcaaggccaccgccgtgatcgacgtgctagccgctgggctggaccagctggagaagtag

SEQ ID NO: 8831 - DNA, 381 bp, Methylobacterium sp.
atgaacgcagcacccctgtacggccgcggcctggatgagatgactggcctcgacgccgctgcccttgagcgcggaatggacgggctgacccaggagctggcgagcgggccggcctacactgccaaggaccgagcgcagcttgaggagaacgcccaggcgtatgccgccgagttctccgccgcccgggtgcgagaggcacgccggatcgccaagctacacggttgctcgatgaggggcgggcgcggcatcccgggctttcaattgacgaagaaggcgactggcgaggtggtgggcggcccccgctccaaggcagccatgctgacgcctggcgacgtggccagggtcttcggtgggcgcctgtcgaccaaggatgtgctgtga

SEQ ID NO: 8832 - DNA, 327 bp, Methylobacterium sp.
atgcaaggccgtgatagcgcagtacgtcgcaattctatcgaccaagtcagcgacgccgagttcctggccgaggtggtcgaagcattcgccggcgaagagctggggcggtgcgtcctcgaaggcccggacggcgtctccttccaggtctgcggcgctgccaagccgctgatcgagcagctgaccacatggtccggcccctctgaccaggacggcatcgaggtccacttctgcgacgtcagccgccgcggtcgcgcctatcccctgcaggggcttctgcacctcgtggacgtgtgcgccgctgcccgcgctcaggcggtgccagcatga

SEQ ID NO: 8833 - DNA, 2925 bp, Methylobacterium sp.
atgagccagcgccattatcagtccgagagcccggagcgcgtggcctcggccctggccttcgttgatccgaccgaccgcgaaacctgggtcaagatggccatggccaccaaggccgccttgggcgacctgggcttcgacatctggaacagctggagcgagggttccgacagctactctcagtccgatgcccgcgacgtgtggcgctccgccaaggaaaacggaggcaccggtgccgctacgctgttttggcatgcccgcaacaacggctggaaggatgacggctcgttccaggctcccccggctctgacggctgagcaggttgccgaacgtgaagcccagcgcgctcacaaggccgccgaagacgccgctcgccggaccgctgccgccaacctggcgaagacgctacgcgatgccggatcgaaggagattagcgaccacccgtacatcaagcgcaaggggtccggcctgaagtacggcgccggcatccgtcgcggcagcttccctcagcgtggctgggacgacgcactgctggttccgatctatggtgccgaccagaaggtcatgagcctcgaagcgatcagcccagacggcgagaagatcggcctgaaggacggcgctcgctccggcggcttctatcccgtcggccagttcatggcagcggagaccaaccccagccgcatcgtcatcatcgccgaaggcctcgccaccgctacagcttgccaggcagccactgggtacccggctgtggtggcgttcagtgtgggcaacctccgcggtgccggcgagaccgtgaagcgcatgtgccccgacgcccgcctggtggttgcggccgacctgggcgctgaggtcaaggcacgcgccgcagcggtcgctcttggcgcctgcttggtcgttccgcagggcgaaggtctggagaagggcaacgacttctgggacgctcgcgacatcctgggcggtaaggtggttgccgcccagttcgaggacgcgatcgctgccggcccagtcgaggccgaggcgcctgtcagtgagcgggcggtgcgctctgaggcagcctatcaagacgcagcagttcagacccagaccgctcaggcggcgcctgtcgcctatgccgaggccgaagaggtgcccgacgagctggccgcgcagctcctgccgaagttcgaggagcgctcggcccagccggtggcagtccagcctgccagcagcgtgacgagcgaagccactggcgaggagcccgacttcgacaagcacttcgcggtcctgggcttcgatcgcagcaccatcttcgtctacagccacagccggacgcaggtgctgacaacgtccgcctcggctcttagcaaggcgtcagggctgatcgagctggctccgctcaactggtgggagttctacttccagaaggcgggcaaaggcggatcgggcctggacgctgccgcggctgccgactggctggtgcgcctggccgaaaggcgcggcatctacgacgacagccgcgtgcgcggtcggggcgtctggctcgatgacggccggcttgtcttccaccacggcaacttcctgaccgtggacggcgtccagaccgagctgagcaacatccgcagccggcacgtgtacgagggcgctgccgctatctcgttggccgccgatacccccatgaccgccacggaaggcgaggctctgaccgcgaccgcctgccggttccgctggtcgcactctgggtccgggctgctgatggcgggctgggccttcctggctcccgtgtgcggcgctctgaactggcgctcgcacatctgggtcaccggtgccgctggctccggcaagtcgaccctgctggacaagttcctggccaagctgatgccgagcgactggctgctctccctgcagggcagcagcaccgaggccggcgtgcgtcagaagctcaagggcgacgcccgccccgtgctgatcgatgagttcgagtgcaacaccgaagccgacgtgaagcgcatcgagtccattctgaccctgatccgccagtcgtcctccgagaccggcgccgaggtcgcccgtggcacgatcagcggtcacgccatgagcttccggatccgcagcgccttctgcctggcttcggtcggtgtgtccctaagccggcagaccgacgaggaccgcctgacccgccttgagctggcggcagaggcggtcggtgattgggacaccctggagcgtgagctggaggtgatcgccgcggaccacacctacggacagcgcatgttcgcccgggccttgaagatgctgccggtgatccgcgagtcggccgccgtcatcagccgcgtggccggcaagcacttcggccgtcagcgcgacggcgaccagtttggcactctgctggcgggcgcctggtgcctgcagcgggatcgtgctccgaccgagaccgaggccaaggtgctcatcgagggacaggactgggcgagcctcggtgccggtgcgtcggttcaggtgaacgacagccgtcaggcgctcgacgcgatcctcagctctccggttcgggtcgatcagcgcaccttcagtgtcgcccagctcatcgaggtcgcggctggcggtgcgatggcggcgaccggatcacagccggccttcgaccaggcggttcacaccctgggcctgcacgggatccgcatctccgacggtgaggatccccggcgcctgatgttcgccatggcgcgccgcgagctggtgaagctggttgagggcactgacttcgaaaccgatctgatcggccgcctggcacgcctcccgggcgcctggaagtcgaaggtcaagaagcccggcgaggccggtccgccggagaaaacgcgctttgccggtgcaaccagccgctacgtctccatcccgttgagcctgtgcagtagcggggacgatgtcgctggggccaatgagagccatccattctga

SEQ ID NO: 8834 - DNA, 444 bp, Methylobacterium sp.
atgtacgaaacgaccgacctttccttcgacgccgtagcggcagaggtaggcgtggcgcgccggacggtgctgaagtggtccagccaagacggctattggcagaagaggaacgtacccaccagcaccgcagagcgcgctcgcatcatggctgagctggcgtcggatctgcagcctgatcaggcgcccgacgcagcgccggcggaggctgtagccgagcctgatccccgcgaggtggaagccaagctgatggaaaagcatcagcggatgtggcgcgttgttgacgggctatcagctgaggccgtgcgcagccgagacgatcgcactgcgcgtgtagctcacaccctggcgcgcaccttcgcgattgcgcaacgctccgagcgcatcgcctacggcctcggctccggcgaaacgccgtcctcgaccgtcgtgcttgagcgggagtga

SEQ ID NO: 8835 - DNA, 309 bp, Methylobacterium sp.
gtgaccgctcaagccccgaccctgttctccagtcccttagccctgcaccgcgccgccatcctggcgtgccccgccctactgcagctggtgctcaacctacaccacccgatcgccttcagcctggagcccagcgcagacgccagcatgaccgacgtgcagcgcgccatcgccgcggagctggtcgcctcccacgcccgctatggggataccgatgccggctttgtcctgctggccaccgcggcggagacggctctggctaacgcggagcgcgagtacggggctatggactgggcagcactggcaagctga

SEQ ID NO: 8836 - DNA, 267 bp, Methylobacterium sp.
atggccgccatcatgcccgcccccgcgccgatccccgatcgtccgccgcagcgcgcggtgaatccaggcatcccgacgccgcccaatccgggcgagatgccgccgccgaacctgcctccgcccccggaggaccccgatacggggccgaccggcccgcgcgtgccgggtcccgacccggacgtggacgagccgccggacccggcccaggtgccggaccggctcccgggcatcccgaccggccccggcacccgtcacgcggcgccctga

SEQ ID NO: 8837 - DNA, 243 bp, Methylobacterium sp.
atgtcccaccacctcgcaaccgccgcgctcaccatcgttctcgcggcaccggccggcgccgccctcgcccaggggccgacgcccttcgccggcagctcggccgcggcctccctcggctacaccgcggccccggccgcgatggcgctcacgctgccggaactcagcgtccgcatcccgccggccgatcccaccacgaccggctcgatccgcccacaccacggccacgcccgcaccggacattga

SEQ ID NO: 8838 - DNA, 459 bp, Methylobacterium sp.
gtggacgtgttcccgaaggagccgggctcgaacgccgagcgcttcgtctccccgctgcagggtctgccgaacgtgatcctgaccccgcatatcggcggctcgacgcaggaggcgcaggagcgcatcggctccgaggtcgcccgcaagctcgtggactacgccgataccggcgcgacggtcggcaccgtgaacttcccgcaggccttcatcagcacccgccccggcggcgcccgcttcgcccacctgcaccgcaacctgccgggcgtgctcggccgcctcaacgacgtcttcgcgcgctccggcatcaacatcgccggccagatcctgcagaccgacggcgatctcggctacgtggtgatcgacaccgacgccggcctcgccgaccccgacgcggtgctgcgggagctggccgccatcgagggcacggtgcgggcgcgcctcctctacgagcgggcctga

SEQ ID NO: 8839 - DNA, 381 bp, Methylobacterium sp.
gtgacggccctctacgcgggcctgttcgcgatcctgtactgcgcgctctcgctgcgggtggttcgggcgcgccgggcggcccgggtcctcatcggagtcgcggggcaacccgcactggagcgccgggtgcgggtccacgcgaacttcgccgaatacgtcccgctcgcgctggtgctgatgctcctcgccgagctctcggggtatccgcgctggacactgcacgggatcgggctcgtcctgctcgcgggccgctgcgtgcacgccgtcggtgtctcgcaggtgcgcgagaagatccgcctgcgggtcggcggcatgctggccacgctcgtgccgatcctggctctcggcctcatgctgctcgcggccacagcacgggtctga

SEQ ID NO: 8840 - DNA, 2436 bp, Methylobacterium sp.
atgatcgtcgaagaacttatcgggcgcctgaccctacagaccaaaggcctggacaaggccaagcaggcaacgaaggagcttgagaacttccgcaaggggctgaaggctctggccggttcggcccggatgcggctcgacgggccagcgcagatcgcgaaggcgttcagggcagcgcagaaggaggccgagaagctggcgcaggtccagaagcggcttgggtcgggcgcagggttcgaccgagcggatgcatcggccaagaagcacctctccacggtccagaagctgcgagctgcctacgtcgatacggcgaaggctcgggccctcttcgaccgcagaccgacgagctccgggcgatcctggatccagaacgagcttgaagcgctgcggcagtaccagcgcaccctcaaacaggtgcatgccgaagccgcgaagctcggcgtcccgcgtggccgcaccgaccaactgagccggatccgctacggcgaccggaacgggttcggcgaggccgtggcggccggcaccatcgcgaacaatgccggccgggcgactcagtacgcaatcgagcagggcgctgtcacgcagcaggaaaccaaccgccagatcaacgcgggcatggaagctgagcagatcgcggccctggacaggcgtgcgaccgagttgagcgcgcagttcccgagcgtcgatgcgaccaagatccggaccatggggcgcgacgcgcgcaacatgttcccgtccttcgagatggcgatgaaggcattgcccgagatggtgcgggcccgggtcatgctgcaggccgccaagggcgtcgatgcggccgacaacgagatgggcgacttcctgaagggcgcggacatcctcggcaagaccgaggacgtgggcagcctccgggaattgctcgacagctacgtgaaggctgtacaggtcgaggggcgacaacttcctctcaaagaatacaaggagcttgcaaaatactcgaaggccggaggcgtcaacctatccaatgagttcatgggttctgtcgcgccgaccttcatgcagtcggaaggcggcggacgcttcggcactcagctcgcggccggtatcaggtccctgatctccggcaagcgcacgaagaagtcgacggcggccctgatggaactcggcttgctcgacaagaagggccagctcaagaacgccgagaagtttcaggacaacccctatcagtatgcgatggaggatatgatccccgcccttcggcggaagggggtcaatcctgacgatgacaaagccgtacaggcgagaatggcgaacatcttctccgacaacatgacggagaaccttttcacgaaaatgatcacgcagcgcgctcaggtcgagcgcaacatcaagacctatcgcagcgcgaagggcctggacgcggcgggcgggcagacccgcggtgacccctatgtggcgtgggaaggcgtcgtttcgcagttccgcaatctgctcggcacgacgcagaaggagaacattggtctagcgggcaaggtcggcgcggccgtcgccgagagcatggctgacgtgaacaagtcgctgagtgcggatcctgccaaggcccaggctatcggcgcgggaacgattgcggggaccggtctcctcaccggcgcggccggtctaaagctctggcgagtcctgagcaattggtacggcgtcggcaagcaaggtgcgatcggcagcggaggcgcggccgggaccggagctggcgcggctggcgctgcgggtgccgctgccgagggcgctgccgcagcaggcgcgggctcgacggctgcgaccagcacgggcgtcgcggcggtagcaggtggcctcctccgcgggctgatgcgcctgataccggccgccgccgcgccattgaccatgggccccgacaaggccgatatggaccagatgacactccggctcggcaagctggccgcggaccgggaaaaggctaaggcaggcacccgcgcggatgctggcgagagcgatcgcgagaaccgcagggccgcggagatgacccgccgcgatcgagaggcgccgttcggtcagcaagccagcaggaccgcatggcaggaccctccgaagcgctacagcttcgccgagagcgatcgcgagaaccggcgaggcgccgagatggtgcgccgagaccaggcatttccgctcggtgatacgaccaaactcgccagcctgaacatcgacggggacgccgtgaagtcgcgcctcgccgagatccagaccgcctcgcagaaggtcatcgacaccctcggtactcaggtgacgatcaaggtggactcgtcgcagatcgatgcggctcaggccaaggcggacaagctcaaagccacggtggcgggtatcggaagcgtatcgggcggggtcggaggcgccggcctagcaaaaggatcaaacagcttcaccagctcaggagcgaccgcaccttga

SEQ ID NO: 8841 - DNA, 732 bp, Methylobacterium sp.
atgacgcccctcctcgcagtccatgacctcaccgtccggttcggtgggctggctgccctgtccgacgtgagcttcgcggttcggccgggcgagatcatcgggctaatcggtcccaacggcgccggtaagacgacgctgttcagcaccctcgtcggcctcgtcaggccgacccagggacacgtctcacttgcgggcgtgcgcattgagggccgccgcccgcacgtagcatcgcgcctcggcatgacgaagaccttccagaataccgcgctcttccctgagatgagcctgctcgacaacgtgatgacggcggccgtggtgcgcgaggacgtcgccaccgcgcgccggaccgccctggcgtgtctcgacaggatgggtctcgcggcgtcggccgccgaggacccggccaacctgaccttcccgcagagggcgctggccgaagtcgcccgcgcgctcgcgacaaggccgcgggttctgctcctcgacgaggtgatggcggccctgacgccgctggagatggacgaggtaatggccgcgctgcgccgcctgcgcgacgaggacggcgtcacgctcctcgtcgtggagcatcacatgcgcgcagtgatgcgcctgagcgagcgcatcctcgtcctcaacttcggacgcctgattgctgacggaagcccggagatggtgtccgcggacccggaggtggtgcgggcttatctcggacacgatcatgctcatcacgcgtga

SEQ ID NO: 8842 - DNA, 198 bp, Methylobacterium sp.
atgccgaagcccgtatcccccgaccggccgatctggccgccgctcccggccgagacggacgggcagcccgagtccgatgtcggcgcggcggaacgcgccccggcggatggcgcggcctcggagccggccggcggcctcgccggaccggggacgcggccggaccccgcggggcccgtcatgtcggcggtcctggcctga

SEQ ID NO: 8843 - DNA, 204 bp, Methylobacterium sp.
atggagcgtgacgccgccgcggactcgagccgcaccacggagcccccggcgcccgccttcgcggtgcgcctcaggccgaagttccgcgaggtcgtcctgccgccgcggccgccgccggtaccgcgcgggtgcgaggcggccgggagcggcggacgcccggacgcgactccggacgatccggacgacccggcgcgctcggcctga

SEQ ID NO: 8844 - DNA, 261 bp, Methylobacterium sp.
gtgaggaaactgaccttcgccttcgccgtagccgccgcgatgggggccgccgccctcgccggcccggcctccgcggctcccggcctgcccgcgggcgtcaccgcccccgacgccgtgacccatgtccagatgtcgccgatggagcgccgcatggagcgccgcgcgatgcgccggcacatggagcgccgcatggagcgccgggcgatgcgccgccatatggagcgccgcatgatgcgccggcacatgatgcgcaacatgtga

SEQ ID NO: 8845 - DNA, 699 bp, Methylobacterium sp.
atgagcgttcgagaccaattgtttcagatgttgcacacggtcgccggggctctcggcaccgatctccggggtcgacttgtgttcgttggaggttgcacgacagctctctttattaccgatgccgtcacccttgaagacgtaagggccacggacgacgtggacctgattgtcgatctcgccggctatgcagcatgggccgaattacaagcgcagctgcgtcggagaggtttcgtggaggcgtacgacgatacggtcatatgccggatgaaactcggagacctcaaagtcgatttcatgcccgacgatccagaaattcttggatttagcaaccgttggtatacgaaggggatcgagacagcagtcacctacccgctaaccgaagacgttaccatcagacgcctgacaccagaactatttattgccacgaaattggaggcctatctcggccgtggagacggagatcttcttggcagccgcgatctggaggacgtcctcctgatcttggatggccgcgcggaaatcatagaagaagtccggcgcgcagacgccgatatccggcagttcgttgccgagcaattcagggggctgctcaaggaccgggacttcgaccatcttctggacggcaacatccgaggcccggaagggcgggtcgatatcgtacgtgaacgcatcgtggccttgagtgacgacggcgcttga

SEQ ID NO: 8846 - DNA, 897 bp, Methylobacterium sp.
atgtacgggcttctggggctggaggccgagcccgcaagaccgggctacgagctgctgcgctccctcatgcatccggacgaccgctgtctcatgcccgatggcagggcggtgcggcagggcctgcttcccgcccgggagcggttccggatcatccatccccgtggcgtcacgcgcacgctcgcgacgcggaatgagatcttcttcgctccggacggcaggccgatggccgccgccggcctcgtcctcgacgtcacggatgtggttcgcctgaaccaggtgcggcttcgcgaccgccagcgcttcgaagccctggcgcgggatcacttcatcgtcaattaccagtcgccgggccatgattccgggatcgtctggttcgattatccggccgccttccagccgagcctcggcgagatgcgggacgatccctacagcatcatctccgtgcgggatcgggccagggccagggaggcgcgcgagtccgcccgggcgctgggccggatcgcgcaggggacgtttcgcttccgcaaggcggacggttccgacgtcgcttgccgggccgtcgaggttccgatcttcgacgaggcccgtcgcatcgtggagtggagcggcctcatcgctccgctcagcgagttcgtctcctcgtcgagcggcttctgccgggcgatcaacgaggccgtcagaggtcaccacctccgggcggcccgcgcgatgctcgactgctccctggcgcagttctccgagatcagcgggctgtcggtctcctcgctgagacgcctggaggaagacgccgcctgctccagcgcccgcatgcggcagagggcgatcgcggcgttccacgcgatgggcatcgacttcatctgcgccgacgacggcagcatcgcggtcatcaaggcctga

SEQ ID NO: 8847 - DNA, 87 bp, Methylobacterium sp.
atgaagtggacccggcagcgctgtcaggtggcgctcatcaccttggcgacggaggccttgatgccctcctgggccgttatcaggtag

SEQ ID NO: 8848 - DNA, 990 bp, Methylobacterium sp.
atgacggttctggtgacgggcggcgccggctatatcggcagccacatggtgctcgccctcctcgatgcaggagaggaggtggtggtcctcgacgatctgtcgaccggcttccattgggcgctgccccccgaagtgccgttcgtgcgcggtgacatcgccgataccgcactggtgcagcgggtcgctcgcgaacacggcgtgcggtccctggcgcatttcgccgccaggatcgtggtgcccgattccgtcgcggatccgctcggatactatctgtccaacaccgtgaagtcgcgcgcgctcatcgaggcggccgtcggggtggggatcgaacacatcatcttctcatcgaccgccgccgtctacggcgagcccgcacgcgtgcccgtgccggaagacctgccaccggatccaatcaatccctacggccgctccaagctgatgaccgagtggatgctgggcgacgcagcccgggcgcacgacctgcgctatgtcgttctgcgctatttcaacgtcgcgggtgcggatccgcgaggacgttcaggccagtccacccgcaatgccacgcatctgatcaaggccgccactcagacggcgctggggcagcgaccaggcctcgaagtgttcggcacggattaccccacgccggacggcacctgtctgcgcgactacatccaggtctccgatctggccgacgcccacatgatggccctgcgccacctgcgccgaggcggtggaagcctgaccctcaattgcggttacggccggggtttctcggttctcgaagtgctcgacacggtccggcagatttcgggacgggattttcccattcatttcgggccgcggcggatcggagatcccgcgcgcgtcattgcccaggctggccgtatccgtgacgaactcggctggcagccgaagcacgacgaccttcgggcgatcgtagcacaggctttcgcctgggaacgcgcgctgccttaccgtaatcagatctga

SEQ ID NO: 8849 - DNA, 324 bp, Methylobacterium sp.
atgctggccagtggcttggcgagcgttccagcggcggccgagagcctgtcggactgggcgcggcgagcggccctggagatcaggcagcacctgcgctggccgaccggctacggtcgggcggcgacgccgcgcacggccctcgtccgcttcaccatcgaccgggccggcagcgtgagcgggatcgcgctggagcggacgagcggcgtcggcggcttcgatgcggccgcgctggacgccgtgcgcaacgcgcgtccgcttcggccgccgccgcttccgccgggccgcgacagcatcacggcgcagctgccgatcgcgttccagtag

SEQ ID NO: 8850 - DNA, 252 bp, Methylobacterium sp.
atgcccatcgtgctcgccgttctcgccgccgcgctccttgccggtcccgccctcgctcaggtcgaccgcaccgggaccggaggtggtccgcgcacgacggagcgcgccggcaacgtgacggcgaccggccagaccaagccgccgggacgcgccgcgagcccgaccgcgcaggacgatccggagcaggtcccggacgggcagacccgtggcgggatcagcaccggcatatgcatcggctgcaacgcgaagtga

SEQ ID NO: 8851 - DNA, 207 bp, Methylobacterium sp.
atgcgcgagtgcggaatcctgagcccgaaccgatcgggcgtcaccggcgatccacggctgcacgggatcggccacgccctggagcagctctacgcgccggtgctggccgagggcgtgccggaggtctggctgcacctgctcggacgggcgggcgcgccgcgcgacccggagcgggaggggaacgaggcgggcgagccggcggagtga

SEQ ID NO: 8852 - DNA, 93 bp, Methylobacterium sp.
gtgggcctcgtcttcgccttgctgctgatcctgccgccgctggggatcgccgtcctcgacctgctccgcacgcgccggtcgcatccgtactga

SEQ ID NO: 8853 - DNA, 270 bp, Methylobacterium sp.
ttgccccatcagatcatcggcctcgcggcgatctccctgaccgtggcggtgctgctgcgcggctggggcgtgtcgcgccggacggcgttcgcgctcggtggcctcggccttgccgccaccgcgctcatcgccctcggtgatagcgggcgtcgcgtcgagcccggcctagcggggccgagcgagaccgagacgatgcggcccctgcagagcgtggtggttccgcagcgtccgggcggggcgaccgccggagtcgaggccttctttccgtaa

SEQ ID NO: 8854 - DNA, 195 bp, Methylobacterium sp.
gtggacgaaggggcgtccgaggctgagcggattgccgcggcctacgcgtgcgcggccggcggcgacacctgggcggccctcgtccgggccgtgtccgacgcgctcgcggacctggccgaggcggagcgccgctcgctccgccgcgaccggctgctatcgcgcggctacgtgcgggcgcggccgatcgaccggtga

SEQ ID NO: 8855 - DNA, 123 bp, Methylobacterium sp.
gtgagcgccgatcagatcttcgtcaccttcgggattccggccatcgccgtcgccctggcctatgcggccatgcgggcgaacgagtgggcggtgcgccgcggccggcagcatcccagcgagtaa

SEQ ID NO: 8856 - DNA, 237 bp, Methylobacterium sp.
atgatccagacgaaaacgatgctcctcccgctcctcgccctgggattggctctcggtctcggcaccgccccggcggaggccaagggctgcctgaagggcgccgtggtgggcggcgtcgcgggccacatggccggccacggcaaggcgggcgcggcggccggctgcgcgatcgggcatcacgaggccggcaaaaagagccgtcagcctgcgcagggcggtcagccccagggccaatga

SEQ ID NO: 8857 - DNA, 231 bp, Methylobacterium sp.
atgcaagcccacgtccatgctccccagagcccgtcacatccggacgccgacccgcatccctggttcggcgtcgaacctgaggcgctggaggatgccgcccgcgctctgtgcgcggttcgtccgggcagccacgccgccgagcgtctgatggagcgtgccgcctatctacgcgtgacgcgcagccgtcatgcggacgacaggcagcgggcgagcgcgctgttcctcggttga

SEQ ID NO: 8858 - DNA, 843 bp, Methylobacterium sp.
atggccgatgccgagcacaagcgccgccagcaggacctgctgacccaggaaggcgggcgggacgaggtcgtccagcggatcgcacagcgccagaaccagctcgtcgaggcgcgggcgaacctcgagcaactgcccacggtccatggaggccgcttgcagaacctgcgcaacgacctcgcctgggtcgagcaacgcgccgccgagacggaggcccggcaggcctacgtcgtcgtcgcgcccgcgagcgggacggtcgccacgctccaagccgcccccggccagccggccgatccgcgccagctgcagatgacgatcgtgccacagacgagtgacctgtcggccgaactcttcgtgccgagccgggcggtcggcttcatcgtgccgggccagccggtccggctcctctacgaagcctttccctatcagaagtacggggcctatggcgggcgggtcgcgcgcgtttcggggtcggtggtgcgccccggtgagaccggcggaccgctgaccctcgccgaaccggcctacaaggtcgaggtcaccctcgacagccccttcgtgcgggtcgacggacgctccgtcgccctgaagcccgacatggcgctgcgggccgatatcgtgctggagaagcgcagcctcatgcgctggctgctcggtccgttcctcgacatccgcaacgccatcgatgcggatccgctggttcgctggctgcgcgacgagctgccggcggccgccgccgggatgctgtcggaggcgcgggccctgcctgaaacgatcttcggcgccctcgcgcgccgggccgcgcgctcgccggagccggagccgcggcggacggcggagcgctga

SEQ ID NO: 8859 - DNA, 2130 bp, Methylobacterium sp.
atgggcggcggaagcctgcccttgatcctccagacggaggcggccgagtgcggcttggcctgtctcgcgatggtggccgggtttcacggccaccgcatcgacatgaacactctccggcggcggcacccggtctccctgcagggcgtgaccctgcggggcctgatcgaggtcgccaaggcgctcgacctcgcctgccgcccgctgcgctacgaggtggagcacatccgtcacctcgcgctcccggccgtcgtgcactgggacatgaaccacttcgtggtcctcaaatcggtctcgggccgccgcatcgtcgtccatgatccggcccgcggcgaacggcgcctcacctatgccgaggcctcgaaccatctcaccggcatcgccctggagatcgtgcccgccgcggggttccgcaggcgggacgagcgggcccggctgccgctctccaccttctggcagcacagcaccggcctgcggcgcagcatcgtcgaggtgatcgtgctctcgctggtgctggaagccctggtcctggccggccccttctacatgcaggtcacggtcgatgaggtcgtcgctcgcggcgaccgggacctgatggccgccctcgccatcggcttcgccctgctgacggcgctgcgggtggcggtgggagcgctgcgggcgcgcatcatcctgatcgtccagaacgtgctgcactatcagatcggagcgcggctgttccggcacctgctgcggctgccggtcgcctatttcgagaagcgccatgtcggcgatgtgatatcccgcttcggctcgatcgacccgatccgcaacctgctggcgcagggcctcatcgcggcgctcatcgacggcgtgctggccgtgctcacgctggggatgatcctcgcctacagccccacgctcgccctcgtggtgctcgtcggtctcaccctctgcgtcggcctgcgtctcaccctcttcgcgcgcttccgccgcctgaacgaggaggcgattcgggttggggcccgagaggacagcaccttcatcgagaccctgcgggccgtgcagagcgtcaagctcaacaaccgcgaggccgagcgggaggggcagtggctgaaccgcttcgccgagaccgtgaacgcgaacctcgcgctcgggcgcgccaagatcggcttcctcgccatcgatcaggcgctcaccggcgccgagtacgtcgtcaccgtctacgtcgccgcggcgctgacactcgacggcatcctcaccgtcggcatgatcttcgctttcatgagctaccgcgagcagttcgtggagaagtcgctcctcctgctccagacggcgctcgacctcagcctggtgcgcctgcacctcgaacggctctccgacatcgccgtgacgcccgaggagcccggccacgagcggccgctcgtccccaaggcgccgctgcgcggcgagatcaccctgcagggcgtctgtttccgttacgccgagggcgaacgggagatcctgcaggacgtgaccctgacgatccccgcgggccgtttcacgacgatcaccggcccgtcgggcgggggcaagacgaccctcgtgaagatcatgctcggcttgctggaaccgacggccgggcaggttctgatcgatggcgtgccgctccggacctacggcgtgcgcgattaccgcgaacaggtggcggccgtgatgcaggaggaccatctcctctccgggtcgatcgccgacaacatcggcttcctcgaccccgtcctcgatgagcgtcgcatggtcgagagcgccgtgcaggccggtgtgcacgaggagatcctggcgatgccgatgggctacgacagcctgatcggcgacatgggatcctcactctcgggcggccagaagcagcgcatcctgctcgcgcgcgcgctctaccggcagccccgcctgctgttcctcgacgagggaacggcccatctcgacatccgcaatgagcggctggtcaaccagagcctgcgcgccctggcgatgacgcgggtaagcgtcgcgcacaggcccgagatctcctgtggggccgacatgctggtccatgtcgacgggcgctgccgggcggtcgagggcccggaggcctccgaggcgctggcgcggatcggtcatccggccgaggctcagtag

SEQ ID NO: 8860 - DNA, 681 bp, Methylobacterium sp.
gtgggacgcgagatcgagatgctgttccgcgaggccgggtacaaggttgatcaggtgccggcctgcaaggatctcctcgcaggcagaggcgcgggcgtcgatctcgtcatcatcgacgccacccgggacggcagacgcgggctctgcctcgccagttcctatcgcagcgcatccagcgtcggaatcgtcgtcatccaccacgccgattcggagccggacccggtccaggccctggaagtcggcgccgacgacgtcctggtgcagccattccggcaccgcgaactgctcgcccgggtgaacagcctgctgcgtcgcatggatctggacaagggtgggccggtcgcagcgaagacgcggcgcggcatccggttcaagggttggctgctcgacctggagcggcgccaactggtctgcgaggcgaccggctgctgcgtgccgctgacgacggccgagtacaacatgctgacggtcttcgcacagaacccgtgccgggtcctcagtcgtgacgacctgtcgatccttgcgctggggcgccctcactcgatggacgtccgctccctcgatgcccaggtcgctcgcctgcgcaagcgcctgtcgacgaacaagcccaacatcgcctacatcaagtcggtgcgcagcgtgggctacatcttctgcaaccgaacgcacgacgtctactga

SEQ ID NO: 8861 - DNA, 276 bp, Methylobacterium sp.
atggcgcgcgatgatgggcctgagacggcggtggaccgccttgccttcaatctgctgggtgaagccttccgcaaactgagcgccgagttcatccgcacggatcgagccgcgggtatcaggcatctgcaagccatccatgacgagatcgccgcggcggcgcgccacgtcgagatggctcggccggatttggtgcgggagggcattgtcgaaggcgcaacgcaccgggtctgtacggtcttgcaatcggctggcgcctggccgcgcaccttcagctga

SEQ ID NO: 8862 - DNA, 165 bp, Methylobacterium sp.
atggcctatctcgccctgatcaccgcggcgctggcactgggaaccggcatcgcccaggccgcgacccggcgccccctcgccgccgagcgcctggagatggcggccggcacgctgttgctgacgggcctcgcccttctcggcaccggcctcccgctcttccgctga

SEQ ID NO: 8863 - DNA, 675 bp, Methylobacterium sp.
atgaccgcatcggccagcaagtggacgcgcgaccagatcgccgcgcgcgtcgcccgggacatccaggacggcatggtggtcaatctcggcatcggcctgccgacgctcgtcgccaaccacctgccggacgaccgcgagatcgtcctgcacagcgagaacgggatcatcggcatggggccggcacccgccgagggcgaggcggatcccgacctcaccaacgccggcaagcagccggtcacgctgctgccgggcggcgccttcttccaccacgccgacagcttcgcgatgatgcgcggcgggcatctcgacatctgcgtcctgggcgccttccaggtcagcgccgcgggcgatctcgcgaactggcacaccggcgcgcccgacgcgatcccggcggtcggcggcgcgatggacctcgcgatcggtgccaagcgcaccttcgtgatgatggagcacctgacccgccagggcgagagcaagctggtggcgcgctgcacctacccgctgaccgcgccggcctgcgtgtcgcgcatctacacggatctcgcggtgatcgagcgtgtcccgggcaccgcggagctgcgcgtcgtcgacatcgtcgagggcctgtccttcgcggacctgcaggccgtcaccgccgtccccctcggcgacgcgcgcgccgacgcgaacgcctga

SEQ ID NO: 8864 - DNA, 720 bp, Methylobacterium sp.
atgatcgacaagatttcggcttccacggaacaggcgctgcagggcgtccgggacggcgcgacggtgctgatcggcggcttcgggcatgcgggcctgccggtcgccctgatcgacgccctgatcgaccagggcgcccgcgacctcgtgatcgtcagcaacaacgccggcaacggcgaggccggcgtcgccgcgctgctcaaggccggtcgcgtccggaaaatggtctgctccttcccgcgccagtccgattcctacgtcttcgacgcgctgtaccgtgcgggcaaggtcgagctcgagctggttccccagggcaatctggccgagcgcctccgcgcggccggcgccggcatcggcgcgttcttctcgcccaccggctacgggaccgatctggccggcgaccgcgagacccgcgagatcgacggccgcaactacgtgctcgaatacccgatccgcggcgatgtcgcgctcatccaggccgagcgcgcggaccgctggggcaatctcacctaccgcaagaccgcgcgcaatttcggccccgtcatggcgaccgcggccacgctcaccatcgcggcggtccacgagatcgtcgagctcggcgcgctggaccccgaggcggtgatcaccccgggactgttcgtgcagcgcgtcgtccaagttcccatgcaagtccccatgcaagtccccgcgccgggaccggcgtccctccgcgcccccacgtaa

SEQ ID NO: 8865 - DNA, 1839 bp, Methylobacterium sp.
atgtgggtcttcatcgagggtcggttgcagatcgatctcggtggtgcccatggtccggaaacggcgacgctggatctcagcgcgaccggtaccgctgccgcacggctcggacttgtggtcggaggaacctacgacatcgcgatcttccacgcggaccgtcatacatcgggcctggatttcgggatccagattccgacgcaggcggcgatgtccgtcgactcgaccgccgacggcatcatcgaccgaacggaagcccgcgcgacggcctttacggtcaccgggttcgacgggttgtccggcgacgccgtcttcacggacggcatccgcaccacccaggcttccgtgagcggcaacggcacccacacgatcgacctgaccggcttttccggtgccgtcagttccaggcttgctgtcggcagccagacttcgggggtcggcaacaccgtaaccgcacgggccgtgaacggagcgcccgcgatcggaggtgcggctgccggacaggccatcgacgacaccgtgacggcgagacccttctcggtcgtcaccgtcacggatcccgacgccaacgcttccgcggccgcaaccatcaccatcacggtcggcggtacggccagcgatgccggcgggacgctctccggcaccggcctgaccaagaccggcacgggtacctacacgctcgcgatcggatcgccggccgcgaccgagtccgccctgcggaacctcgtcttcacgccggttgccaaccaagtcacgccgggcggaacggtcacgacggggttcagcctcgccgtcagtgatggtgaggcaacgacaaccgacagcaccacgacggtggtcgccacctcgatcaacgatgcgcccggcatcggcggagatgggcggatcgacctctcccagggtggaactgcggcggtcacgaccggagatctcacggccggtgatccggatgtcggacagagcctgacctacacgctgaccggcacgacgcgcgggcaggtgctggtcaatggcacggcgctgtcgtccaacggcaccttcacgcagacgcaactcgcggccggccagatcgccttccggcaggacggcagcgccgacccggtcgcgggcttccgtgtcacggtgagcgacggcatcgtcacgtcgagtccggcgacggttctcgcaagcgtcgccctgacgcccccgccctccgatccgggcgcggccggcccgagcgcgggcgacgacaacctcacgggcacggccggccccgacacgatcggcctcgggctcggcaacgacaccttcacgggcggcgccggcaacgacctcgtctacggcaacccgggcaacgacctgatctacggcaacccggatgccgacacgctctacggcggccagggcgacgaccgcgcgtacggcggccagggcgacgaccggctctacggcaacatcggcgacgacgtgctgttcggcaacctcggggccgacatcgcctacggcaaccagggcaacgacatcgtctacgggaatcaaggcgcggacgtgctctacggcgggcagggcaacgacgtgctctacggcgggcagggtgccgacacgctggtgggcgggatcggcgacgacacgctcgtcggcgggctcggggcggacctctaccgcttcgatccgaactcggcccgcgacctgatcctgggcttcgaccggggcgcgggcgaccggatcgccctgggtgggcagacctacacggtctcctcggcgcagaacggggacgcggtgctcctgctctcgggcggcggcgtggtcgatctcgccggcatccgggccgatcaggtcgacgcgagcgtcttcgcggcctga

SEQ ID NO: 8866 - DNA, 147 bp, Methylobacterium sp.
atggcccttccgaaagacgagaagccggcgccggtgcggacgaaccgcttcggcctgatcgccgccgccatcctcttcgcggcgctcgtcgcctacacgatctacttcctcaccgttccggccacgccgccgccgacgccgcactga

SEQ ID NO: 8867 - DNA, 312 bp, Methylobacterium sp.
gtggacctgggagcgacgccacggaaccgggcggcggcgcgcgcccgccggatcgccctcctcgtcgtcctgtgggccggcccgggaacgcgggcggatgcgcaggacagcccgatcctgcgggagcttcagcgccgcgagcaggagctgatcctccagatgcgcgagcggcaacggcgcggcgacatccgggaggacgagcggcgggatctcgcgcggcgggaggatctgcgccgcgaggaagcgcgcgagatggaccgccgccgcctgatcgaggcggaggagcggcgcgccctcgacaggcggcgatga

SEQ ID NO: 8868 - DNA, 369 bp, Methylobacterium sp.
gtggggatcgacgacgtgatgtcccgcctcgtcctgaacggactgatcggcctgtgcctcgcggccggcgcgccggccttcgcggccgatccggtcctgccgcgcgtccgagccgatcccgtgcacgcttatcccgttccggtcgagccgcctccgcccgcgacgatcctgcccgtgctggcgccgctggtgaacgcggtcgacccgcgcaccgggcgctgcctcgcgggcttcgcgcccgacaggcacgggttctgccgacgccacgacgatcccccgatcgtctgcccggagccggacttctgcggggccggagcgccgagcctcgcgccctacggcatcggccccgccctgcgcctcaactactag

SEQ ID NO: 8869 - DNA, 1251 bp, Methylobacterium sp.
atgagactggacgtgatgaaccagatcggatcggccttgaacaggctcttgtccggctccgcggagacgagcgcgcccggtggaaccggcaacctgcgcggcgcgaccgtgcagatggccgcgacggcccagcagccggcgcattcggcgggcatcggagagaggctgaagaccctcctggctccgctggccggcgcgctgaaggacgcgaaggcgtggctccaggccaagatgcagccggcccccgccccgcaggtgccggtctcgcagccccggatcgacaccaaccggacggccacgcagatccagggccggatcgagtacgcggccctcaccaaatcgggatccgagttcagggccggcgacggcgccctgacccccaagatccggaacgcgatcacgcatgccttcgggtacgagctgatggagagcttcgccaacagctccgatcaggtgcaggcgtcgcagtccttcatgcgcgacaacaacaccatctcgaagatcgcgtcgaacaccgcactgagatccccgcagatggacgccgtcgccagcagcgtgcgcgccatcatcggcgacacgccggtgatcctgagccggaagtcgctcggcctcacggcccaggacgaaggcgggcccacccagccggcgcatccggcgctcgcggcggggagccagcccgtggaccggcaggcggcggccgacgcctccgtggccacgatcgaccgcgtcatggtggagctgttcggcgatcccgacgatcccgccagcatcgaggcggccctcgaccgccttccgcgggagctctgcgaccagctcggcacgatgaacgccctgatcgacggcaccggggcccgcgtcgacgacgccctgaagaaggaactcaagacgacagccggccgcgacatcttcgcgctgcgggcgatcaacccggctctgctcgcgaggcccgggatcgcgaccaacgattcgcgcgcgctgagcagctcggtcatgtccgtcgccaaggccgtccagaacctcgtgaacggtcacggcatcgctctcgacggcaaggaggccgccccggaggtctccgcggccggcgcgaaggcgaacatgcaggcgcggtgggccgacggtttcgagaagttcctcgcggccgcctccgcgcgggcggatcagggacatctcgcgcaggcggcggccgacgctccgcagctcctcgcgacccgggaccgtctcgtcgccgaactcgaccggctcaggtcctag

SEQ ID NO: 8870 - DNA, 300 bp, Methylobacterium sp.
ggcttccagggcgccgggttccggggcggcgggttccacggcgtccgggcgggcggatatcgcggggttcgggccggtgggtatcgcggcgcggtggcgggcggctaccgcggcgcctacggccgcggcgcctacggatacggccgctacggctacgggtaccgaccctacggcgtcggggtcgcggccgcgggcgtcggtgccgccgccgcggcggcgggctactacggagcgacccgcggcgggtgcggtcccgacgcctattacgacagctatgcgggcgtctgccgcgcctactga

SEQ ID NO: 8871 - DNA, 330 bp, Methylobacterium sp.
atgtccgcgcggcaccgaaggcctgttcaggaggcttgggacagcgcgcaccagggccgcgatgtcatcgggccgagggatatcgaatcccgacgggaggtcatggtggacaagaacgatgtattgtcgggctttcgccgctacgtgccgcatccgagcttcgaggatgtggcctggtgggtgcaagcctttccgcactgcgccgacgacattcgcgcgcttgcgcgggccgcgatcggcattcaggctctcggctccctcgccgcccgagaagaggattttgcgcagccaagtctgcggcgagaagaccgggataatccgccgccctga

SEQ ID NO: 8872 - DNA, 849 bp, Methylobacterium sp.
atgttgatacccgctctgccgccccagccgacccgcgacgagcgggcacggcgcatcgccacgccggcccggcgggccgccgccttggccgctctcctgctggccgcggcccttccgtggggaagcgccgcgcaacaggcggttccacagggctctgatcggaccccgccgcagagcgcaccagccctggagccggacgcgctcgcccgcctgcgcgagaccggcgcggcgctcgcggcggcgcgcagcctgcgcttcaccgcgagcgcgctccacgacgttccgaccgcggagggccagtccgtgctctacgccgtccggagccgcgtgacgctccgccgccccgatcacctgcggatcgacacgggcggggacgaggccccggccgccttcgtgagcgacgggcgcaccatgacgctctaccggccgagtgccggcacggtcgcgacggcgccggcgccggccggcctggaggccgtcctgagggccgagatcgcggcggccgggcaggcgcaggccttcgccgacatgctgctggacgatccgggacgcaccttcacggacggcctgacccgggccttcgtggtcggccgctccgcgctcgtgggcggcgtcgagacggaggtggtcgccttcgcgagcccggacgcgcaggggcagatctggatcggcgcgcaggaccggctgccgcggcagctctgggtgaccgagaccgccgcgccgggccgcccgcgcagcggcgtgaccttcagcgactggcagctcgacccgatcctcgacgaccggaccttctcggtcgccggcgcggacggcgcgaggccggtgcccttcaccaagcccgaactctga

SEQ ID NO: 8873 - DNA, 570 bp, Methylobacterium sp.
atgagacggatcggtttcggcctgctggccctcggactgggcgtcgcggcggcgggcccggcggaggcgttctgggtcgcgcgcggctggcgcggcgtcgccgtcggcggcatccacgcgccgctcgtcgcgcgcgaggccgtgatgggccggtgctggcgctgcgcgccgctggcggccggggccgcgctggcgatcggggcgggggccgccacggcgcccgcggccgccatgccggtcgccatgccggtcgccgcgccggccgccgcgaccgtggccgcggcgcccgcaccggcggatgcggccacggccccggcggcgagacacgcggccggcacccaggtcgcccaggcgaacaccgcctcgacccactgcgcggcgggcctgccggcggattcgaagatgatctacgacgcgtccctgcggaacatgaagagcctggagaccctgcgcgacaccgtcgtgtcggagacccgctccctggtcgaggccggccggatcaccgaggccgatgcccgccccgccgccgagaaggccggaacctgcctgaggatgctcgcccacccgtga

SEQ ID NO: 8874 - DNA, 318 bp, Methylobacterium sp.
atgaccgaacggtatggcgcggaggcgaacgggcacgtgctggtggcggggcgcgccgggcggcgccggcacatcgcccatctcgcccgcgagccgcgcttcgacctgatcgaggcggacgtcaccgggctgctgccgccgctgccgcggatggggcaggtcttcaaccgcgcctgcgcggcctcgccgccgcacgaccaggccgacccgctccacacgatgatgacgagcgtgctgggcacgatcgcgtggttctcccgcgaggtcgcgccccgcgaacgggcccggcccgagccgctcgccgcagcggcggtgtga

SEQ ID NO: 8875 - DNA, 1275 bp, Methylobacterium sp.
atgaccgacaccaagaccgacgcgacgctcagcctctgcatcgccgcgggcgcgcggccggacttcctcgaccgcctgctcgggcgcgtcgcggccgatggcggcctgcccgccccctacgagatcgtggtctcggacgcctccgcggacgggacgatcaaggagatcgtggagcgccgcgccgcggaggggctgccggtcgtgcgcttccggcacgccggggccgcgcaccggccgggcgacgccgcgagcctgctcgccgccctgcggcgggggcgcggccgctaccgcgtcgccctcgccgaggacgagcttcccgtacccgcggccctgtgcgaggcggtggccttcctcgacgcgcatccggaggtgctcgcctgctacgcgccctgggagctgcacgacgaggcgcccggcgcggtcgcgaccgcgcagtacgccctggaggccgacgccgtcttcgggccgggcgaggcgatggagctgttcggcttcctcgtgcgccacggcgccgccccggaggcggccctctaccgcgccgaggctctgcgggccctgccgccgccaagccaccactgccacgcgggcttcgtcggcctcgcccggctgatcgccgagggcgcggtcgccttccggagccggccgttccgccgcatcgccacgcaggaccccttcacgggccggcgccacgagagcgcgaccgcgggggcggcggactgggacctgcaccgcggcggtctcgaattctacgtccgcgccctgctggcacggaccggcaccgccccagacccggcccaccgcccggtcttccgggacgcgatcgacgcctatgtcgagacccggatgcggcaggccttccgggtcgccacgggccggggcgacttcctggccgcccacgagatccacaaccggctgagcctgctcagcctcggcgaggcccgaccgccggtcgagggcctggagcggctgccgctcctcgtggcggtgcagacgctggcgcggctcgccaacgagaccgccgaggtggagcgcgtggtgctggtcggcgtcgaggacgggccctcgatcagcagcctgctgcgcgagctcggcctggagcggcgcatcctggtggccccgcccctggaagcgccgggcgagaaggcgatccgcgggagcctcgtcttcctcggcgagaaggccgcggacgcgcgcgcgcgcttcatcgagcagggctacgcgccgagcctcgtggtggacgagcgcgacctcatcgccggcatctgcctgccctga

SEQ ID NO: 8876 - DNA, 144 bp, Methylobacterium sp.
gaggacatcatcgagccctacctgatccagcagggcttcgtgcagcgcacgccgcgcggacgcgtcctcaccccgcaggccttccgccacatgggactggccgtgccaagcgcggagatcgccccggaggcggcggaggcctga

SEQ ID NO: 8877 - DNA, 279 bp, Methylobacterium sp.
atgaagtggatcctgccggtctgcgccctcgtgctgtgcgtggccgatccagccttcgcccgcggcgtgccgcatcggcccgcacccgacccgtccggcgccgaagcgcgggtgcagccgaacgataccggcgctccaggcagcctgatcatcccccgcggcagtacgggcgcggacacgatcttcctgaactccgccgcgggcggcaatgccggtcagccggagcgcgcgatcccactgggcagtggcggcggaggcgacagcggcggcagcccgtag

SEQ ID NO: 8878 - DNA, 285 bp, Methylobacterium sp.
atgcgcctgacgctctccctcatcctcatcgcggccgtcgcgctctacggcgcctccttcctgcaggccgcccaatccggcgccttggcggaagcgggcgcgcaccctgtgcgcgacggggcgccccggtcgatctgcatcggctgcggcggccccgtcgtgccgttcgaccccagcggcggggtccaggccggacaggcgccggatgccgccggcaagccgcggccggcggtcgggcccccggcaagcggcggcgccccgcaccgcccggggcgggcgccctag

SEQ ID NO: 8879 - DNA, 195 bp, Methylobacterium sp.
atggtggtcctcgacccgcgtaccggtcggctggtctcgatcagcctgggcatccagcccgacacgcgcaccggtcccgccgcaccccggcccgcccggccgccgagggagtggccgccgcaccatccggaagcgcaccaggagccgccgggtgccccgccggcccgcctgcggatccgccgcgaggagagctga

SEQ ID NO: 8880 - DNA, 345 bp, Methylobacterium sp.
atgacctacgcgttcgataccctcaagttcacgcagcggctggaacaggtcggtgtcggacgcgatcaggccgtagcgcatgccgagctcgctcgcgacatgatcctcgccgacacggcgacgaaggccgatctggctgcgttggagaccgctctcaaggcagagatcacgggggtccggacggatacccgcgctgatgtttcgaatttgagaacggacatccagacgatgaagcgagagttcgagggatcgctccgcgaactcgaacttcggatcaccgtgaagctcggcgcgatcatcgctgcggcagtcgccgcgatcgcggccctgcaaaagtttctctga

SEQ ID NO: 8881 - DNA, 795 bp, Methylobacterium sp.
atgccgccagcttccagcctggaagacctgatcctcgccctgctgccgaccgacagcacgcccgtgctcaaccgggtgatgcgggtgatgctgacccgcgagcgccaggagccggtcggccaggacgcctatttcgccgcccgcgaccggttgctcgccgcgcgccggatcggccggctgcgggggcagggcggccagatcttcctgatgcccgagcaggccccggtcgaggcggaggcgcccgccccggagagctggcccgaggccgccctgatggcgccgctgcggcgctatctcgaagggcccttcgcgaaggggctcgacgtcggcgagggctgcaccctcgtgcaggacacctcgacgctcgggccccgccagggcgtctgggcccggccggacttcatctgcgtcacggccatgcgcttccggctgctgccgggcgtccaggtcgacgtgcacgccttcgagctgaagaccgagagcggcggcaccgtgcaggcggtgcacgaggccctggcgcagacgcgcttcacccatttcggccacctcgtctggcacctgcccgagggctcgcgggccgaggcgcggctcgccgagatcgaggcgcattgcgccgcacacggcatcggcctgatccgcctgcgcgatccgcgggcgccggaggcggccgagatcctggtcgatccccgccggacggcgacgcggccggcgatgatcgacgggttcttggaatcgcggctgaacgcggagaacagggcccgcctcgaagcggtgctgagggaggtgcgggcgtga

SEQ ID NO: 8882 - DNA, 210 bp, Methylobacterium sp.
atggctcacatcagcctcgcagatctgatgaagcatccgcccgccgtcgatgcggcgaagctcgacgcgctgacggaggcggatctccgggcgcagcggatcgcggacggctacgatccggaggcgggtcctccggacgacacggagatcgtgctgcctttgcagcaggtccggtcgcgccttgggatgactcatactgtttccggttga

SEQ ID NO: 8883 - DNA, 111 bp, Methylobacterium sp.
atgatcgccgcatcgcgaaccctcatcctccggcaccgcgagatcgcgggcgcgctcgcctcctcgggcctgttcgtcgccagcctcttgatgctcacagccctgctctga

SEQ ID NO: 8884 - DNA, 105 bp, Methylobacterium sp.
atgtcgccgcaagccgacgacggcatcatacgctggaacaccccgaacaaggacggcaatctgggtggccccggcgcgggcggcagcggcggcggcggcggttga

SEQ ID NO: 8885 - DNA, 495 bp, Methylobacterium sp.
atgaaggcccttgttctggctggcgcggcgctcggcgccggcctgatgatgacgccgagcgccgaggccggcccctacggctacggcggctatcgtggcggttacggcgggggcttcgcgggccaccgcggcgactacggcgggcgtgggttcggctaccgcggctacgcgggtcggggcttcggctacggcgggtatggcgggcgcgggttcggctaccgcgcggccggctacggctatcgcggcggcttctacggcggccgcggctacggccggggtctcggcctcggtctcgcgggcgcggggatcggcctgggcgtgggcctggcggcgggcacgctcgcggccggctcctacggctacgccgcaccctattacggcacgaacggctacggctcctacggctacgccccggtcggctacagctacccgtcctacggctacgccgcccccgcctacggctacagctacggcgccggttgcggctgctggtag

SEQ ID NO: 8886 - DNA, 693 bp, Methylobacterium sp.
atgccgagcgtgcgcgagctcggagaactcaagtacaagatcacgcggctccggatggtggacgcgcgctacgtcaccggcatcgaggccgtcggcgacctgaacaagacgtccgatcagcgtctcaaggaggtcgaggcggttgctgcgcgctacgagccgctgatcgcgagcacggaggagcgggcactctgggatgaattccggcggaactggaccgactatctcgctcagagagcgaacatcgcggcctccgccgatacgaagagccagaccgcgctggatgatctgttccagctctcgcgcaaacacttcaacgcagccctcgatgcgctcgatcgcgatacggccttgaacatcgccggcggtgagcgcgcacgctccaccgcgagcgccacctatcagttcggcatccagctcacgatcctgttctgcggcctcgcgctgatcaccgcgctggccggcatcctgtacacgctcgtcggcgtcacgcggccgatcgatcgcctgatccggcgcatgcacgctctcgcggccggggacgtcgagggccgcatcccgcacatcgaccgcaccaacgagatcggcgccatcgccgccgcagtcgaagcgtcccggggcaacctcgtgcgcacccgccagctcgaggcggagacggcgctggcgcgggcctcggcggaggagcagcgcaag

SEQ ID NO: 8887 - DNA, 594 bp, Methylobacterium sp.
atgcgcggcatgagcgcgttgaagacgcattatcggccctatgtctgcccgcttcacgcggtcctcgaacagatcccgccggaagcgcgggtgtacgatatcggatgcgggtccggctcgttcctctatctgatccgaaggctgagatccgcgatccgcgcccaggggcacgatgtctcggccgaggcgatcgcggcagggcagcagctcgccaagatcgagccgagcatctcggtctccctgcgaggcgccgattatgtcccggatctgagcgatgtcgatgtcgtgacgatgatcgatgtcctgcatcatgttcccaagcgggagcaggccgggttcgtcggacggatcgtctcgaagatgcgcgtcgggtcgcggatcgtcattctcgatatcgatgccgcgcggcgatggcgggcctgggccaatcaggttcacgatctcctgctcgcgcgcgagtgggtcaatccccgcacggcggcatcgacgatgcggttgctgcaggatgcgggaatacaggccgagatgccgcgtctgtactcgaccttgtggtacggacattacctgatttccggaatcaagaccaaacattga

SEQ ID NO: 8888 - DNA, 345 bp, Methylobacterium sp.
ttgcgcaactccctgcagggcctgaccgtggcggcgcgctccgagcgcgccgtacggcaggagctggtcgttctcgccgttgccgtgcctgcagccttcctgattgccgatcagatctacgattggatcgctctgatcggcagtctcgcgctcgtgctcatcgtcgaacttctgaacacggcgatcgagaagctctgcgaccacctgcatccggggcgccacccagcgatcggcaccgtgaaggatttcggatcggctgccgtgttctgcgcactgatcttcgcgctcatcgtctgggtcagcctggcaaccatgaatattcttcttccccacgacagcctgtga

SEQ ID NO: 8889 - DNA, 1626 bp, Methylobacterium sp.
atgttcggggggatgctgccggttctcgccgtggctctcacgtttgccgacggcacggcgattgccacaagcagcgacagacttctggcgtctttcgccttcaacgcgatcctgttcgggctccttgtccactccgcagcccacctgctgaaaagatcgatctttctattgatttatgccatctttgcaatctactcttctctctatgtgttgttctatgtctatcattttaacatatttggtcagatatttggcgaatcatccatcaacgcggtgatcgacagcaatccccaggaagccggcgagttcttgagctgggccttcaggcttgagcatctgcctcttccactcctggcaggcctcaccgtcgcagccgctttcgccgtccgggcgcccgccgtgccggccatccgctcgcggcgcgtgggcttcgccgccctgactgcggcgctgctgatgctgccgatcgcggccgtgaagaccaatgtgattctatacaatccgatcttcttcccgggccatgcgacgtacaaagctctcgcaaatcgttctgcggtcgccgaaatccaaagcaagatcgacacgattcgaatcggatccgtcgatggccccggagagaaagccgttacgcacatcctcatcatcggagagtcgacgacgagacgacacatgtcgctctatgactatccacgggacaccacgccgcgcttgcgcaaactcgcgcccgaactcgaggtcgccacggatgcgtgttcgtcacgcggcgctaccgttccggctcttcaggagatgctgacctttgccacccgcgagaactcggcgcccctcttcgagaagccgagcctgctccagatcatcaaggcggcgggcttccgctcttggtggctctccaaccatgccttctacggggacttcgacaattggtcgatggttctgtcgcggccagccgatgcgcgtcatttcgtcaaccgcgtcggtgaagggacgagcttcgacgaacagctcctgccctatctgaaggatgcgctcgccgatccgtcgccgcgcaagttcatcgtgctccacctgctcggtgctcattcagattatacgctgcgttatccggtcggctttgataaatttaccgacgcgccattgccgccgactccccggacgctcacaagccgggatgctcaactcttcaacgcatacgacaatgccatcctctacaacgatcatatcgtcggggagatcatcgctgcggcccgagcggccgatgcacatgcgaccgtcaccttcgtgtccgaccatggcgaggcgctcggcgagatctcggacttcttcacgcatatcgatggtcgcgcgccgcggcaggtctacgagatcccgctcaccttctggatgtccccggcctttcgggcacgtgccacgccgcgcatcaaccaactgcgaggcaacctcgggaagcccttccagacggacgcgatgatccacacgctcctcgatctttacgacatccggcacgacgcgcatgcgcctcaacggagtctgttcgccgccgactacagcgtaccgtcgcgcttctgcgacaagatgccggggctgccggcatcggcgaccaaccctctgatggtcacagcgcagtga

SEQ ID NO: 8890 - DNA, 156 bp, Methylobacterium sp.
atgcgcgcgttcggcccaagccggtcgagcgggatctcactggcctggagcgcgccgagcccggcgtcgatgaaagcgtcgctcgcctcgttgaagtcggacgagagcttcttgcggtcgttcagggtgtcattccccgcggttatgcgcagctga

SEQ ID NO: 8891 - DNA, 975 bp, Methylobacterium sp.
atggatcgtcgccagtttctcggatgcggcgtcgccttcgccgcagctggcaatgcgctcgctccgcgcagggccatcgcacaagccttcccggtgcgacctgtgcgggtcgtcgtacccttcaccgctggcggcacaacggatttcacggcccgcgtcgtctgtgagacgatgagccgggccgccggacataacttcgtcgtcgagaacaagccgggcgccgcgggggtcataggcgtcaaggacgtggccgcctccgagcccgacggctacgccctgctgttcagcgactcgtcgctcgccgtgacgccgacgaccaaccccggcgccaagctcgaacctttgaagatgctgcagccgatcgggctggccggcatcttcccctctgtactcgtggtgcatccgagcgtgcccgcgaggaccgtgcaggaacttatcgactacacgaaggccaatgccggcaaggtcaacttcggctctggcggaatcggtacagttcctcatcttcaggccgagcagttcaagctcgtgaccggcgccgtcatcacccacgtgccttacagaggcgccgcggccgcgcttcaggatgttgtcgccggacagatccagatgctgttcacggccgctccgactgcgctcgccttcatccagtcgggcgacctcaagctgatcgcaacaacgggcgccgaaaggctgccggtcgtcgcggacgctccgacactagcggaagtcggcttcaaggatctcgtttcggcgcagtggttcggaatgctcgcccccgccaagacccccgcggacatcgtcaaacggcttaccgaactgatgtccggcgcactcaacgatggtccgacagcgaagaagctcaccgaccagggtggcataatgaagcgaggaacgccggaggatttcgcaagatttatcgagagcgagatcgcaaagtggcgtgacgtgattgccgcatccaagcagaaatag

SEQ ID NO: 8892 - DNA, 1230 bp, Methylobacterium sp.
ttggctggccccttctgcggctaccatctggcgcgcatgggcgccgaagtcgtcaaggtcgagaatcccaagggtggcgacctcgcgcgccggctcggcgccgatccgacgatggccgagcgcctgatgggcctgtcgttcgtggccgtgaacgccggcaagcagtcggtcgccatcgatttcaaatcggccgacgggaaggagatcttcctgcgcctcgtcgagcaggccgacgtggtgctggagaacttccggccgaaggtcatggatcgccttggcctgggctacgacgtgctcgccgggcgcaatccgcgcttggtctactgcgccatctcggggttcgggcagaacgggccctggctcggacgcccggcctacgaccagatcgttcaggggctgtccggcgcgatgagcgtgacgggggatgcggccaccgcaccgctgcgcaccggctttccgatctccgacaccatcgccggcatcaccgcagccttcgcgatttcgtcggcgctcgtcgagcagcgcaccaccgggcggggtcgccggatcgacgtttccttgctggaagcgaccctggccgcgatgggctgggtcgtctccaaccatctcaatggcagcgtcgatccgcagcccatgggcaacgagaacttcaccgccgcaccctccgggacgttccagaccggcagcggtcccctcaacatcgctgccaacgagcagaagcagtacgaaactctctgcgacctcgttggccgtcctgatctcaaggccgatgtgcgctttgccgaccggcaatcccgcaaggtcaaccgtccagccctctcgaacgagctgaacgcggccctgcaggctcggaccgccaaggagtgggaggcgttgttcaacgcccacggtgtgcccgccggtagcgtgctcagcgtgccggaaatcctgcaggaagagcaggtcacgggccgccgcttcgttgaaaccattgacgcgacggtgcgtggtggccagccgatgcgcgtcactcggccgggcttcctgctcgatgaggactacccggtgccgacgccgccgccgcagctcggtcaggacaccgaacgctggctcgaggtactcggctacgggccggagcaggtcgccagcctgaaggggaacggcaccgtcgccgcggtcgatcggccaacgagcgggccgtccgcaaagccccccgagctgcagccccgcgcagacagcccccgtcgttga

SEQ ID NO: 8893 - DNA, 870 bp, Methylobacterium sp.
atgagcgacaaggatcctgccgccgtcctcgcggatgccgaggcctggtggtcgacggcgatcatcgacatgaagcccggtgttatccgcttcgccggctttccgatcgagcaactgatcggttcggtcagcttcccgcagatgatctggctgatgctgcgcggcggcatgcccacaccggccgagggcgcgctgctggaggcggctctggtggccggagtggatcacggtccgcaggcgccctccatcgcgatcagccgcatgtccgtcacctgcggcctgcccctgaacggggcgatggcttcggcgatcaacgtcttggatgacatccacggcggcgcgggcgagcagtgcatggagctgtacaccgacatcgcgcggcggatggacgaaggccagacgctcgacgtagcggtggagggggggctcgatgcgttcatagccgcgcgcggcaagatcatcgctgggttcggacaccgcttccacccgatcgatccccgggcgccccgcctgctcgccctggtcgatgcggcgcgcgagcagggcgtggtgaacggccgcttcgccgagatcggccgcgcggtcgaagcggcgctcggtcggcgcaagggccggggcatcccgatgaacatcgacggcgcgacggccgtcatcttcgccgaactcggcttcgcctcgccgctcggtcgcggtcttttcatcctgtcgcgctcggtcggcatcctggcccatgcctgggagcagaccctgcagggtggccgcatcaaggggccgatgccccgcgggatcccctacacctacacgggaccggcccagcgcgacttcccgggcgacgcggcggctccggaagctggggtactgcggtcatga

SEQ ID NO: 8894 - DNA, 972 bp, Methylobacterium sp.
atggacctcagggacctcgcgttcttcgaagtcattgcggattacggacatctcggccgtgcagcagagcgcctcgggcgcacgcagccggcgctgaccaagtgcatccaaaggctggaggcttcggtcggggccgagctgttcgcccgctcggggcggggcttggtgttgacccaggtcggggaggtgctgctgacgcgcgcgcgcctgatgcgcaccgcgatggacgaggcgatccgggaggtcagcgagtttgccgccggcaccgcgggccatgtgcgggtcgggaccggcgccacgatggcggagtacctgctgccgcacgtctgtcgccgactcatcgccgcagcgcacggggtcacggtggacctgcagatcggcatgagcggggttctgcgcgctgccctgcgcgaaagtcgcctcgatctcgtaatcgggcccgtcctgccgggcgacgccgatgaattcgctcatgagagcttcggcaccgacgaggtggtggtcgtggccgccaaaggccatccgctctgcggtcgaccgctcgagatcgaggcgctgagcgcctggaagtgggtcctgcccgcccgcaccgtcgccatgcgccagtggctcgatacagtgttccaggcccacgatatcactggcccgcacgtgcagatcgagaccaactcgatcaccatgctcccgcgtctgatcggcgaaaccgacctgctcagcttcacctcgacccgcaacctgttgccggaacgcctgggcggctgggtcgaacgcttggacatcgacgtgacgaccctgcggcgcccgctcggttgcgtccatcgccgcggcagctacctgtcgccagccgcctcgcgcgtcgtcgcgctgctgcgcgaccacggcgcggcgctgctggcggaaggcggtgtcggcaccggtgccctggcaccaccctccgggcggacccctcaagaccgggttggcaccgcatag

SEQ ID NO: 8895 - DNA, 1218 bp, Methylobacterium sp.
ttggtgcccatcctcggactggcctacctcttcaactacctcgatcgcacgagcgtgggcttcgctgccctgcagatgaatcaggcgatcggcctcaccgcctcgcagttcggctggggcgccggcatcctgttcttcagctactgcctgctcgaagtcccgagcaacgtgatgatgtatcgctacggcgcccgccgttggctcgcccgcatcatgatcacctgggggttggccgccgcagcgaccgccttcgcggtcggtccgatgagcttctacgtcattcgctttctcctcggcgccttcgaggccggcttcttcccgggcgtgatctggtacatctcgatctggttcccggcgcgctaccgaacgcgcgtcctggcgctcttcatggcctcgacaccgctctcatccctgctcggcagcccgatctcggccgcgctgctcagcatggacggcatcctcggcctcggtggctggcagtggatgttcatcatcgagggcctgccggcctgccttctcggcctcgcctgcctgtggatgctcgcagacaccccgaaggacgcgacttggctcagcgccgacgagcgcaacgcgctggtcaccgaactcgccaacgagaggtacgagaagccgaagaaggatctctgggcagcgatgaaggacgtgcgggtggtcatgctcaccaccatcacgttcgccttcacgatcggctcctacggcatcggcatctggctgccgcagatcctgaaggggcacggcctgtcgaccctcacgatcggctgggtcacggcgatcccctacctcttcgccaccatcggcatgctggtctgggcgcagtacgtcgaccgcacgggcaagaagatctacaacctcatcgcggccctggtgctcggcgcggcgggcttggctgcctccgtcctgttcacctcgctcatcccggggctcatctgcctgacgctggcgctgattggcacgatttcggcccgcaccgtgttctacacgatcccgcagagcttcctcaccggagcggcggcggccggcggcctggcgttcatcaactctgtcggcgccttcggcgggttcgtgggaccttaccttgtgggctatctcaaggatgcaaccggctcgttcgatgcggggatgctcggcatggcggcgaccctgctggtgtcggtcttcatcgccgcctcgctcaagctcgtcattaagaacgcctga

SEQ ID NO: 8896 - DNA, 300 bp, Methylobacterium sp.
gtggcggcgcaggcgctcgccgagcggatcggcgacgcctccgtgacgtgcgagccgcgcccggcgtcggaggagggcgccgcgacggcgctctgccgcgtcggcgacgaggatctcggcgcctggatggtcggccggggctacgccgtggccatgcggcagggcccgcacccctatgccgaggccggcgcccgcgcccggggccggcggctcgggttgtggtccggcgtcttccaggaccccgatgcgtggcgccgatcccaccgggcgccggtcgcccggctggccgggggatcctga

SEQ ID NO: 8897 - DNA, 555 bp, Methylobacterium sp.
gtgccggaatcggcgcgtctcatcgacggtggcggcgagatccgcgtcgaggattgccggccggtctcccgggatgggccggctgacgcggcggatgagatcggcgtggtaggcgccgccgaccggcttctcctcgccgagcatctccaagatgcgctccagcgcggcttccagcgacgtgtgcccggcctgcatcgcctgcatcagggccatccgggccttgtaggcctccagatgctcaccctcgaagccgccggcccggtcgatctcgaccgcccgggagaaatgctcgaccgaccaagccacgtcgtcgaggatctcgatccagcgcgcgtcgctcatgcgagaacccgcgctcctggcatcacctgcgcgcggaacccctcggtgcaccacgtgagcgggcggatgtcggccgccagcccgtgcgccgcgcaggcctcctcggcgaagcgccaggcctccgcctcagccgccacaggcacatcgatgagcagatcgacgtcgctgtcgtggcgcatcgccccgcgcgccgccgagccgtacaggaggtag

SEQ ID NO: 8898 - DNA, 375 bp, Methylobacterium sp.
atggttccgtcagaggccgagatcgaggcgcggctcgccgagctgcgccgccgccgcgaggcgatcgaccgcgagatcgccgaccacctgctctatctggagctcggccggcgcctgcgggccggcaccgcggaggcgggtgcggcgtcggcgggtgacgacgccgatccggacgcggccgatccgcccgggccggtgttcccggggcccgcggaggccggcgggacggggccggacggcggagccccgccgcggcggtggccggcgcgggagcccgccgccggaccggccgtgccgccctccgtgccgccgcccctgtcccccgccgccgcgtcgggcgcggcacggggctgggccgcccgcgcggccgaggcc

SEQ ID NO: 8899 - DNA, 1776 bp, Methylobacterium sp.
atgtcggggccaggaacagaccgcgcgccagcgcgagccggcggcgcggagtcgggttgcggcgacgcggtttcgtccgccctcatccacgcggtcgggctgctggagcgcggcgatccccgggcggcgctggaggcggcgagcgaggcctgcttcgacgcgcccggacgccccgagccgcactacgtctacggccaggccctggccgccctgggcgagcatgctctggccgagcgcgccttcgccgaggcggtccggctgcggcccggctggcccgacgcctgggtcaattacggcctcgcccgctaccgccggggggcgctcggcgatgccgtgacggccatgcgcgcggcgctcgcccacgcgcccggccacgccgccgcgaccgccaacctcgccgccttcctgcgcatctccggcggcgccgaggaggccgccgacctcgtgcggcaggcgctcgagcgcgagcccgctcaggcgggcgtgcggctgaaccgcgtcgcggacctcctgcaggaggagcgcgccgccgaggcgctggcgctcctcgatgccggcgcgccgccggccgctgcgcccgccgacctgccgatcctgcgccactggcacctgcagcgcgccctcgccctgctgcagctcggccggggcgcggaggcccgcgcggcgctggccgcgctcgacgcgctcggccccctgccgccggcgttggcgccgctgcgcctctggcgcgcggtgctgctcgcgcggggcgaggggcgtgacgaggcggcccgcgccgccgccgaggccatggcggcctccctcgacgcgatggggccggacgcgatccctgagcaccgtatcatgggccactacgacctcgccaagttctggtccggccggggcgagcacccccgtgccttcgcgcactggcgcgagggccaccggctcctcgccccgagccagcccttctcgcgggcggaccatctcggcttcgtcgagggctgcatggcccatctcggcgccgcgcgcctcgcccgggggccgcgggcggcgaaccgggaccccgcgccggtcttcatcgtcggcatgccgcgctcgggcacgacgctctgcgagcagatcctggcggcgcaccgggacgtgcacggggcgggcgagcgcggcgcgctggccgaggccggggcctgcctcgcgggcggtgcggcggacgggcccggggcgccggcccggctggcggcgctcgacgcgcccgccctcgacgccgcggccgggcgctacctggccgagctgcgggcgctggcgccggacaaggcgcgcatcgtcgacaagatgccgggcaactacctccatctcggcctggtcgggctgatgctgcccggggcgcgggtgatccactgcacgcgcgacccgcgcgacatcggcctgtcgatcttcaccttccgcttccacggccggcacggctacgcgcacgatctcggcgacctcggctggaccatccgccagcagacccggctgatggcgcactggagcgcggcgctgccgaacccggttctgagcgtggcgctgtcggactgggtcacggatttcgacggcacgctggcgcgggtgctcgcccatctcgacctgccgccggacccggcctgcgcgcgcttccacgagcgcaccgaccccgtgcgcacggtgagccgcgcccaggtgcgccagcccatcaacgcgcgcggcctcggccgctggagaacctacgcggccgagctcgccccgctgatcgcggaactcgcgccggccgaggactga

SEQ ID NO: 8900 - DNA, 153 bp, Methylobacterium sp.
cgcccctacggccccgccgcgtacggccgcccgcgcgtggtctacgaggagcccgtctacgagacccgccgggtgatctcctacgagcgcgtgcccgtcggctacgccccggtccggcgcgggtgggacggtccctacggcgagcggtggtag

SEQ ID NO: 8901 - DNA, 306 bp, Methylobacterium sp.
atgcgccagatcctcaccctcgccgtcgccggcgcccttgccgggaccgcgctcgcggttctcgcgggccccgccgcggcccagatgcggccggtcgcctgcccggagggccggctcgtggatggaagctgcgtcaacccgcggctcgccttcctggcccgccagcaggcggtctgcttcacccaggtgaagctctcctacatcgcctgccccggcacgctgccgggcgtcgacacgcgctacaagttccccttcaacgtcgtgaccgagcgccagcgcgagctgaacttcgtcgtggagcgctga

SEQ ID NO: 8902 - DNA, 1278 bp, Methylobacterium sp.
atgagacttctacgatgggccggcgcgctcggcctgctctgcggcgcggcggaggccgccgacctggcggcgcccgtgccgttggctccagccgccttcgagccggtctggacgacgacggtcaacaccgagttccggtacttcagcttcggcggcaccaaggggcagccgaccggcatcgcgccgctcggcgcgcgcggccgcggcagccagttctacctgccgttcggcctcgccatctcgggccagccgacacccgacctgaagatcgacctcacggcccgcggcggctacgtcgattcgcgccaggagacgcaaggcctgatgggtgcggtgcgcaccaccctcgacacgcagctctcggcgaccgcgacctatctggggctcgatggggtgcagcccttcgcctcgctgaacctcaacctgccgaccggcacctcctatctggcgggcacgcgcttcctcgcccgcctcgattcggacctcgtggacgtgccgaccttcggcgagggcttcaacatcggcccgagcgtcggcgtgaacgtgcccatcggccagacgatgctgttcaacctgacgctgggctacacggcccgcggccagtacttccgcgagggcgcgccggacccgatcacgggcatcgacgccttcgtcgacacgcgctcgggcgacaccgtctcggtcaacggctcgctcgcctacgaggacggcccctggagcggcaacgtggccgtggtctactcccaggacggcaccaccttcatcaaccggctggcggccatccgctcgggctcgcgcgtcggcctgtcggggcaggtgggctacgcgtggtcggaggcctggggcaccacgctcagcgcctcgttcaaccactcggagcgcaacttcgtgccgaacgcgccgctgccgggcctcatcgcggagccgcgcaactcgaacagcaacctctaccgggtcgggctcgacacgctctaccgcaccggcgccttcgcgctgggtccgacgctgagcttcctctaccgcgacgtgaattcctacgacccgatcaccttccagttcctgcccgctcgcgagcgctacggggcgggcggcacgttcacgtacgccatcaccgacgccgtctcgctgagcctgcgcggcgagcgcatcctcgtgcacgaggccgcaaaccccgataaggagttctttcccggcagcggcatcgttcccggaaccgggcagccccgtctctcctacgccggctggtcgatcagcggcggcgccacgatcaagttctga

SEQ ID NO: 8903 - DNA, 1089 bp, Methylobacterium sp.
ttggacgatgttctgtcgcccgcgcaaatttccgagatttacgaggccgcgatcgaggatgacggcctcgcgagacttgtcgagatcgtgggccggatcgccgatgtcgacagtgccggcatctggctccggcagggctccgagatcatcgatctcacggtgagcgaggcgatcgcggcctcgatggtgccctacctcgcctactacgcccgaattgacccctgggccgcggcgatgatggcgtcgagccgcgtgacgctcggcaacgagatcgtcgacgaagcgcagctcgtgcagggcgagttctacaccgacttcgcccggcatttcggcatgctgcggccgatgggcgcgacgctcggcatcgcgccgggggtcgtggcctccgtctcgaccaaccgcgcgagccgcgcccacctcctcgacgggacggacaaggcgcgcttcgcggtgctggccgtccacctgcagggcgcattgcggctgcgccaccggctcggcggcgagcgcgtgctgcgccgcgacctcgccgccgccttcgacgggctgcagttcggagcgatcatctgcggcccggacggaacggtcctgttcgccaacgacgcggcgcgcgccctcgaagcggcgcgcctcctgcaactgcgcggcccgggcggcgtgctcacggcagccacctcggagcagacggcgcggctgcgcggcgcgatcgcggccgccgcgggcagcgggcagcccggagggatccagcttgccggggcggagggctcggacatccacgccctcgtcacgccgctgccgggagcggctccggacgcccgccgggggcgcgcgctcgtcacgctgcgccgggcggacgccgtggccggccctgcggagggccggctgcgccagctcttcggcctcagcccggcccaggcggcgctctgcgtgcagctcgcacggggcctgaccttcgaagcggcggccgatgagcgcggcgtcgcgctcagcaccgcgcgcacgcatttcctcggcgtcctgcagaagaccggggccgcgaacctgcgcgacctgctgcgcctcctcggcacgctgccgcaggcccattga

SEQ ID NO: 8904 - DNA, 81 bp, Methylobacterium sp.
ctcggcgcccacacccttccccaggccgtcctcatcgcgaccgcggccggcgtgcgccccgtcgatcaggacggcgcgtag

SEQ ID NO: 8905 - DNA, 270 bp, Methylobacterium sp.
atgcgctcgggtctcgagcgcacggcgcatctcctgtgcgaactgctcgagcgcctgggatcgatcggcgccgtgtcggacggccagttcgaactgccgttgacacaggtggatctggccgaaacgctcggcctgtcgagcgtccacgtcaaccgtgtgctgcaagccctgcggcgcgacgggctgatctcgctgcgggcgcaccgcctccggatcctggcgccgcggcggctgagtcagctcgcggagttcgaggccgggtacctgtag

SEQ ID NO: 8906 - DNA, 453 bp, Methylobacterium sp.
atggtgaccccgatccggaatggctcatccagcttggtcgaactcgctggcatcgtcgtctcggcctatgtctcgaacaacccggtgccgctgtcggagcttccgaagcttatcgaccgggtccatacggctctcaacgagatcatgaacgcggatgcggtggacaggaccaccgagctcgaagagaaggcgacgcctgagcaaatcaaaagctcgatcacgccggatgcgctgatcagcttcatcgacggaaagccttacaagacgctcaagaggctcctggccggacatggcctcgacccattcagctaccgtaagcgcttcggcctgcccgcagactaccctatggtggcgctgaactatgctcagcggcgctccgagatcgcgaggggaatcaccctcggcatctacggagggcgtggcaatcagcacaggagcggcgcgcgccactga

SEQ ID NO: 8907 - DNA, 141 bp, Methylobacterium sp.
atggcgaaccgctcgcgctcgctcgagatcacctcggcgtcgtcccggcggactgcctcgacgcgcagcctgcggcccttgacggagaccggctccacctcggccgtcacgctcatgccgaccagcgcggccgcgccgtag

SEQ ID NO: 8908 - DNA, 1425 bp, Methylobacterium sp.
atgacgtctatcctgcgccccgtcgacggtgcgcaccgcaaggtgctggtcctgggaggggacgggttctgcggttggccgacgagcctgtacctgtcgcggatcggctacgacgtgacgatcgtggacgatctctcgcgccgtgggatcgacaggacgctcgggaccgactcgctcacgccgatccgtccgatcggcgagcggctggcggcttgggaggcggtcgccgggaggcgcatccgcttcgtcgagctgcgcgtcggcgaggcctacgcggccttccgcgacctcgtcgcggagatcgggcccgacacgatcgtgcacttcgccgagcagcgctcggccccgttctcgatgcgctccgcccgcgagaagcgcctcaccgtcgagggcaacgtctgcgcgacccacgacgtggtctgcgcgctcgccgagacggggctcgacgcgcatctcgtccatctcggctcggtcggcgtctacggctacggctcgaccggatttccgcggccggagggttacctgaaggttgcggcccaggccccgggcggcaccgtcgagaaggagatcctgtacccggccgatccggagagcatctaccacctgaccaaggcgctcgatcagctcgtcctgcagtactacgccaagaacgatcgcctgcgcatcaccgacctgcaccagggtatcgtctggggtacgcagaccgaggagaccgcccgcgacgagcgcctgatcaaccgcttcgactacgatggcgattacggtacggtgatcaaccgcttcctcgtccaggcggcgctcggctacccgctcaccgtgcacggcagcgggcgccagacccgggccttcatccacatccgcgacacggtgcgctgcgtggcgctcgccatcggcgacccgccacggcgaggcgagcgcgtgcgcatcctcaaccaagtcaccgagacccaccgggtcatcgatctcgcccggatgatcgcgcggctcagcggcacgccgttccagcacgtcgccaacccgcgcctggagcccgaggagaacgagctcgacgtgagcaaccgcggcctgatcggcctcggcctcgtgccgacccatctggaggatgcgctgctcgccgagatctccgcgatcgccggccgatacgcccaccgctgcgatcgggcgacgatcccgagccgcacccgctggtgcgccgccccggagccgtcgccgatcgcgccgggcgcgggggcggctccgagccctggctccgcggcgcgaacctgcgccgagccggcgtccccttcgacggagtgcgctctagcgggcggagccgcgcccgctccgccgctcccccaggcggacgcggacgagctggaagccggcccgccacaggaagcctggtacgatccggagatagcggcgccagagccggcgcggctctga

SEQ ID NO: 8909 - DNA, 144 bp, Methylobacterium sp.
atgatcgcctcgctcccggacgcggaccttcgcgccggggatccggaaagcggccttgtcggagagccggcgatgggccgcacggggcgtgagatttccgtgtacctcgaaattctcctgccgagcccgtcggcgttgcgttag

SEQ ID NO: 8910 - DNA, 120 bp, Methylobacterium sp.
ttgctgcccggcttcctcgcggacgccgggctgagcggcctaagcaccgggctggccggcggggtgcacgccggccgcggtcgcgatgaggacggcctggggaagggtgtgggcgccgag

SEQ ID NO: 8911 - DNA, 180 bp, Methylobacterium sp.
atggccgagatccggatcgtcctgagccgcctcacgcccgccgaacgcgccgccttctggaatgccgtggacctcctctaccgcgtaccctctggatctccgatgagcatgaaggaagaccggtcgatccagtacggcgttgcgcagggtctcgaagccttgcttccgccggtccggtaa

SEQ ID NO: 8912 - DNA, 345 bp, Methylobacterium sp.
atgcactcgtcaccgtgctgcggccggtgcgggatcgtgtgccggtcggaccttcggctcgtctcggcgcgcagcttccgccgggacgatctggacgacaggcgggagatttcatcgatgctgtcggaaatagcgcgtgagatcctggcgtacttgcacggcacgcaccggctgcccggggcacgactgcgcatcacgacgctggacgaacggttcgggaccgaccctgcgattgcagcggcgatctccgaactcgcacgcaccggatatgttgcgacgccggacgctggcacgatcgaactgaccgcgcgaggatacggggcgtcgatgagcgaacagctctga

SEQ ID NO: 8913 - DNA, 300 bp, Methylobacterium sp.
atgccgatgaacatgtatgatggcgaggaaggacgtccactgcttgatctgatcatcgaaggcatggaggtcgtcgacagcgacggtacgcggatcggatccgtcgacaaagtcgagggcggccacttgaagatctgccgtgccgatcagaagccccgaaaccagccccagtacgtcaccccggactggatcgctgctgtcgatgatcgagtcaggctgaaccggacgtttgatgaagcgcggcgcttgtgggcgagcgaaccctacgcaaggcggcatcatctccaacgcgcgatctga

SEQ ID NO: 8914 - DNA, 123 bp, Methylobacterium sp.
atgcctcatgatcagacgcacgccaacgtcggcttgacgggcctgcgcttcgccccgacggtcgcgagcctgcgcgagaccgcggcagcgctgctgcgccaccgcatgagacccacgccgtaa

SEQ ID NO: 8915 - DNA, 90 bp, Methylobacterium sp.
gtggccgacccagaaggcaacacgatcgagttcgtcgagccggacaagggcatcttcgccgaaggcccgctcgaggcgcgggacgcgtag

SEQ ID NO: 8916 - DNA, 135 bp, Methylobacterium sp.
atgagcatcctgacccaagccgtcaccggtttcccggccgccgaggcccccgcccgcggctggttcgcgcgcatgatccagctctggctggagcaccacgcccgcgtcctcgagatgggcggcgagccgctctag

SEQ ID NO: 8917 - DNA, 198 bp, Methylobacterium sp.
atgacgagactccccgcgctcgcggccgccgccctcatcggcgtcggcgccctctcctccaccgcggccgaggcgcgcgggcgcggcggcgcgctcgccgccgggctgatcggcggcctcgccgccggcgcccttctcggcgcggccgcctccgcccatgccgagccggcctacgggtacggctacgccccgcccccg

SEQ ID NO: 8918 - DNA, 555 bp, Methylobacterium sp.
atggcgacgacgttcacggtcggcaacagcaacggcgcggtcttcgccgacgccggcacgacctccgccggtcaaacggacggaacgaacagcttgagcctcgccctcgcgcaagccaatgccaccggcgactcggtcatcatcaacctgacttcgaacatcacgctcaccggtccgctctcgccgatcttcaacgccaacgtcacgatcaacggcaacggcttctcgatcacctcgaccagccagcgcatcttcttcgtcggcaccagcgccgggttgggcggcggcggcctcggtgccgggggtgcgctcttcgtgaaccagaccggggatgtcgtcctcgacaggatcgacgtgacgaacaatcgcgcgaccggcggggccggcggtccgggtcccggtggcgggagcggcggcatcgcggagctgaccaagagcggcacgggcacgccgaccctcggggacatcgacaccaccgcgggccgggcaacgacctcgtctacggcaaccagggcgcggacgtgctctacggcggccagggcgacgacacgctga

SEQ ID NO: 8919 - DNA, 738 bp, Methylobacterium sp.
atgcaggatcggccgcaaccccggacggtcggcaccgcggggtccgaaccggccgacgactcaccccacgccgcccgcctgcagcccagcgacggcaacccgcacggggtcaccggccccgtcctgttcgaggcctaccgcaccgcctcgctggcccgctcgagcgccgcgccccagatcctcacccgcacgccccggcacgtcgcgggcggcaccgacgagatcatgctctaccggcaggaggccggcacgctggagggcgaggcggacgggcggtccttccgcctggagcccggcgacctcgccctgttcgactacgcgcagcccctggtcagccggacgagcgccttcaccaacctcgtgctgacgacgtcccgcgccagcgtgcccgccgccctggtcgggccggacctgcacgggcacctcatcccgggcgggagcggcccgggccgcctgctcgccacggaggtctccgacccggtcgcgacgcgaccgggcgcggtatcagggccggccggtctgcttcaggcgcgtcatgaccgcctcgggcgaggcgtaggcctcctggcgggcggcgctccagtagcgcagggcgtcgagctggatcgcctcgccggtcaccgcgcagcgcacgaagctgccgggcttgaccacccgcatggtgccgtcgccgtactcgacgacggcctccccgctcgcaccccgctcgaagcgtcccagcatcgcagatgtccctga

SEQ ID NO: 8920 - DNA, 249 bp, Methylobacterium sp.
gtgcggcgcctggcccggctggatcccgaagttctgcagcgcttcatcgacgccctcgccgccggcgagatcgttcagccggtcggcgtccggaccggatctagcgttgtggtgatgacggggccgttcgcgagcattccggcggccgtagaggcaatcctgcccggcgatcggctgcgcgtggcggtcagcatcttcggccgtccgccgcacgcagtcctcaggatggcggatgtacaggcaatctaa

SEQ ID NO: 8921 - DNA, 213 bp, Methylobacterium sp.
atgacccaacccctccgcctcatccgcttggccgcggtcgaatcgatggtcggcctcaagcgggcctgtctctacgatcggatgagtcgtggcctcttccccaagcccgtccgactcggcgacgccagaaactcccctgttgcttggcccgagcatgaggtgcaggccttcatcgcgcagaagatcgcggcccgcgatcaggcggcggcgtag

SEQ ID NO: 8922 - DNA, 216 bp, Methylobacterium sp.
atggcaggatcggcggaagagcggctcgacgccctgaatagcgagatcgcagacctggaggaaaagcaggatgcttatgtctcggtcatcgcggctttgaccgatcaggggctggacactgccgcggccaaggccgcgctcaaaaggatcgaggatcagctcgtggcgcttcgggtccgcacggcaactttcgagggtgacgcgaggcacgtttga

SEQ ID NO: 8923 - DNA, 396 bp, Methylobacterium sp.
gtgccgaacgcgttcaacccgtcctttctgtcattcaacctgccgtccggaaacgtcagccagtccttcgcccccttcttcacccagcaggtcggcatgacctacgcgggcaaccgggagatcgaggagcgcgtcgtcgccgacgtcgcgagcttcggccggcagatcggccggctgctcgacggcgtcctcctgctcgcgcgggacagacccgagccggaattcgcgacgctgcggacgatggccgccgagatcaaacgcgtgaaggaggagacccggtcgagcgcgctgcgcgacgcgcgggcggcgctcgacgcgctcgcgcgggcggaccccaagggactcgcggtcctgctggagggctacgcgccgcccgtgccccggggcagcccgtga

SEQ ID NO: 8924 - DNA, 273 bp, Methylobacterium sp.
gtggagtgcgtcttcggcatcccgggcgaggaaagcctcgacatcgtcgagagcttgcgtacctcgaagatcgagctcgtcctgacccgccacgagcaggccgccgctttcatggccgccacctgcggccggctcaccggcaagcccggcgtatgcctggccaccctggggcccggcgcactcacatgccgtccgcgtgctcgcgcgagcatggctgcgtgttctctggcgcgcgtggttggacggaaggcccaacgatcctcagcgacatag

SEQ ID NO: 8925 - DNA, 1428 bp, Methylobacterium sp.
gtggaccgtgagaccgctatcgccagggctgtagaggcattgaggtcgggagccttccgcgaggacctggcacgtcgcgtcgctatacccacggagagtcagaaccccgcacgggcggccgagctcgaccgctacatcgagcaggagatgcggcctgccttcgagcggatgggcttctcctgccgcgtgctgcacgccccctccgcaccgacgcccttcctgtacgctgagcggatcgaggcgccgggcctgacgaccgtgctcggctacgggcacggcgacgtcattcacggcatggacgagggctggcgccaggggctctcgccttggaggctgctcgagcgggacggactctggtatgggcgcggcatcgccgacaacaaggcgcagcacagcatcaacatggcggctctgggcgcggtgctggagacccgcggccggcttggcttcaacgctaagtggctgatcgagatgggcgaggaggtgggatcgcctggactccacgccatctgcgccgtgcacaaggacctcctcgccgccgacctactgatcgcctccgacggcccgcggcttaaccgggatcgcccgaccgtgttcctcggctctcgcggcgagttcaacttcaacgtctggatcgacgcgcgcgcggacgaccaccactctgggaactggggcggcctgctctccaatcccgccatccagttgacccacgccttagcgacgctggtcagcccgaccgggcagatccgggtatcaggtctcgttcccgaggcgggcatcccggagaatgtccggtcggcgctgtccgactgcatccttgaggcggcgcccgatgccccgagcatcgaccccggctggggcgaacccggcctgaccggaccggagaaggtgttcggttggtgctcgttcgagatcctggcgttggaggtcggcaacccgcgggcgccggtcaacgctattccatcgcgggcatgggcccgctgccacgtccgccttgtggtgggcgtagactgcgacgccgtcctccccgcggtccggcggcatctcgaccggcatggcttccactacgtgcagatcgaggctgcggaggaggctcccccgttcccgccaactcgcctcgacccgaacaaccgatgggtgggctgggccctcgattccatcgcacgcagcacaggcaagaaacccgcattgctaccgaacttcggcggctcgattccgaatgccgccttctccgagatcctcgacctgccgacgctgtgggtgccgcactcgtatccgggatgttcccagcacgccccggacgagcatctgcccgtggcaattgtggaggagggattgaggctcatgacaggcctgtactgggaccttcacgcgaccgacggccacggctcggagggagcgacggctaggaatgggcaggacgcatag

SEQ ID NO: 8926 - DNA, 909 bp, Methylobacterium sp.
atgcgacttatcgtggccctgacctgtgcgaccctgctcacctcaacgacctgccccgttgaggccgaggaattgagcggcacgctcaagaagatcaaggagcggggtgcgatctcgctcggtttccgagactcctcggtgccattcagctacttggataaccagcagaagcccgtcggcatggccatggatttctgcctcgccattgcggatgccgtgagggagaagctcaacgacaagagcatcaagatcgacctgctcgccgtcgccccggcctcgcgcatcgccttgctgacgaacggcaccaccgatttggattgcggcgccaacacgaacaacccggagaggcagaaggtcctcgggttcacgaacacgattttcctaacagcgtcgaaatatgtttcgaagaaaaacaagaacctccacaccgttgaggacttgaggggccgcaccatcgtatccacctccgggtcctcgaacatgaggcagatcgtgcagttgaatgcgcagcgcaagctcggcctgacgatcctcactgcgaaggaccacgccgaaggtttcttgctggtcgaaaacggtcgggcggatgccttcgtgatggacgacattctgctcgcgagcttcattgccgcgtcgaaggacccgagtgcctacgaaatctcgtccgaggggatgtcaaaggccgagccctactcaatcatgctgcgcaaagacgatgccccgttcaaagcacttgccgacgaggccgtggcgtccattcttacgagtccgcgcatggccacgctctacgacaagtggtttacgaagccgatcccgccccacggcatcaacctaaattttccgatgagcgcgcagatgaagcaggccttcgcccacccgaccgatagtccggacccggacgcgtactga

SEQ ID NO: 8927 - DNA, 234 bp, Methylobacterium sp.
gcggcggcggtggaggagcagggcgcggcgacccaggagatcgtgcgcaacgtcgccgaagcctcgaccggcacgggcgcggtgacccggaacgtcgcgggcgtggcgcgggctgccgagaagaccggatcttccgccgcgcaggtgctggcctcggcctccgagctgtcgcgccagtccgagcacctctcgggggaggtcggccgcttcctcgcgagcgtccgcgccgcctga

SEQ ID NO: 8928 - DNA, 1104 bp, Methylobacterium sp.
ttgcgtatccgggctctcacgatgacgagtattctgaccaacgcacgggcgctcaccgcgctcaggactctcggagcggccggcgacggcctcgacaccgccaaccggcgcgtctccacgggcgcacggatcggcagcgccgccgacggggcggcctactggtcgatcgccacgaccctgaaggccgacaacgcctccctcgacgcgctgaaggacgccatcggcctcgacaagaccgccgtcgacgcggcggcgctcggcctgacccggacggtcgaccagctcaggatcatcagccaggccctggtctcggcccagggcgagcaggcggaccgggcgaagatccagctcgacatcggcaatgcccagcgcgtcatgcgcagcatcgcggagagcagcgcggtcggcgggtcgaactggctctcggtgcagtccgacgcacccggcaccttcgccacccggcacctcgtcatggcctattcgcgccgggacgggaccgcgcacctcacccgcagcgcgctcgacgcgtcgcagttcgtcctgttcgacgcgaaggcgcgcatcgacccgccggactgggccgaggtgagcgcggcgcccgcgctcgggacgctcgccgcgacgacggccgccatcgccgcgcgggcgaacccgacgatcgtcgggggctacacggtctcgaccttcgacgcgccgggccatacccacgtcaacgggctgctcgacacgggctacaggatcgacggcgtgcccgcgctcacgccggtgcagacctctttctcggtcgccacgatcgacgtctcgcagggccacgtgaatcgcgggatgatcgaggcctatgcccgggtggtcgacgccacgctgcagaaggtcatggacggcgccgccctgctcggatccacctcgaccctgctcacggcccagcgcgacttcgcccggcagatgacggcgatcaacgggaacgcgatcggcatcctcgtggacgccgacatcgaggtggaatcgacgcggctgagggcgctgcaggcccagcagatgctgggcctgcgcgccctctcgatcgccaacgcggcgcccgacacggtgctggccctcttcaactga

SEQ ID NO: 8929 - DNA, 234 bp, Methylobacterium sp.
atggccggcgagaagccgcacggcgacaagacccacgcccagcagcagcgcatcatcgagcacaaggacgggccgaacgtgcccgcgggcggcggcgcgaagatccgcaacagcccgccgcgggagccgcggagcgcctcgcagcaggagagccgcgaccaccacaagcacaacaatcccggccaggaggggcaccggccgcagaagcacggcccggccgaggagaagcactga

SEQ ID NO: 8930 - DNA, 354 bp, Methylobacterium sp.
gtgagcggccggcgcggcatcgccgcccttccgccggcgcgcgcctccggtgtaccctggtggccgatgaccctcggatggcccctcccgcgcctgctggcggcgatgatcctcgcgatcctcgccggcgcggccctggccgcgacgccgtcggcggcccacgctcacgagggccacggccgtcacgggccgcgcgccgccgcgcacgcgccggcggccgcccgcccggctgcgcccgtccgcctcaagaccgggcccgacatcccccggatcgccgtcctcaccgcggcagagcacgcgccggcggccggtcgaagcgacagcatggattttcctcacgttcggacatcggcc

SEQ ID NO: 8931 - DNA, 171 bp, Methylobacterium sp.
atgcgcgaccccaacagcctgttcaccacccaggccttccggatgcgcaaccgtgacctgatctacgtctccaacgccccctacaccgagctacagaaggtgctcggcgtcttctcaagcgtcacgggacccgtcgcatccgccgcggccgtctacgcctactcgaagtag

SEQ ID NO: 8932 - DNA, 231 bp, Methylobacterium sp.
gtgctgatccgcaataggacgaacctcgcaattattgcgtcgatctcgttcgacgcccccctccttccgcgcattgcggagggcgtcgcgctgctctcggcattgtggacgcgcggcctctcggcctacgtcgcttggcagagtctcacctcggcacggtcgatcgagcaacgtccgcgcatcgatacagctcgtgcggcgtcgttcgccggctccgtcgctgagttttga

SEQ ID NO: 8933 - DNA, 96 bp, Methylobacterium sp.
ccgagcagggagctcttcaagagcttcatcgatatctccaaaagcttcgagacccacaagacgccagatcgccagctcagcgcttggtcgttttga

SEQ ID NO: 8934 - DNA, 144 bp, Methylobacterium sp.
gtgcgcgggcgcgccaacggtgcgctgacaccggaactggcgctgaaggtcggtcaggcggcgggtctggtcttccagcggggcgagcaccgccaccgggtcgtcatcggcaaggacacgcggctctccggctacatgatcgag

SEQ ID NO: 8935 - DNA, 189 bp, Methylobacterium sp.
gtgagcgcgccgccggtcacgccggacgggcgctacatcgtggtgcgcgggcggctgtggcggcgcgccgatccgggcctcgacgaggccgcgcgggcgcgggcggtgtcggcgctgatggaggcgcggcgggccgtgcgggccgccaaggcggcggagcgggcgggcgatccgggggcgggcgaggcc

SEQ ID NO: 8936 - DNA, 336 bp, Methylobacterium sp.
atgatctctgagccatccagccgagtgctcggggcacagagcatcaagcggaacgctgccgctcacctccggttggtcctccatcgatccgaggaggcgatcatgaaggccctactagcatcctcgctgctcacagttggtctgctcgccactgacccagcgtccggccagcgtcttgagatcggccccgatggcccctcggtcgacatgcgctcacgcggtcagcgggagcgggacatcgaacggcgggagatgcgccgtgacatgcgacgggacgaggtgccgcgcgatcggcgggacagatctgtcgatcccgacgacgatgatgaggactag

SEQ ID NO: 8937 - DNA, 249 bp, Methylobacterium sp.
cgccccgccggcaccgccctgccccgctcggtcgagcagatgaccgagctcgtcggccgcgtctcgatgaagaccctggtgcgcgagaccaccgacctgatcgagaagctctgcatcgaggccgctctgcgcatcacccgcgacaaccgcgcctcggccgccgagatgctcggcctcagccgccagggcctctacgccaagatgcgccgctacggcatcggcgacctcgacgggccggacgaggcctga

SEQ ID NO: 8938 - DNA, 795 bp, Methylobacterium sp.
atgtttgctgacgcgatccgccgacaggcggaggacgcgccgcgcgccgcgctgccggccgtggccgctgcgctatggcgtgcgctcgccaacgggcaggtgagcgaggccgaggccgagacgctgtccgcgctgatcgacgcgaggcgggaggccagcggcccacaacgccacccgaccagcccgaccagttcgagcgacggggccgcggacgtacgaggtgataccctctcaggttctacaggatgcgccaggacgggcgttggcagtcggccgcgcaccgatgccagtctggagcgccgccgccgctgggcggcctccggtaggcttcccccggccattgctgcgcggtttacggctggggagcaggcggtgctcgctctggtggcagccgagactgcccgccggaaggactgccgccttgcgatcgagcacatggcggcgattgccggcgtcggccgatcgaccgtgaagaacgccctgcgggaggcccggcggctcggcctcatcaccgtggaggaacggaaggtcacgggctggcgcaacgacacgaacatcgtccgcatcgtctcggccgagtggacggcttggctgcggctgacgcggcgctcgcccaccccggggagcgagacaccctcctctgcggaggggggaggggtcaaaaccgcgaccggcacgcctactcaggttcaaatccggggaaaaccgaggccagcggaaccgtccaagatgctgccggcaggcagcgggcgacctctgccgatgcggcctcgtgagaattctcgcgggcggtaa

SEQ ID NO: 8939 - DNA, 1659 bp, Methylobacterium sp.
atgtctctggcggcctcgccgatctcctccgcgccgtcgatggaagaacccgaggcattccatcgcggggttgagctgttcggcgactggcgctggcggctcaacaacctgtactggatcaccaacaaggaagggcggcgcgtccagtttcagatgaactgggcgcaggaagcgctcttccgggagatgcactacctcaacgtgatcctaaaggctcggcagctcgggttcacgacgttcattgccctgttcgggctcgaccagtgcctcttcaatgcggactttcgggccggcttcatcgccgacacgttggagaacgcgaaggccctgttcgcggacaagatccggttcccctacgagaacctgccggacgggctgcgggccgcgcggccagtgcggaaggcctccgagacgcaggtcctcttcgacaacaacagcggcgtgcgcgtgggcgtgtcgctgcgcggcggcacgatgaacctgctccacgtgtcggagtacgggaagatctgcgcgaagtcggcgcccaaggcccgagagatccggaccggcgcgctgaacacgctgcaggccggtcaggtcgccttcatcgaatccacggccgagggtcaggaagggcacttcttcgacctgaccgaggccgcgcaggcgaccgcgcgcgccgggcggcccctctcgctcctcgactggaagttccacttcgcgccctggtggaaggagccggcctacgtcctcgacccgaccggcgtgccgatcgcggacgggtaccggcgctacttcgccaagctggaggccgagcagggaatcgtcctctcgcccgctcagcaggcttggtacgcgaagaaggccgaggtccagctcggcgacatgaagcgggagtacccgtcgaccccggcggaggcgttcgaggccgcggtcgaaggcgcctactacggcgagtggatggccaaggccgagctggacggtcggatcgggacgttcccggccgagcccggcttcctcgtgcacacggcctgggacatcgggcgctcggattacaccgcgatctggttctttcagatcatcggtggtcgcctccgcatcgtcgggtactaccagaacacgggcgagggcctgcccttctacgcggcgaagctcgaggagatggccgccgagcggggttggacctacggcgaccacttctggccgcacgatggtcgggtcacggaatggggctcggggcgctcgcggatcgagcaggccctgacagaccacaagctcaagatccggatcgcgacggcgctcagcctgcacgacggcatcaacgccgtgcggaccacgctgccgctgtgcaccttcgacgctggaccgaccgccgagggcgcgaaggtcttgaaatcctaccgcaaggagtgggacgacgagcacggcatctggaaggaccggccctgccacgactgggccagccacggtgccgacgccttccgctacctcgccgggtcctggcgcgcggtcaccgagaccgtcgcacccgagacccgcaccatccacacaccccgcggcgcgatcgtgcgcccggcccttgagcccgtgaagagcctgaccggcgcgacgcccggcaacggctattcgatgaacgagctctgggagatggaccagcccgccgacacgagggtctga

SEQ ID NO: 8940 - DNA, 297 bp, Methylobacterium sp.
atgaagggacgggcccgcctcgcgtggaatgttcggcagatccgcgccgcgcgcggcctgtcgcaggagacgctcgccgtcgatgccggcgtcgccgcgccctacctgagcggcatcgagcgcggcactgtgaaccccacggtcgacgtgctggaccgtctggccacggcgcttggcgtggagatcgacaccctgctgcgcgcctatgacaccgccagcacccccccccagcccttgcgggccggccgcaagccgcgacagggccgtgaggggcccgcgaccaaggcaggcgcctga

SEQ ID NO: 8941 - DNA, 195 bp, Methylobacterium sp.
atggaagcgcgatcagtgcagctgatcgcgctccagacctgggccaaaggcatgtcgccgaacaaggccgcccggcagctcggcacaaccacggcgcgtgtgcaggaactacggggcgggcggttcaacaggttcacccttggcgagctgcaggacctgaccagccgtgcaggcttggcctatcaggcgccctga

SEQ ID NO: 8942 - DNA, 1152 bp, Methylobacterium sp.
atgattgaggcattgggttcgaacgctttgacttggccgtccgtcaggccgaccgaagtcagtgtctggcacgggcacgtcgcgttcgcgcactggctcgtcgaggcgctcaggccgaggctcgtcgtggagctcgggacccataacggggtgtcctatttcgcgttctgcaacgcgatcaagaggctcggccttgatgcgcgcgccgtcgcggtcgatacctgggagggcgaccatcaggccggtctgtacgacgagtcggtttacgagcgggtccgccggttcaacggccagttctcggatttctcgacgctgaagcggaactacttcgatgacgtcgtcgaaagcttcgaggatggttcaatcgatctcctgcatatagacgggctgcacacctacgaggccgtcaggcacgattacgagacctggagggccaaactcagcccacgcgccgtcgtgctgttccacgacacgcgggccttcatcgaggggtacggcgtccacaccttctgggacgagctgatgcgcgaggggaagggcttcaacttccaccattcggcgggcttgggcgttctagtccacgggacggacgtaccggaggccgtcgaggcgctgtgctccgtccccgatcagtccgccgaggcgacgcggatacggcagtccttcgaagtgttctcccggatcgctcagacgctcggccaggaggcggtcgtgcacgcgctcgcgcaccagggcgagaacatcgctctgcactgtcgcgccagccagagcagctactactcgacgaacgcggagacgccgcagggcgccgtaaacgggatcaggaccgggcatttcgggtttcataccgacaacgaggatcggccctggtggcgcctggacctgggtgggcggcggaccttcgacgagatccgcatcttcaatcgtctcgacccggactgcgcggtccggagccggaccatcgagatctcgatctccgacgacggcctgatctgggacacggtgtattcccatgacggatcggtcttcggcgggatcgacggtcaccctctatcgttcgtgcgcgggggcatggaggcgcgctacatcctgctgcgcttgcgcgaaacgaacttcttccatctcgacgaggtcgaggtttacaggcactga

SEQ ID NO: 8943 - DNA, 3804 bp, Methylobacterium sp.
atgttcgagatcaccggcgctgatatcggtgcgctgagcgacggggacctccgcacgctgattattctgctctgcgaggcggacctacgacgccgaggcctgtcgactgcggcggttaccgcgggcgggaatcaagatgcggcggatggcggtgtcgatgtccgcgttgcgcttccgccaggaacgtcgaccgagaccttagactacgttcctcggcctgccaccgtcttccagtccaaggcgtcggacatgccgcggaaggcgatccttaaggagatgcggcccggcgacacgctgcgcccggccatcgttgcgctggccgaggaaggcggcgcctacatcatggtaagcccaggcgccgacctgacggacacgatgctcacgagccgcaagtcagcgatgaaggaggcgctacgcggcctccccaccgccgctgcccttactctcgacttctacgaccggacgcgcatcgcaacttgggtccgagatcacccgggccttattccctgggttcgtgagcggatcggtagggcgctgcggggctggcggtcgttcgggcgatggtcgtcacgccccgcggacgctgacgctggttaccttatcgacgacgcggtccgcatcaggatgcccggcgaggacgagggcgatggcctcggcgcagctgacggcattgaccggatccgcgccgagctacgtgagcccggcaaggctgtgcgcctcgtcggtctatcgggcgttggtaagacgcggcttgcggaggccctgtttgaccctgctgtgggccacaatagcctggatccatcgctggcgatttacgccgacaccgccgacgagccggctccttcaccgggcggtctcgcgagcgatctaatcgcggggcggacccgcgctatcctggtggtcgacaactgcccgccggagacgcaccgacggcttaccgagatcgtcaccgcgcctggcggcacggtcagcctgctcacgatcgagtacgacattcaggacggcgagcccgaagagacggcggtgttcgaactcaccacgtcctcgctagcggtgatcgaacagttggtcgctcggcgctatccgaccctatccgaggtcgacacccgcaacatcgcagagttttccggtggcaacgcgcgcatcgcgctagctttggcaagccgcgacccccggcgcggctcattcgctggtctcgacgacaaactgctgttcgagcggctgttctggcagcgcaacgacccagatacttccctactgacaatcgcccaggtctgcgcgctgctctactcgttcgatggcgagacactggagggcgacgccgctgaactgccgatcctaagcggcctgagcggtcgaacggtcgatgcggtgtatgctgccgcagctgaacttaagcggcggcaactcctgcaagcgcgcacgcgttggcgcgcggtgctgccgcacgccgttgccaatcgcctcgcggcaatcgcgctccaggacatcccccgccaacggctcgcggcagcgctggtagagggcgcccctgaccgtgtcctacgctccttctcccgacgtctcagctacctcgacgccagcccagaagctcgggagatcgttcaagcttggctcgtgccgggcggcctccttgccgacatccggcatctgaatgaccttgggatcacggtgctgacgaatgttgccccagttgcgccgaaggcggtgctgtctgccctggaggtcgcgatgcacggggcggacgatcttgcgctccgcgactttacccctctcgctcggctaatgcgcgcgctggcctacgagccagcgcagttcgagcgtgccgttgcgctcctcgtcaggctggctcggttgccaaaggaaaaccgtttgcacggcgacgccgctgaaatcttggagtcactcttcccgatccggctgtcgggcacgcttgcccctattgacctgcggctggctgtcgtcagtcagctactgcgctccgcggacggggccgagcagcgcgttggcgtccagctactgggggccgtcttgcgaacggacgggttctcgtcgtggcacggttttgagttcggggcgcgctcccgcggctacggtctctacccgcgcaacggtcaggaggtgcgggattggtacgccgccgtgctcgaatgcgccgaaccatttctgacggcggaaggcgcagtggctgatggcgtacgaagcgcggttgcgcaggcgttccgcggcctatggctacgggggggccaggctgccgcgctgacgcggcttgctcacgctgtgatcggcgcacgcgggctatggcgcgatggttggggagcggtgcgtcagacgcgcatctatggcggtgagcagcttactccagacggtctggcggaactcggtgccctcgaggatgtgctccgcccacagacggttgccgacaaggtccgcagcgttgtcttgcaagggggccgaagcctcgatctcgacgacgttgacgaccccaaggaagacttcgctctcgcgatggatcgccaagcagccaccatcgcacgcctcgcgcgagaagtgattgccgacgaggctatttggcgagcgctgctccccgatgtggcggcaggcgatggctacaaggtcgtactcttcggcgatggcttggcgacggcagccgaggcaccgcgtgccgtatgggctgccctggtcgagcaaacggccgctctaccagtgcccgggatctccgttctatgcgggttcctgcagggcatcgagcgccgagaccgcgcgctcgcctgcgcgcttctcgatgaggtgctcgaagatccgatccttgccccatggctgccggtccttcaggcgggcaccacgcccgatgaagcggcactggcccggctgcaccgcgtactggcaagcggcgtggcgccaatcggacggttctcgcgcctcgcgcatggcgatgcttcgagcgccataccaggcgctgaactggcgcgcctcctacttcgaattgccgaatcccagggaggtggcacggtcgcacgggacattctccacatgcgcatctacgcagaccgaggcgcggggcgggcaattgacccggacctcgtcgaggctggccgcacactcctcttgggcttccggttcgcgaaaggacccggctcgcgagaagattacgaattggcctcgatagcccgcgtgtcgctagcaggagaaggggggcggccggctatccaggagctaggccgagcactcgcgctcgcgatgagccgatacgaggttggcctctacgattacaaccatctcatccacgcactctttgaggctcacccgaccgagatgctcgacgcgctcttcgcgggagatggttcatcgccccggcggatcgtcaacctactgactgagctcccccactcgggtaagcccccgatgggcgcggtgtcggacgacctcttgctcgcatggtgcgagtgcgcgcccgcggaacggtacccccttgccgcaagcttcgcgatgctatttgcgcaatccgacgaagggacatcaccgcaatggaccagcttagcggggtgcctgctggcacaagcccccgaccccgtgtcggtcttcgaggccatcatcggccgactccacccaatgagttggagcgggtcattggcggaagtgctctcgtcccgccaagatcttctcgaccggctcgacatcgctggcctgccaacgttggcagagccaatgggccgggcacgggaggcgctgagggtcatggtggaccgcgagcgccagcgtgagcgggatgaagatcgggagcgcgatggccggttcgagtga

SEQ ID NO: 8944 - DNA, 597 bp, Methylobacterium sp.
gtgctgatgaagctggtgagcgagcagtccgacgccgacatcgccaagcgtcgggccttggagcagctcgcccagcacctacgggccctggccgccaacctgatgcggacctcgcgcggtgccggcgcgccctaccacctcgaagagcagatggtcggctgcctcgaggcgctggcggctcaccgcgcggcggttgggcacggtgtgtccacctatgagtaccaagccatgctggatccccacgaggcgcaggccgaggctaggccgtgggctggcggcacggaggaggatcaggcgcgctgggaggcggacggaacggtggcctgcgctgacgccatcgacgacatccgccgtgccagcctgcagatgacggcgtccatgctcgtcgaccagctgacgcagatgcgccgcggcgagagcgacatctacgaaggtgtcagacgcctggaggcggctcgggagaagcggcgggcctatcatcagccaaggctcagccagctcgcaagccgcgggtgcggccaaacggtcgctgaagtggttgcttggcgacgtcctcgcagatgtcggctgactatctttgtgcccaccgaggtatga

SEQ ID NO: 8945 - DNA, 453 bp, Methylobacterium sp.
atggcgacggcgctcaacgacatacttttgggcgtcatagcgacgatccgtcggcggaccctcgcggccttcgggggcctgcccaacggatggtggcgggcacatcagcggcccgccacctcgggatctctatcgtcagaggtaggtgtcgagggtgtcctccacatcgacggtgaggacgcccaagcccagcgcatgggccacttcgcgaaacagcttcatcggtctacctggatcgggttgtcggggatcgagcgctgggcgctccttctgaccgattacggtccgcagcccggtctgttccttcgccccttcatcacactccatggccttggcacatggaacacgttcatgggcggctcttggctgcgcctcatgatgacggccagggcggaccgctcccgcgacactgccagcgcctcctggcaccgtcgtgtccagaggtgggcatga

SEQ ID NO: 8946 - DNA, 129 bp, Methylobacterium sp.
atgaagacctgcgcgattccctgctctgccggctacctctggatggcggggctggccagcttcatcctggcggtggccgtcatcgcggtgctgcgggagatcgagcaccgccgcgggccaccgggatga

SEQ ID NO: 8947 - DNA, 390 bp, Methylobacterium sp.
atgaagccgatgccttggaagaatgggggcaagaccctcacgctcgacgctgacccgtcgtccgaggaggagatgcagatcttcacctcaccggaggagcgcatgcagcaacgcgccctcaaccacgatcgggctctccgcgcttcagaactaggctggctcggcaagctcatcggcagtgagactaattcggcgcggaacctcgcggccttctttctcacgttttcgctgctgatcggcgtaggctgcctgatcgccgcatggtggcagaaagagcagggcgagttctggagccggagcgcggagcgatcattcagcgcagcagcggcggccctggcctacgtctttggacagggctccaagggatcgtctagccaagggccgccttga

SEQ ID NO: 8948 - DNA, 507 bp, Methylobacterium sp.
atgcagttccacagcacactctccctgcccgcgatccgcgcggcgcaactccgccacgtagcgaacgaaaagaacgccacgtccgcagatatcattgacagcttcatccgcgccgcctggacggatgttggcggcggtgtagtgttgccgggcttcgacttcgtcgcgtgcctcgatgacgacagcggcgaaccagtcgtgaccttcgtctgtacgggctctctgccggttctcctcaagcccgagcaggcacatggagtcgccaacgggatccgggacttgctggccgctgttgcggctcggttcgaggtcgatgcgatctgcgaagggtcccgggcgcgcttcatcggcactaggaaggggcggggcttcacaatccagcttctcgacgatctggacgatccgggtcggaagcccgtgacgctgctcggcctcaccgccagcatcgcggccgacctcgccgacacattcgagaccttcgccaagcgcgcggaggcgctccggtga

SEQ ID NO: 8949 - DNA, 945 bp, Methylobacterium sp.
atgatcacgcccacgaccttggccctggcggccctcatgcgcttgcggggagtgggccggaagcaggcccttcgcatggtcccgggggagttccccgcaggcgtggacgtcgaagccaaggtccacgacctggtcgccggagcgggtcgtgcaggcgacgtcggggagattgtctcgtcggcccggacgatgctcgccgacagcgtggatgcgggcatcaatgtcctcgggttccacgatggggaatatccggtccggctgagggacacccccgatccgccggccatcctgtacgtgaagggcaacgtctcgcccttgcacgcccctcgtgcggtcgcggtcgtcgggacgcgtgaacccaccgagtacggtggcaaggtcgcaaggaagctcgccctgagggtcgctgaggccggctacgtcgtcgtcagcggcttggcccatggatgcgacaccctcggccatgagggatgcctcgatgccggcggggtcgggatagcggtcatggcccatgggctcgacaaggtctatccggccgccaaccgcggcttggcgcagcgccttgtcgagaacggtggctgcctggtgtccgagtacccgctgggtgtcacgccgatgcgcaacgcgttcgcggagcgcgaccgcatccagagcggcctgagcgacgcggtgcttgtcatcgagaccgacgtgaagggcggcacgatgcacacggtgcggttcgcccgcgagcagcaccgacccctcgcatgcatcgaccacccgcagaagtggctggaagaggacaagacgagggggaaccagaagatgatcaaggacgggtgggcgacggccatcccgcacggggaggcgctcctggcgttcctcgcgggtgtcccgcatggggcgggccgccccggagacgtggcgtcgtcgccggaccgtcagcatgtgctggggttctga

SEQ ID NO: 8950 - DNA, 519 bp, Methylobacterium sp.
atggtgatcttcgacttcgaccagacgctggtcgacacgagccctgtcgagaacctgcgggctaaccgggactggcgtggcgtgatgagccgggcgtcgagccttcaggtgtacgatggcatgacgtctctgcttcgcgacctgcgcgcggccggagagaccgtcgccatcgtcaccaagagcccggacatggtggccaaggccttcatccgggagcatgcctggcccatcgacatcgtcgtcggcttccatcaggtgaagcgtcgcaagcccgatcccgaagggctcctgctcgccgtgaggcaggctggcgcatccgcagccgatagttgccatgtcggtgacagaccggaggatacggaggcagcccatgccgccgggatgccggccatcggcgcggcctgggggctagacgatgcggcggcgctccgtgcgtccggccccgaccatctcttcgagaccgtcgcggacctccggacgttccttttccgccggcgtcgacaggacacggcgcgatag

SEQ ID NO: 8951 - DNA, 1476 bp, Methylobacterium sp.
atgctggcttgggtcagggaggttgtgatcagcggcgcgaccgattaccggcgctatcaggccgacgcgatgaagacccggtacgccttgcgcttcaccggcctttcggtccgtcgatccaagggcggcctggtcctgctcaatgcggctaggcacagccgtcttgcggatgccccggcacgtctgcgcgacgagatgggcgagttgcttcggttcaagaccgcgacgttggccgagcgcgggctgaagcgcagcgggacctggaacgcggagaccgctgcacagaaggtcgagcacttcgctctgatgttcggcgccctcgccgccgatccggacggcgaggtcgagggcttcggcacggaccccggcgccctgacgctggcgctgctagccatccctgccgtgtgggactggtacctgtcctggcgggagcgccgacgcggcttcttcaccaagtgggaggccaacatgctgagcatcgcgctctcgttggtccgggccgagacgggctggctgcgccagacgccgggcatcgccgggcatctcatccccattccagggctggtatcgacggcggacgtggctgcggcccgggcggactgggacgcaacctgcgaggcgatgtaccggcacggtcgtgcccgcatccgggagatcgagcgtgtcgcccgcgtgcaccgcgaccccttcgagccgatcctggccatccttgaggccgacagtccggtcggcgagtaccggaagatcaccgacgagatccttcggctcatgccgaacgagaacctctatcctcgggccgcagccgaggccattcgggggttcctgatgctgcgcttcggcctccatctcgggctgcggcagcggaacctgcgagagctcctcctctgcccgcgcggccggatgcccaccccggagcgaaggcttgaggagctgcggcgcggcgagatccgctgggccccgcgcgaaggcggctgggaggtgctgatcccgtccgtggcgttcaagaacgccaactcgtccttcttcggccgaaagccgttccgcctcgtcctgcccgacctgggcggtctctatgagaagatcgaagcgtgggtcgggcgccaccgcgccgtgctccttggaccggcgcaggatcccgacaccttcttcgtcaagacggtgaagcgcaccagcgccagcgccgcatacgaccagaacactttctacgaggcctggcgcctgaccatccagcgctacggcatccgcaacccgtacaccggccgaggcgccatagaggggctgctgccgcacggcccgcacaacatccgcgacgtgctcgcgacccacatcctgaaacggaccggctcctacgagcaggcgagctacgccatccaagatacgcccgagatggtgatgcagcactacgggcgcttccttccgcaggacaaggctgccatcgcggcgcggatcctgaaccaggtctgggaggcggcgtaa

SEQ ID NO: 8952 - DNA, 504 bp, Methylobacterium sp.
atgcccgaagacgcaccctcgcggttgccggccgagacgcccccgggcggcgcccgcctctacgcctggatattcctggccttttccgtcgtcggcctcctgacgggaggcctcgaaaggctcgcgctcctgcccgacgccgccgcgaaggcttgccgcgcgttctacctgtgcggaccccgcccgctgaacacgctcccgccgttcgaggtggtccacggctccgggtccacatgggaacaggtcgagaaggacgatgtcccgccggtacagaggcgacttgaggccgagaatcccgatttcaacatcgtctggcatcgcggcgaggagaccggcggctgcagcggggcattcaacaccacttgccgataccactaccatggccggtggggggcggtaccgaagtgggagacagcatcgaagctgccgtggatcgtcctgggctgcgtgttcctcgtttccctcgccgtcattcttcgtcgccgcggcacgcgcaccgcatga

SEQ ID NO: 8953 - DNA, 912 bp, Methylobacterium sp.
atgctcgaacggtttcagggggaacggggccggaagcatctcgtgggggagatggagcgacaaaggcttgtcactgggacgcctggcctcgctgaggctttagtggacgttggggaactcgcacgcgtcgcgcccgggacctcgatcatcgagcagggaggtaccgacaacgacctattcttcatcgtggtcggggacttcgaggtcgtggtgaacgatcaccgcgtcaacatgcgcggcccgggcgaccaagtcggcgagatggccgctgtggccccgtcgcaggcccgagcggcgactgtgacggcgacgacggaggccatcgtcctgaaggtggacgaggccggcttctcctccgtcgccgaccggtaccccgaggtctggcgacgcatggcgcaggagctggcgcgacgcctcgaacaacggaacgcgctgatccgacctgccaacgagaagccgcgcgtcttcctgttctcgtcctcggaagcccttccggtggcgcgggctatcgaaaatgcgctcgcggacgacccgttcctgaccgtcgtatgggcgaacggcgtgttcaaggtgacgaactacacgcttgagacgttggaagaggagttgatgcaatccgatttcgcggtggcggtggcccaccccgacgacaagaccgaggtcagggacgaggagtggccgacgccacgggacaacgtcgtgttcgagctgggcttcttcatggggagcctgggacgtcagcgtgccgtcctgatggagccgaagggggcgaagctgaagctgccgagtgacttggcgggcattacgacgatcaagtacaacttccagccgggtgccgatgtcggggccatgatggggccggcctgcaataagttgcgcgcccacatcctgcgcctcgggcgaaacgtctga

SEQ ID NO: 8954 - DNA, 408 bp, Methylobacterium sp.
atgggcggcctagacgtgtatctcgacgtcatcgacgtccagttggctaagagcggccccgatttagccgattatatccggatgcgcctcgacgaatgctcgcagttgctcgcggtgctcagccctatcacccgggcgtcttggtgggtgccatgggaaatcggggttgccacagagaaggaacgcttcctggcctcattcgtgtcggacggcgcgaccgtaccggaatttctccaaaaatggccctacctacagagcatgtccgacctagataagtatattgcagagtctaagagcgcgcagcttctcgtcgaaaactaccggagacaggggtatggaagcacagcgcagtcgcgcggttttaggtctttccataactcgctaaaatcgtcgcttggccagcgataa

SEQ ID NO: 8955 - DNA, 465 bp, Methylobacterium sp.
atgtccatgcctgcccaattcatctcggcgctcgaagctgacagggagccgaacgcgagaacggccgcaaccctacgcaagatcctcgcgtccaatggcgtcgagggcgcgctgatgctcgacgaccgggcaggcacgcccgttcgcttgcccctgacggcctcagcggtcgaggccgtcgtggcggtcttgctgcgcctaggagcgaacgcggatgtcgtcgtcgcgcaacgggaacgtgaggtttccccggaggaagcatctcgtctgctcggagtctccagaccgttggtctaccatcgcatggacaccggccgactacgtttcaggcaggtcggctcgcatcggcgcatcgccatggacgatgtcctggcgctgaaggcggaggaagatgagctccgggaggcggccagggccttcggcgaggatacggacgagcaggagatgattctccgtggtccttaa

SEQ ID NO: 8956 - DNA, 630 bp, Methylobacterium sp.
gtggtccttaaggttttgttggacgccaatgtcctgctgcctcaacagcagcgcaacatcatcctacagatcgcactgaaacaccgcatcgagctccattggaccaagcttatcgtggaggagtggctccgcaacgttgagcccgccgtgcgcggtaattgtgagcggcggaccttgccgctcatggccaagtatttcccgcgagcggaactaccggccatgcccgcgacaccctatggatcgaccgatgccaaggaccggcacgttgcggcggcggccgtccacgtcgcgccttcggtcctcgtgacctggaatatcagggatttcgaccgcagtgctctcgcggggcacggcgtcacgcttcagaccccggaccaactcatttccaacctgtacgaccagtttcccgacctcacgtacgaagcggcgctcgaagctaaggcgaacttgtcgagatcagcgccatcttgggacgatttcatcgccttgctcgcgggcaatggcctgacaaccttcgttcagcgcatcgatgagcatcacaagcgcctctcgtacgagtgcgaggacgaagaacgctcggaggaagaagaggaccggacggactacacgggctccagcggccccccttga

SEQ ID NO: 8957 - DNA, 615 bp, Methylobacterium sp.
gtgaagtaccagccgcccggcaccgacatcctgctcaccgcggcggccttcgacatcaagcgcctgaacggcctcacgcccgacccggtcaacggctcgcgcttctccgtgcagaccggcgaggtcagcgcccagggcctggagttcgaggcgcgggccaacgtcaccgagaacctgaccctcgtcggcggcgtctcgctgatcgatgccgtcaataccgggaccgggaccacgcccaacgagacgacgggccggaccgtgccgctcgccggcctccgcccggtccaggtgcccgacacctcggtctcgctgttcgcgaactaccgcttcctcggcgggccgctcgccggcctcgggatcggcggcggcgtgcgctatctcggcgcctcgcagggcgacgcggccaacagcttccaggtgccggccaacaccgtgatcgacgcgctcgcgtcttacgatttcggctatctcgacgcctcgctgaagggcatgcagcttcagatcaacgcccagaacatcctcgacgagaagtacgtgcagagctgcatctaccaggcgtggtgcttctacggcgcgccccgcacggtcttcgccaccctgcgctaccgctggtaa

SEQ ID NO: 8958 - DNA, 195 bp, Methylobacterium sp.
atggcggataccggcgagacccgcgcggagcggttgaaatcagcgctgcgcgacaacctgcggcgtcggaaggcgcaggagcgcggcaaggagcaggggcggaagccgggcgaggccgatccgccgacccaggatgattcgccgggcgccgatgcgtccgggaccggtcccgattccgacaaaactggactatag

SEQ ID NO: 8959 - DNA, 384 bp, Methylobacterium sp.
gtggagacggatcaggcggccggcgaggccggagggcgggcgcccttgcggacgcccctggaccggggggcggtcggagccctcccgtcgcttccgcaggcggaactccacccaggtcgagaagtcggccagctcccggccgtcggcgtcctcgatgacctcaagcaccaccgcggcctcgtcccgggcgatgccgagccagtggccgatcagggcgcgggccgagcgatgcgaccggcccgtattggcgacgatcagctcgacgccacgggtcagcagctcgtggcggaaggcccgggcctgctcgcccgccccgccggcctgcccggcatcgccggccgacccgtcagggttggaaccggggtctggggaggggttaagggg

SEQ ID NO: 8960 - DNA, 720 bp, Methylobacterium sp.
gtgtccctgaccgacaagcagcgccgcttcgtcgacgaatacctcgtcgacctgaacgccacgcaggccgccatccgggccggctacagcgaggacacggcgcggcagatcggctcggagaacctgtcgaaacctgacatcgcggacgcgatcgccgaggccatggccgagcgctcgaagcgggtccagatcaccgccgacgaggtcctgcgcgagttggtcgaggtcgcgctgggcgacgtgaacgagctggtcgagcaccgcgtcgggtgctgccggttctgctggggcgagggcttccggtaccagcgcacgcgccaggagctgatccgcgccgaggccacgcacgccaaggacaacgagaaggccgttcgcgagggtcgcgagaccacgctattcgatgtcgagggcggtgacggattccatgccgcgcgcgagccgaacccggactgccctgagtgcttcggcgagggccgcggccgtgcccttttcaaggacaccggccgggccagcccgcgcgcgcggcggctctacagcggcgtgaagctgaccaaggacggcatggagatgaagctgcggtcgcaggacaaggcgatcgagctcatcggccggcacctgggcatgtggaaggacaaggtcgagcacgatgtctctggcggcctcgccgatctcctccgcgccgtcgatggaagaacccgaggcattccatcgcggggttga

SEQ ID NO: 8961 - DNA, 2307 bp, Methylobacterium sp.
atgagcgacacccaaggcctggacggcgagcgcgacgaggccccgcagagcgggcccgacgaggtcgtgcggttctggctcgaccagatcgagcgctacgagaaggcgttcggcgactggaccatccgcgtcgagaagatctggaagatctacaccgaggcgcgccgagcggagggcagctcgcgctcgcggaagctctccctgctctggtcgaacgtctcgacgctgcagcccgcggtctacgcgcgcctgcccgcgccggccgtgtcgcgccgcttcaaggattcggacccggtggcgcgcgtcgcctccgagctgatggagcgggcgctgatctacaccttcgaggacagcgacctcgacagcaccctcgccctggtgcgcgacgacttcctgctcggctcccgcggcacggtgtgggtgcgctacgaggccgacttcgagccgatcctggacgagatgggccagcccgtgatgcaggatgcagcggagggcgaggagcctcagccggccgagcgcatcgccgacgagcgcgtgccgatcgactacgtacactggaaggacttcggccacactccgggccggtactggcaggaggtcacggctgtctggcgcaagacatacctgacccgcacgcaacttgtgcgtcggttcggcgaggagaaggcccggaaggtcggcctcgaccagtgccgcaacacctcgggccagtacctcgacatgggcgcccgcaaggccacggtctatgagatctgggaccgcgacacgggcaaggtctacttcatcgcgaaggcctgcccggagccgctggaggtgaccgagccgttcctgaagctgaagggcttctggccctgcccgaagccggtctacggcacgctgcacgacgagagcttggtgccggcgccggactacgtgttctgccaggacatcgtcgaggaaattgaccagctcaccggccgtatcgggaagctgaccgacgccctgaagctcgtcggcttctacccgaagggcgatgacagctcgggcgcgctccagatcgagaaggcgctgcaggccggcgtcgagaacaagatgatcgcgattcccggctgggctgcgttcaccgagaagggtggctcgaaccaaatccagtacctgcccgtcgagcaggtgctgaaggtgctccaggggtgcatccagcttcggaaggagctgaagtccgacctctacgagatcaccggcatctcggacatcgtgcggggcgagagcgacccgaacgagacggccaaggcgcagcagatcaagacgcagtggggttcgatccggatccgcgagcgccagaagctcctcgccaagttcatccgggacgtggcccgcatcgcggctgagatcatcgctgaccgcttccagcccgagaccttgatggcgatggcgaacctgccgctgccgagcgatgccgaggtccaagcccacatgcaggctcaggccgaggcggccgccatgcagcagcagatcgcggccgcgcgcccgcagcccgtgccgatgatgccggggatgggcgggccagctccgatgatgccgccgcccggccctggcccgattccgagcggtcagggcgccatgatggggcccgagggtccgaaggcgatcggcgggggcggcacgaccgtcaacgtcgacacgaagggcgcgggcaaattcaccgaggtcgccaacgcgaagcaggccgagcgctacgcgaagatgatggatgcggccgacgaggcggtctcgatccgtggcgacatcgacacgctggccgatctcggctcgaagatcgccacgggccgcctgacggaagcgaagctcggcatcgcgcagtacgccaaggcgctcggcgccgacgatctcgcgaacggcctgaccggcggcaagatgagcgagatggaggcctatcaggcgatcgcggacaagctggcgccgcggatgcgcgtgccaggctctggcgctacctcggactacgagatgcgcgtcttccggaactcgctcccctcgctgctgaagacgccgggcggcaacgcgatcgccgtggacaccttccggtcgctctacgactatcaggccgccgtcggcgatatcgccggccaggcgctgcgcggggagatcccgcagaaggatgcggacgcccagatccgggcgctggagagccccttcctccggttcaaggaataccggaaggaggccgtgcggggcgaggcgtcgccgccgccgcccgcatcttcggccccgccgccggcttccggccagaaggtccgccgctacaatcctgccaccgggactctggagtaa

SEQ ID NO: 8962 - DNA, 1932 bp, Methylobacterium sp.
atgccccgccttccctccggagagtacgcaccgccggccggtaccgccgcgacgccgggcgccttcatcaccgccgagcagcacaacaccttcgtcaccgacatcggtgcggagatgaccggctcggcccgcgagagcgagatgcgggacctgggcgcgctagttaccacgaccggcacgggcgcggcctacgcgctcgcgctgagcacgccgtgggagattttgccggacgggatcacggtcggcttccgggttcacgtgtcgaacaccggcgcttgctcgctctcgatcaaggacgttgtcggcccgctgcgcgcggtgtccggtaccgacctcgccttcggcgatctgcccgcgcgctcggcgatccaggcgacgctcaaccgtcagggcgcgtccgcgatcttcgcgggcacgctgaccgcgaactcgaaccagatcacgggcgtgtcgagcacggccgggctctacgtcggccagaccgtgtccgccaacggcatcccgtccggcaccgtcgtgacggcgatctcgggcacgctggtctcgctctcgaaggcctacagcggcgcgacaggcccggcgctgatcaccgccgtggggccggaatggctgctggtgaacggcggcctgctggcgacggccaaccgcctcgcgatcgcgaacggccagcttccggtcacgctcaccgccgacgcgcagctcgacgcggcagccaagggcacggcgatcctcgcgagcggcaacctgcgggtgaagctgccggcgcctaccatcgcgggcgcgggctacttcttcgacctccgcaacgacggcatcggcgatgtgaccctgtcgacgcagtcggtggacttcaccggctcggtggcgagcggcaacgcgcagatcttcaacgtctccagcaccaccggcctcgccgtcggcatgctgctgacgatgccgccggcgccgaagagcttcacgggcacgctcaccgcgaactcggccatcatcaccgccgtgaccgacgtatccggcctcgcagtcggtcagccggtctcgagcatcgtggcgggcttcccgagcggcgcggcgattgtcgccttcgacagcacgaccgtgaccatctcggcgcccttcgccggcaccacgacgaccaacgcctcgatcacggcgacggtggacggcatcctgcccggcaccacgatcaccgccatcagcggcaacaccatcagcctgtcgcaggcctatgtcggcgccaccttcgtgacggcctcgctctcggcctacagcacggcgatcgacgggctgcccttcttcgtgatgtacccgggcgagacccggcgcgtgatgtgcgacgggaacaccttccggtcgatcgtgacgacgccgttctatcgggaatggttcggctcgggccggttcatccggccgccgggttacgcccgcatcgggtaccatgccgtggcgcctgggggcggcggcggcttccagggcggcggcggtggcgagggcatctccgatacggtgccggcctcatccctgcccgcgtccatgctgctcaccatcggcgcggcgggcgcgccctcggcgaccaccggcagcgatggcggcgtgacgatcctggggacgctcgcgacgctggcgggcggcaagggaggcacggcatcgggcgcggccgcggcggtaggcgggggcactgcggacggcatcaacgcaggcggagccggtaccggcagcggtacgaacccgacctcaagcatcaacggcggcggcggcggcgcgaacaacgtggcgggtggcacggtccgcggcggctcgctcaacgcgggcgcaggcggccgattcccgaaccttgcgcccggccctggcggtggcggctacggctcggcaacgaacggcgtcgccggcagcgcgggcggccccggtcgcgtccggatctacggcatcgcctga

SEQ ID NO: 8963 - DNA, 273 bp, Methylobacterium sp.
gtgacggagccgcttgaggtccgacgccggctcgccgctgggtacctgacaggccgcacgctcgaggaagccctggccgcgtggcgatcggactacgacgcgccgacctaccgcgagcggcggccgcagctcgcccggctcggcaacgtgatccggaagctcgcggccgaggccgaggcgcagggcgacgctgatgccgaccaccccgggcagaggcccaaacgcaaaaaggcggcgccccggcctaagccagggcgccgcggggacgtgtga

SEQ ID NO: 8964 - DNA, 756 bp, Methylobacterium sp.
ttggcgcggggcgccctcggggtgatcctgcctgtcctggcgcccgggcgtgccggactcgggccgcggcgtcggcctctgcggtgcctcggcctcgggtgcgcggcggccgggttctggggcctcccggcgctcgggcgcagtggagcgctccggcgcggtctgccgctccggctgccgctcgggcgcgcggtcgcgggccggcggcgtcgggcgctcggatgggtcgcggtccgggcgctgcggacgctcgggctgacgctcccgatcgggctgacgctgcgcgggagcgcgctcctcgcggggctcgggccgctcgcgggcggccggcggctgcggacgctcggcgggtgcggcgcgttcgggattgcggtcgggacgcggctcaggccgctcgcgctgggccggaggcgccgccctctccgcaggtgcccgctcgggcgcggcacgctcagggcgctcggacctgtcaggacgctcggagcgctcaggtcgttcgggacgctccggtcgttcggggcgcggcgctccgccgcgcgggccttccccaccgccgcgcggcccctctccgccgccgcgggggccccgctccatgtccggcccgccctgggcgaggagcaggggcgcgcccggatcgtccggacgtgcggagacgggcgtggcgaggaggccgggcagcacggttccggcgaggaggagcttccgcatcgatcggccttcgcggcgcgccggccacggagcggtgacggcgcgtga

SEQ ID NO: 8965 - DNA, 1218 bp, Methylobacterium sp.
atgttagcgcgcctctgcttcctcacgatggtcgtgacggcgctcgcgccggctgccgccgcgcagacgcgcgtgaccatcggggtgctgaacgacgcctcgggcgtctacgcggattccggaggaaccggctcggtggtggccgcccgcatggcggcggaggaccacatggcggcgcgccgaggcctcgacgtcggcgtcgtggcggccgaccaccagaacaagcccgacatcgccgcggccatcgcgcgccagtggtacgaccgcgacggggtcgacgcgatcttcgacctgccgccctcctccgcggcgctggcggtcaaccagatcacgcgcgacaagaacaaggtcttcgtcgcctccagcgccggcacggccgacctcaccggcatccactgcacgcccaacaccgtgcactggacctacgacaccgtcgcgctcgccaacggcacgggcggcgccctggtgaggcggggcggcgacacgtggttcttcatcacggccgactacaccttcggccacgtgctccagcacgacaccacggcggtcgtcgagaggaacggcggacgggtcctgggctcggtccgggcaccgttccccacggcggacttctcgtcgttcctgctccaggcccaggcttcgggggcgaaggtcgtcggtctggccaatgccgggcgcgatgcggccggcgcgatccggcaggcgggcgagttcggcatccggcagggtgggcaggcgctcgcggccctgctgatctccctggccgagatccacgcgctcggccccgccgtggcgcggggcctcgtgctgacggaggccttctactgggatctgaacgacgcgacgcgccgcttctcggaccgcttcgcggcgcgcttcggcggccggaagccgaccgcctaccaggccggcgtctacgcgagcgccctgcattacctgagggcggtcgaggcggtgggctccccgggggacggggccgcggtggtggaccggatgaaggcgatgccgaccgacgatccgctcttcggccgcggcgagatccgcccggacggccgcaagatccacgacatgtacctgttcgaggtgaaggcgcccgcggaggcgacgggcccgtgggacctctacaaggtgctcgccgtcattccggcgcaggcggccttccgtcccctcgatgccggcggctgcccgctggccggcctgtccgaggcccgccgctga

SEQ ID NO: 8966 - DNA, 585 bp, Methylobacterium sp.
gtgccagccttcgttgcccgcctgcacgccgccgaccgtggcgaggtaaccaaactcgccttcgagttcctcatcctaaccgcactgcgcaccagcgaggttctcggggcgcgctgggaggaaatcgacaccgtcgaagcggtgtggaccgttccggcggtgcggatgaaaaagaagcgggtgcatcgcgtaccgctaagtccgcgcgcgctcgccgttctcgaccgagccaaggtgctcgcgaacgacagcccctttgtcttcccgggccaaaagccgatgaagccgctgtcgaatatggccttcgatatgacgctccggcggatgcaggtgccggttacggcccacgggtttcggtcatcgtttcgcgattgggcggcagagcagaccagctacccgcacgaggtcgccgaaatggctatcgcgcatgtggtcaagaatcgagttgaggcggcttatcgacgtggtgacctgctggacaagcggcgcgggctgatggcggattgggcgtcattctgcgacggcagcgggccggcagacaagtcgaaggcgaacgatgccgcgagcaaccaagtcaacgggtag

SEQ ID NO: 8967 - DNA, 531 bp, Methylobacterium sp.
atgatggaggtctacgatttccacgcaaaaaatttgagctacccgaagcgttcctacgccgcgtcggacagtaagggttacgagctgattaggtggattcacggaagtcgccgcgggatcatcggtatcgatctcggcagaatggaaacagtttggaaggagcttggaagccacgcggcgctgatctacgccgcgtcaacgattgcagttagtgatcggatgacgctacttgatgtcatccgtggcggaactgcggatttcgataagcacgggcacttgctgaatagctggatggggcgagcgcgctactctgccgagacgatcctgagtaactcaacgaaaccggagctcgggcaagccaccctcacgcagctgcccacgcttccgagcgagcctacgcccgagccgcacttcgatcaggaggaacaagctcgcattaaagctgagttcgacatggtcgctattttggggaaccgccagcgggatcagcgacgggagaggctatcccggcgtggaccccgcagggtgtag

SEQ ID NO: 8968 - DNA, 216 bp, Methylobacterium sp.
gtgaccgatcacctcgacctgccgcagactgggttcgtgagcccggcttgggtcaagcggcgctacgcgatcagcaattccacgatgtatgcgtgggtcgccaacgcttacctgcccgcccccttgaaggtcggcccgcgtgccgtgcgcttccgtgcggaagacctgcgcgcgttcgaagctcagttcgccgcccgtgacgtgcaggtgatctga

SEQ ID NO: 8969 - DNA, 102 bp, Methylobacterium sp.
gcccacggcttcgagctcgtgcggaaaccctactccgctgaggaactcgcccgggttctgcgcgaggcggcccagcgagggcggaccgcggtcgagcgctag

SEQ ID NO: 8970 - DNA, 336 bp, Methylobacterium sp.
atgaacgggctgctgcgggatgttcagacgaactggttgcccagtgtccgtacggcgagccaggtcgatgcgctgaccgggcgctacacgacgagcgtgctgcgacacatcctgaccagcgagccgaagatgctcgcgaccatcgacaaggatctgggcgagcgcgcccgcaaactcaccgaagcgcgcgcggtgtacgagccgctcatcagctcgtccgacgagcgggccctctatgatgggttctccaagagctgggcggagttcacggccacggtcgaacccattctcgacctgtcgcgcagcggccggaaggccgaggccctggcgctgtaa

SEQ ID NO: 8971 - DNA, 210 bp, Methylobacterium sp.
gtgaacgaggcggcgccgagcgtggtgctgccgaccgcggcgcgacgggcgagcgtcccggcggagcggagcgcggcggacgcgcggacggacccgatcgcgccggcgagcgccaggacgggcgcggtgcggcccgcggcaacgacgatcgcggcgcggcgggcgcgcggaacgagcggggcgagcgcggtgcggcgcgcggtgccgtga

SEQ ID NO: 8972 - DNA, 672 bp, Methylobacterium sp.
atgatcgacggttatctccgcgagcattatggcctgactgttcaagatggtcccttccggggcatggcttacatcgccgaggccgctggatctctgttcggaccaaagatccttggctcctatgagcaagagctcgcccagattttcaaccagctgggtcgttacgaaacgttcgtggatgtcggctgtgcggaaggctacttcgcggttggtgcactcgtggccgcgcctcacctcaggaccgcggcgttcgacttggatcctcgcgcgcggcagctttgcgccgccctggccgaaatgaacaaggtcgcgggtcgcctacaagtcgcggagctgtgccgcccagaggatctcgttgcgttggcgggtcctaagacgctgatcatgatcgacattgaaggagccgagacgaacctcctgggcagtacgccagccgaagctctcagcgactgcgatgtggtggtcgagacgcactacacggcagccggctgcacattggagttcctgcactcctacttctctcgcacacacgacatcacgatcatcgaacagtccgcccgcgatcctgctgcattcccaccgctgatggcgctcggccaggtcgatcgcttcatggcgcaatgggaagggcgtggcccggagccgtggatcttcgccgaggctaggcgctga

SEQ ID NO: 8973 - DNA, 1281 bp, Methylobacterium sp.
atggctaccattattggcgacgcgaccgacaacaccctcgtgggtgggacggacaacgacaccatcatcggcaacgccggtaacgacgccctcaacggcggcgctggcggctctgacctgatctacggtaacgctggcgttgacaccatcacgtcgaccaagaacgtggttgtcggcggctttgtcaccgctgctgtcgacaccgtgtacggcggccagggcaacgacatcgttaactacgctggcgcgactgcgggcgtttccgttcgggcctttggtggcctgggcgatgactcgctcgttggtttcaccggcaatgacacgcttgtcggcggcgatggcaacgacacgctcggcggccttggtggcgcggatcgcctcgtcggcgacgctggcaacgacgtcctcgacggcggcgctggcaatgacgtgatctacggcaaccttggcaacgacacgatcacgggatccaacctgaacgtcgcgggcaacctcgacaccgtgttcggcggccagggcaatgatctgatcgactactccgcttcgggtggcaacagcatcatctacggcaacttcggcgatgactcggtcgtcggcgccacgggcgtttccgatcgcatctacggcggtcagggcaacgacacgatcaacggcactggtgttacggctggtactgacaccgtgttcggcggtcagggcaatgacgtgatcaactacgccaccaccgcggctgtgggtggcctgatctatggcaacctcggcgacgacaccgttaccggcggcgcgggtgctgacacgctctacggcggtcagggcaacgacaacgttgtcggtggcgctctgacggacgtcctgttcggcaacctcggcaacgactcgctctctggcggcactggtgctgacacgctcagcggtggcgcgggtgctgatacgtttgcctacgccgctggcgacagcgcgaacagcgtcaccgccggtgctgctgactacgacagcatcacggatttcgtgacgggcaccgacaagatcagcggccttggtgccgtgggttcgtcgaccaacttccgcactgtgaccaacacgtctaacagcttcaccgacgcgcagaccgccgctggtggtctggttgctggcgatgtccggtatgtcttcgttgccaaccagagcggcaccggcggctatctcttcgccaacaccgacggcacggccggcctggcagccacggataccgctatccagctgacgacgggcaccgtcgcggccacggatatccttgcctaa

SEQ ID NO: 8974 - DNA, 240 bp, Methylobacterium sp.
atgaccctggccctggctatccccgttgtcgaggcagccgccttcaccgccggctgtaccctgatccacggccggcgccaccagccgcagtgggtgaccttcgcgctgctaggcctactttgcctggtcgcggtcggtgggctcgcgctggccctggcaggcataggcccatccgatccggtccaggcaaccgcacagatttcctttgaaaatcacgctgcgggagcaatccggtactga

SEQ ID NO: 8975 - DNA, 477 bp, Methylobacterium sp.
atgcccacgcgagccctgccgctctggctcttcacgatcgccctggtgatcggggccccgatcctcaacatcgtctactggttccaggtgctcgcctcggggacgttgccgcacgacggcgacgcggtcgcgatccccatgttcgggggcgtgatcctcacgctgatgctcgcgcccctcgtcctcggtaccgcctggatctgcctgcgccgctaccatcccggaacgcggctcggggcgtggcggcaggaccggcctgtccgcagcctcctcgccagcctcctcttcggtggcccggccctggtgctcgcggccggggcggtccacgaccttctgaccccgggcccgtggtacgagcacatccccgtggctctgtcggtgccgtgcatcgtatggctcctcgccatgcgggcggccttcatcgagcagcgtggagccgctctcccgcgacgacctgcccggcacagagagccatga

SEQ ID NO: 8976 - DNA, 219 bp, Methylobacterium sp.
atgttcctgacgatcggcgcggaggccgaccggctcggcgagcatttggccgctcggtcgcgggccgacaagagcgaggccatgcgtgtggcgctcgccggccggctgcggctctgcgaagcgtcgctggcgaacggaacggagccgcacccgccgggggagggcggcgggaccagataccggatcggaagccgatactgctcggcccctgagccttag

SEQ ID NO: 8977 - DNA, 201 bp, Methylobacterium sp.
atggctgaggtcagccagatggcgttcaaggagcaggctctctcgaccagggtgatgagccgcttgggcgagatcgtctcgatggtcgaggatgcgcgcaaactctctgcactatgtgcgagcgaacctgtggctggcaacgtggccgtgtcaggtgatggcacgctctgctgggcgccgatgagcccaggcaatcactga

SEQ ID NO: 8978 - DNA, 177 bp, Methylobacterium sp.
atgcccgcggcatcgtgccccgggcgatcgtggaggccgaggcgatcgggcgctctctcgccggacgcgccggcccagaccttcagcccggcgccggtcggcggcgactcggagcccgatcccggcctcgaccgtctgctcgcggccctcgacttcgcgcggctcctcccgcgctga

SEQ ID NO: 8979 - DNA, 222 bp, Methylobacterium sp.
atgatgcgctgcgagagcggcctcgtcttcccagacctcgtagaggtacaggcgctcgtctccttcgcggtcggcatgaagcgtgaagacgcggcatcccggctcggctcgcgtcgccggtatgatacccagaaccgcacggcgcgcggcatcgaagtgttcgggttttggcgtgatccgagcgaggacggtgagcggctccgacatccctgcctccgataa

SEQ ID NO: 8980 - DNA, 843 bp, Methylobacterium sp.
atgccccgctacgcccgccgcgacttgctggcgaagttccacgccatgatcgacaggcgccagcccattatcgggggcggcgccggcaccggcctctccgccaagtgcgaggaagccggcggcatcgaccttatcgtgatctacaattcgggccgctaccggatggccgggcgcggctcgctcgccgggctcctcgcctacggcaacgctaacgagatcgtgaaggagatggcccgcgaggtgctccccgtggtgcgccacaccccggtcatcgccggggtcaacggcaccgatcccttcgtcatcatggaccactacctcgacgagctgatcgcgctggggttctccggcgtccagaacttcccgaccgtcgggctgatcgacggcaccttccgggcgaacctggaggagaccggcatggggttcgggcatgagatcgacatgatccggctggcgaacgccaaggacctgctcaccacaccctacgtcttcaatgccgaggaggcggccgagatggcgcgggcgggggcagacatcatcgtcccgcatatgggcctgaccacgggcggggcgatcggtgccgagacagcgctgacgctcgcggattgcccggcgctgatcgaggcttgggccgaggctgcgcgacgggtgcgcccgggcgtgatcgtgctctgccacggcgggccgatcgcgacgccggaggacgcggcctacgtgctcgccaacacccgccactgccacggcttctacggcgcctcctcgatggagcgcctgcctgccgagacagcgctcaccgagcgcacccgcaccttcaagtccatcctcttcccggagacccgctga

SEQ ID NO: 8981 - DNA, 1206 bp, Methylobacterium sp.
atgagcgtcgtctacgtcgtcggcacctgcgacaccaaggaggccgagctgctctacgcccgcgacgtcgcgcgggcggcgggggcgcgggccgtgctggtcgacgtcggcaccctcaggtcgtcggcactggcggatgtgccggcggccgaggtcgccggtcatcacccggacggggcggccacggtgctcggcgggtgcgaccgcggggcggcgatcgccgcaatggcggaagcgctcgctcgcttcctcgcgacgcgcgacgacatcggtgcggtgctcggcctcggtggttcgggcaacaccgccctcgtcacccgggcgatgcgcgccctgccggtcggcgtgccaaagctcgtcgtctcgacagtcgcctccggccaaaccgccgactatgtcgggccgagcgacatcgccctgatgtacgcagtcgttgacgtcgccggcctcaacgcgatctcgcgccgggtgatcggcaacgccgctcacgcggcagccgggatggccctgcgcgcgccgccgcaggcaccggccgacaagcccggcctcggcctgacgatgttcggcgtgaccacctcctgcgtgacgcaagttcgcgaggcgctgagcgccgagtacgagacctacgtcttccacgccaccggcaccggcggccagtcgatggagaagctcgccgattccgggctgctcgccggcctcctcgacatcaccaccaccgaggtcgccgaccacctgttcggtggcgtgtttccctgcaccggggaccgcttcggcgccgcgatccgcacccgcctgccctatgtcggctcggccggggcggtggacatggtgaatttcggcccccgcgagaccgtgccggagcgctaccgcgaccggactctctacgtccacaacccgcaggtgacgctgatgcgcaccacgcccgaggagaaccgggcgatcggcgcgttcatcgtcgagcggctcaaccgcatggaggggccggtgcgcttcctgctgccgcttcgcggcgtctcggcgatcgacgcgccggggctgcccttccacgacccggaggccgacgcggcgctgttttcggcgattcgcaacagctggcgcgaggcgccgaaccggcgactcgtcgaggtcgacgccgccatcaacgatcccgccttcgcgcaggcgcttgtcgccgccttccgtgacgccgtgcaggagagaccctga

SEQ ID NO: 8982 - DNA, 702 bp, Methylobacterium sp.
atgctcgtggtgcgcgacctccacgtccgcttcgggcaggcccacatcctccagggcgtcgacctcgcggtaggccccgcgccgctcgcgatcgtcgggcgcaacggcatgggcaagacgacgctgtgccaagcgatcatgggcatggtcgcgggccggggcgagatcagcctcgacggcgcgagccttgccggtcgggctccggaccgcgtcgccctggccggcatcgcgctggtgccgcagggccggcgcaccttcccgtctctgaccgtggacgagcacctgcgcctcgtcgaccagggcccgcgcgcccgctggaccagggcgcgggcctacgagaccttcccacgtctggccgagcggcggcgcaacggcggcacgcagctctcgggcggtgagcagcagatgctggccatcgcccgcgccctgctgatgaacccgcggctcgtcatcatggacgagccttcggaggggctagccccggtgatcgtcgaccacctcgccgaggtgctgcgcggcctcacccaggagggcatcgggctccttctggtcgagcagaacctgcgcatggcgacggcggtctgcgatcacgtcgccgtgatggtgaccggccgcatcgcagcgaccctgccggcggccgagctcgccgggaacgaggacctgcagcggcgctacctcggcgtcgccgccgttcaccactga

SEQ ID NO: 8983 - DNA, 750 bp, Methylobacterium sp.
atggctcccgaacctgccctccagctcaccggaatcggccgccgcttcggcgcgctgcacgcggtccgcggcgtcaccttgagcgtggcgcccggcgagcgccgggccgtcctcggccccaacggcgctggcaagaccacgctgttcaacctcgtctgcggcgacttcccgccgaccgaggggcgcatcgtcttcttcggccaggacatcaccggtctgccagcccaccggcgcacccggctcgggatcgggcggacctaccagacctcgctgctcttcaacgggctcggcgtcctcgacaacctctacctcgcggtgcgcggcggccggccgggccggttctcgttccgccggcccgggcgcggcgatccgcacctcgcccgcgcccgggcgctcgccgagcggatgcgcctgacgcacctcgaggagcggccggtctccgacctctcacacggccagcgccggcaactggaggtcgggatggcgctcgcctgcgacccgaaggtgctgatgctcgacgagcccgctgccggcctctcgcccggcgaccggccggaactgctggcgctgctccggggcctgccgcgcagcctcaccctcgtgctggtcgagcacgacatggacgtggccctgcccgcctcggacatcgtgacggtgatgaaggacggcgcggtcgccgtcgaggcgacgcccgaccggatcggctccgacccgaccgtgcaggcgatctatctcgggaagggacactga

SEQ ID NO: 8984 - DNA, 1023 bp, Methylobacterium sp.
atgagcgctcggctctcgctcccggcgctcgccctgctgctcgccgcgcccctcctcctcgggctcgtcctgccgcagccccaggcgcagttctggaccgtcaacatcctggggcgcgccctcgtctacggcatcgtggccctgtcgctcacgttcctggccacctacgggggcttcgtctctctggcgcagatgacggtggcgggcatcgccggctacgggctcgcgatcctggtcgagggggcggtgccaggcatcgtcggcggcctgccctacgcgctcgcggtcccggttggcctcctggccgccaccctggcggggctgctcatcggggcgatcgcggtgcgcacccgcgacatctacctcctgatgatcaccctggcgctggcgatggcggtctcgcgcttcgcggaatcgaacatcgactggttcaacggctacgagggcatccgcaacgtcgtcgggccgaccctgttcggggtgccgttccgccagccgcacctgttctactacgtctcgctcgcggccgcggtcgccctctacgtcggcgtgctccacctcgtgcgcaccccgttcgggctcgtgctccaggccatccgcgacaatccccgccgcgccgcggcactcggctacgacgtggcgctccaccgcatcgccgccttcggggtcgcgggcttcatcgccggctgcggcggcgtgctgacgacgatctacaacatcggcatctcgcccggctcgatcgggctcggcgccagcgtcaacatcctcatcatcagcgtcatcggcgggctcggccacccggtcggcgccttcgtcggctcgctgatcttcgcggtcttcgacaccttcgcggcctctctgtacgaccgcgaccgcttcaacaccctgatcggcctcgtcttcctcggcatcgtgctggtctcgccggacgggatcgtcggcctcgtccgccgcatccccggcctgcggcggctgccccggccgaggcccgacgccgcccggcgggccgccgagaccggctga

SEQ ID NO: 8985 - DNA, 879 bp, Methylobacterium sp.
atggcgctcgccgccacagtcgtgctgaacgggtttaccctggccgctctctacttcgttgtcgcctccggcttctcgctgatcttcggcctgatgcgcactgtaaacatggcgcacggctcgctttacttggtgggcgcttatttcgcctacgcggtgttcgagccgctctacgaccgcgacgcgtggtacgcttggtacctagcggtgccggtcggcatggccgcagcggcgctggcgggggccgccatgcagacgctcctgctcggctggatgcagggccaggagctgcggcagacccttgtcaccatcggcatctcgatcgtcgttgccgaccagctacttgcccattttggcgggacgccgcggcagttcttcgctcccgacgcgctgttcggcacgacggagcttcccctcgtcggccgctacccgaccttccggctggtccagatcgcggtcgcggtcgcggtgggcgtcggcctgtggctgctcctcgcctggaccaagctcggcctcatggtgcgggcgggcgtcgacgaccggaccatgctcgccgcctgcggggtgaacgtgcctcgggtggcgctcgcggtcttcgccctcggcgccgcgctcgccggcctcggcggtgtgatcggcgcgacggcccagcccctggcgcagggcatggacggccgcttcctccttacctcgctcgttgtggtgatcgtcggcggcatgggctcggtgcccggcaccgcggtcggggccgtgctcgtcggcctcgccgagcagatcgggcaggcgctgtttcccacctacgcagtcatcctcaccttcgggctgatggtcgcggtactggccgtgcgcccgcaagggctgatggggaggcccgcatga

SEQ ID NO: 8986 - DNA, 672 bp, Methylobacterium sp.
atgagcagcttgcccggcattcgcgcgtgcctgacgtattgcgttctgataatcctgatctggacggtcggctctacggcttggacgatgtggatcttccataggccacttgatgagcccatcgccctggcccccgcgggaaggatccagcggaacatcgagatccgattcaccgctccttacagtctcgccctcgatttcagcttcggcgcgcgacgcgcggagatcatggccctcgttggcgaaggatccgcgatcggatcagcagtagcgctacacggtcgatccggcacaacggtcccgctacgttggtctctgactgatgtggacggcaaggtcgtagcgggcagcgaagcggatacgcacggaagaacctcctacgcctccgacttcgtatcgcgcaacgttgcgaccttctccatcatccctggccgctaccgccttgaggtgaatgtcctccgtgacgtacccgagttccgggatgtgccagtacgggtgcatctcggactaccggtcggaaaggtatcgtcgggctggcagagcgagttcgcattcttcgccggcttcgcgaacgtccttgcgatctggccgctggccggcttgctcctcttggctctggccatgttgacgatccgagatctgacgggccccggatcgatgcgctcagcatga

SEQ ID NO: 8987 - DNA, 285 bp, Methylobacterium sp.
atgacccacctgagcaccctttccgcaccgaccaccagcaccctggccatcggccccggctcctggcgcgacgcaccccttccccagcgcaatagcaccgacgcccgtgaccggctccggctggcactcaatgcccgcggcatgcgcctgtcgttctgcgtcgacggcatgctcgcccgcgacctggccaccaacgagagctgcggcgggatctacccctacggcgacttcgccggcatgcacgcggccctggtcgccggcgagctggaggtggaccatgtctga

SEQ ID NO: 8988 - DNA, 198 bp, Methylobacterium sp.
atgtctgagatccgcatggatgcagaagcgcgcgccagggtcattgcgtggcgctgcggcttcgtcctggaccgcgacgcggcgagcatccagatcaagtaccccgccgacggcgtcgtcgccggtcgagtggcctcgttcgaggacgtcccaggcgcattcgtcgaaggcaggctggccaaggaggtgcgcgtatga

SEQ ID NO: 8989 - DNA, 183 bp, Methylobacterium sp.
ttgacggacacgactcccgacatcgtcgagctgacgggtgacatcgtgtcggcctacgtgtcgaacaactccgttcctgcggccgagctggccggcctgatcgcgggcgtgcacgcggccctgcagcgcctgaccggcgcggcggcggcccccgccgaggccgaggcgcccgtcgagaagccc

SEQ ID NO: 8990 - DNA, 282 bp, Methylobacterium sp.
atgccgcccgacgaccggacatatgacgagcagttgcgcgaacgcctcggcgcgggcggcgtgaaacggctgtccgagttgattggcgcggcgggcgggctcacgcccaccgaagcgaggcactggttcgagttgtcagtgcaggattggcgcgaggtcgaagcgctcgccttcctggcgctcgacgattgcgagcaacgaggagcgatcttgccgtggcatctcgttcgctggctggaccgccgccgccatcacaaacccaccacgagcttgttcgcatga

SEQ ID NO: 8991 - DNA, 399 bp, Methylobacterium sp.
gtggccacgaccgtcaccaccttcgccgagctgaacaccgccctccgggcggcggacgatcgggccgccaacacgggcgcgatcgagatcgtggtctcgggcacgatcgccgcgacggccgacctcacggccgtcaacctgcgggccggcaacacgctgctgatccggggcacgaacggcggcacgctggacggcgggcggacgcatcgcgggctcttcgtctattccggcaccgtcacgatccaggacctgacgatccagaacgccagcgcggtgggcggcgcgggcgggcttggcggcggcggcggcgccggcctcggcggcggtctcttcgtggcggccgacacggcgcacggcgcgacggccggccacgtcaccctgtccaacgtcagctttacg

SEQ ID NO: 8992 - DNA, 741 bp, Methylobacterium sp.
gtgacgggtgccagcgaagagcagatcccgcagcccgtggcggccttcaacgggcgcgtccgagggctggcgctcagccagcgcgccgaccgtgccgttgggctggcgggcgacatcgtcgatctagtccggcacgcggtctcggtccacgcgaccaaccgcatcgtgacctacagcgaccggatttcatcgcaggtcgggacgtccttcgccgcgaacgccttcaacgacgtgcagcggtccttgatcgaggccgagatccttcagaccgtgcgtctctgggaccacccggacatcgaccgcatcggcctgcaaaccgcctactggctgtccaaggatcccgccgtccggaccatcttgaacgaccggcacacaacggcacccgagccctatcccgggtacatcgccgatcggctcgcacggcaggaccttctctggctccggctcgaccgggtgatggccttgatcctcggctccgacctcctgaccaggctgcgcaacttccgggacaagcgccttgcgcactggctggtccagacgaagctcgagcgagcaggcgagacggtgccgccggccctgtacggggacgagcgccggctgctcgtccggacggtcattgcggccgatctcctcgcccgagcaacgcgagacgcttcgttcgacttcaagggacagtggcggattgctcagcgcaacgccgaggccttctggcacgggtgcacagtgaagccgctcaggtaa

SEQ ID NO: 8993 - DNA, 195 bp, Methylobacterium sp.
atgcagcgcggtctcgatcccctccgcgatgcccatggtctgcgctggcgggaacaggcggatcgcggtgccatccagaaccgcggagtgcccggtactatcgcgagatcggcgagcgccaccgttttcgacagcggcgtgcagatcagccgcagcttccaccgcgggttcggtaagagtgcgtccgggttctga

SEQ ID NO: 8994 - DNA, 642 bp, Methylobacterium sp.
gtgaatggcgaaccggtaggatcacgccctgacgccaccgttggccccggcgcacccaagcagcaggagctgttcgaggcgcggacgcagtggttccacgtcttcaagaccatgatcgattcgggtgatctggccaccctctccggctcggccgtgaaggtctacctggtggtgaagagcttcacgaacttcgccaccggacgtgccttcccggccttggagacgatcgccgaaaaatcggggctctcgctggcccaggtgaagcgggagctgaagacccttgaggagcggcactatctcaccaaggcgaaatccggccggcgcaacgagtaccgtctgcgcgagaaggtcgaaatcacggacggcagtggacggcccgcagccgtcgccacctgggactacctgccgagcagcgtgcagcacgccatggctgacctgaagaacgttctgatcaccggcgacctggccggggccaagatcgtgcacatcgagcgcctgcaggtgaacgtcacgcacctccacgacaacgccgtgaacttcaacgtgcagcagttcaacgccgacctggagaagctgccgccggccatgcgcgagaagctgctggcgaattggaaggcgagcttggagcgcgaggatgcctga

SEQ ID NO: 8995 - DNA, 129 bp, Methylobacterium sp.
atggcgcattatgtgttttccgccacaacaccgacacggggcgaggagctgtgggtcacggacggcacagctgagggcaccatcctcctcaaggacatcaacaccggatccgtcggctccttcccggcc

SEQ ID NO: 8996 - DNA, 465 bp, Methylobacterium sp.
atgctcgaccccgtcgcgacacgccttgccaggctggctcaggacgtcgctgcgacgcgcgctcgaacgcaacagcttcaagcccaaggcagcgtgctgaggcagcgccttggtcgggcacgtcgcgcgctcgccgccgcaggcgaggcatcggcgcaggcctgcaggacctcgcatctcctgctgcaggaacgcacgccggtcgtgctcgagcaggcagggttggacgaggcgccccgaacgccagacccatcactcggcgccgtccacgagcttctctccatcctcatggcgcaggcaggcggcccggagcgcctcgtcgacgtactcctcctcgctcacgaggaggccgaggccgcaggggaggatgagcgggccttgatcctggccggcctgctccaccagctcggccgacacctggcgcaccaagtcggaccccgcgccgccggcattacgctgaactga

SEQ ID NO: 8997 - DNA, 900 bp, Methylobacterium sp.
atcaccgtcgacgtgaagggcgagatcctggagctgaagaacaccatcaacaccatggtggatcagctcaactccttcgcgagtgaggtgacccgcgtcgccaaggaagtcgggtccgagggcaagctcggcggtcaggcccgcgtcgagggcgtggccgggacctgggcggatctgaccaacaacgtgaacctgatggcggagaacctcacgggtcaggtgcgcaacatcgcggacgtgacgaccgcggtggccaacggcgatctctcgaagaagatcaccgtcgacgtgcgcggcgagatcctggagctgaaatccacgatcaacacgatggtggatcagctcaactccttcgcgtcggaagtaacgcgcgtcgcccgcgaagtgggcaccgagggcaagctcggcggccaggccgaggtgaagggcgtcggcggcgtctggaagggcctcaccgacaacgtgaacatgatggcggccaacctcacgggtcaggtgcgcaacatcgcggaggtcaccacggcggtggccaacggcgacctgtccaagaagatcaccgtggcggtcgagggcgagatcctggagctgaaatccacgatcaacacgatggtggaccagctgaactccttcgcctccgaggtgacgcgcgtcgcccgcgaggtgggcatcgagggcaagctcggcggccaggcccaggtccgcggggtcggcgggacctggaaggatctgaccgacaacgtgaacatgatggcggccaacctgacgggtcaggtgcgcaacatcgccgaggtcaccacggcggtggccaacggcgacctgtcgaagaagatcaccgtcgacgtgcgcggcgagatcctggagctgaaatccacgatcaacacgatggtggaccagctgaac

SEQ ID NO: 8998 - DNA, 624 bp, Methylobacterium sp.
atcaccgtcgacgtgaagggcgagatcctggagctgaagaacaccatcaacaccatggtggatcagctcaactccttcgcgagtgaggtgacccgcgtcgccaaggaagtcgggtccgagggcaagctcggcggtcaggcccgcgtcgagggcgtggccgggacctgggcggatctgaccaacaacgtgaacctgatggcggagaacctcacgggtcaggtgcgcaacatcgcggacgtgacgaccgcggtggccaacggcgatctctcgaagaagatcaccgtcgacgtgcgcggcgagatcctggagctgaaatccacgatcaacacgatggtggatcagctcaactccttcgcgtcggaagtaacgcgcgtcgcccgcgaagtgggcaccgagggcaagctcggcggccaggccgaggtgaagggcgtcggcggcgtctggaagggcctcaccgacaacgtgaacatgatggcggccaacctcacgggtcaggtgcgcaacatcgcggaggtcaccacggcggtggccaacggcgacctgtccaagaagatcaccgtggcggtcgagggcgagatcctggagctgaaatccacgatcaacacgatggtggaccagctgaac

SEQ ID NO: 8999 - DNA, 315 bp, Methylobacterium sp.
atcaccgtcgacgtgaagggcgagatcctggagctgaagaacaccatcaacacgatggtggaccagctcaattccttcgcctccgaggtgacccgcgtcgcccgcgaggtcggctcggaaggcaagctcggcggccaggcgcaggtgaagggcgtgggcggcacctggaaggacctcaccgacaacgtgaacctgatggcggccaacctcacggggcaggtgcgcaacatcgccgaggtcaccacggctgtggccaacggcgacctgtccaagaagatcaccgtcgacgtgaagggcgagatcctggagctgaag

SEQ ID NO: 9000 - DNA, 78 bp, Methylobacterium sp.
gagtgccggcctgtcacgccggaggtcgcgggttcgagccccgtcgcccgcgccacgttctcctttcagctccgctga

SEQ ID NO: 9001 - DNA, 540 bp, Methylobacterium sp.
atgctggctgccccactcaacctcgcgccgcgcgcgccgctcaaggggccggccggcgctcccgtcccggccgggccgcagcccgcgccgggccagatccgcgtgctgatcgccgacgattccgccgtggtgcgcgggctcgtcgcccgctggatcggcgaggccggcttcaacgtcgtcggcaccgcctcgaacggccgcatcgcgctggagatgatgggccgccacgacccggacgtcgtgctgctcgacatcgacatgccggagctcgacggcaccgaggcgctgccccggatgctcgccgcgagcccgacgctgcaggtcgtgatgatgtcgacgctgacgacccgcaacgccgacatctcgctcaagtgcctcgcgctgggcgcggtggactatctcgccaagcccgagagcaaccgcggcgtcaccacctcggacgccttccgggcggagctcgtcgagcgcgtgcgcctgttcggcgcggtgcgcgcccgcgggcgccggcccgccccggtctcggcccccgccttccacgag

SEQ ID NO: 9002 - DNA, 141 bp, Methylobacterium sp.
gtgcaggatggtgaacggctccgcacggattgctgggaggtgcggctcggcatcgtctttgccgagtcgcacctcccacacggaatgggtcctcacgaggtcgagcggatcggctcccgggcctaccgcgtcagcgcgtag

SEQ ID NO: 9003 - DNA, 87 bp, Methylobacterium sp.
atgcagtcgatagtccctatcgacgacgtcgataagatggagccgctggcgcacccgatgggcgtacggtcccgggatgtggtgtga

SEQ ID NO: 9004 - DNA, 714 bp, Methylobacterium sp.
ctcgaggcggagacggcgctggcgcgggcctcggcggaggagcagcgcaaggccggcatgcgccagatggccgacggcttcgagcaggcggtcggcggcatcgtcggcatggtctcctcggcggccagcgagctgcaggccaccgcccagggcatgagcgcgaccgccggccagaccgcctcccagtccaccagcgtggcggcggccgccgcccaggcggctgccaacgtcaacacggtggcggccgcggccgaggagctcggctcgtcggtcgccgagatcggccggcaggtctcgggctcggccgatctggcgcaggcggcggtggccgaggccaacgccacggcgggcctcgtgcaggatctggcccaggccgccagccgcatcggcgacgtggtggcgctgatctcgcagatcgccggccagaccaacctcttggccttgaacgccacgatcgaggcggcgcgcgcgggcgaggcggggcggggcttcgcggtggtggcggccgaggtgaaggagctggcctcgcagacggcgcgggcgacggaggagatctcgacgcagatcggccagatccagggctcgacggatcaggcggttggcgcgatcggcgggatcggtacgcgcatccgggagatcgccggggtggcggcctcgatcgcggcggcggtggaggagcagggcgcggcgacccaggagatcgtgcgcaacgtc

SEQ ID NO: 9005 - DNA, 1191 bp, Methylobacterium sp.
atgtcttcattcggcggttccgcgcccgagcgctcgcagctgtccgaagtgacctcggatcgcaggctgtcgcagcccctagctcccggcttcatccacctgaaggtggtgcaggggctccgcatcgtcgtcaccgaactcggtgccgaccccgacgccctcgctgccgcggcgggcctcgatcctcgactcttcgccgccggcagcaagctcgtcccattcacagcgatcggtcgcctcctggcgctcggcgccgagcgcacccgctgccctcatctggggctcttggtcgggaaacggacgaccctgggctcgctcggcctggtcggcttgctgatgcgctcctcggacacggtcggcgccgccttgcgggctctcgaagcgcatctaagcctgtacaacagaggggcggcggccggcctcggcatctacgacgacaccgctgtcttcagctacgcgctgtacgagcccgaagccgacggagccgccctgcacacggaacgcgccctggccaaggcgaccaacgtcctgcgggcgctctgtggggcggactgggcgccgttggaggtgatgctgccgcattccgccccccccaacacgaagccctacagagcattcttccgagcgcccgtccggttcgatcaggaagaggccgccctggtgttccaggcgcagatcctgaagcagcggatcgtcacggcagatccggccacgcaccgccgggtggaggaccgcatccgccgcattgaggccgctcagaccacgaccctatcagacgagcttctccaatatctccgtaccgcggtgacgcggcagcggtgcaaggctgagcgcgcggcgcgcctgcgacaggtgacccgccgcaccctgagccggcgcctcaaggcggagggaacgagcttcaagcgcttggcgaacgaggcgcagttccgcgtggccaaacagcttctcgccgacaccagcatcagcgtgacacagatctcggccatcctggacttctccgaaccctcagccttcacccacgctttccggcgctggtcgggcgtgacaccgagcgcgtggcggaagggcaactggccgcgcaccgagatcactcagctcgatgaggagcctggagccagaggagagatactggatgcctttgccccgccggatcttggtctgcgaccttctcatcgtcgccggcagtaa

SEQ ID NO: 9006 - DNA, 237 bp, Methylobacterium sp.
atgaacctccggttgcaacctgtgcgcgtccgaaccgggagcagcgataccgatgggctgctcgtttttacgggcgagtaccttgtggctgttttggtgcagctatcagaggagcatggtgagcacacaggcttctggtttctggaagccggcttcgatggtgcggaggatttgacccggccaacgttccgtgaccttgaggaggctcaagcctggatcgagcagcggatcggctga

SEQ ID NO: 9007 - DNA, 546 bp, Methylobacterium sp.
atgccccgcatcggttacgcccgcgtcagcaccctcgatcaggatctcgacgggcagcttgcccgcctcaaagccgagggctgcgccgtcatccgctccgagaaggtctcaggcgccagccgcgagggccgcgccgaactggcgaccgtccttgagttcctgcggcccggcgacgagttggtcgtcacccggcgcgaccggctcgggcgcgatacccgcgacgtcctcaacgtcgtgcatgaggccgagcagcgcggggccagcgtcacggtactcgacccgcatgtctccacccgcggtgagatgggccacgttgtgctgaccgtgctcggcatggtcgcgcagatggagcggcgcttcatcaaggagcgccaacgcgagggcatcgagcgggcgaaggccgaaggggtgtatgccgggggtaaacgacgcctcgaccgcgagcaggtgcgggcgctgcacgctgctggcagcgagcccgcggccatcgctgctgcccttggctgctcgcggatgcaggtctaccgcatcctccggcaggcatga

SEQ ID NO: 9008 - DNA, 2907 bp, Methylobacterium sp.
ttgagcgtcaccggcctcgcgctgaacggcggtttcgtcggcgccactggcggcccgcgcctcggggcagctctggcccaggacatcggcgccattccgttcggagcggtcgccgctgcgcacatggatgccgacacgatgaccgatctcgtcatcgctacgggatccggcatatccgtcctcaaaggcaagggcgatggaaccttcgaggcgccaatcagcgcgctggcaggcccccaaggtttctacgctgtggctgtggcggatctcgacggtgacgggcgccaggacatcgtagcggctggtcgggactcgtcccccggttcgttgtcggtgatcctgcgggacgccagcggagggtaccgagcgccgcaggttctgaacgcgggtacgatcttcacgagcatcgcggtcgccgatctgaacggcgacgggaagctcgacctcgtcgctgccgacccggggaacgtgaactcgaccacacccagcgcaggtagtgtcaagcttttcctcggtgacggccaggggggcttccagggcgcgacgagtcttaccaccggatcgtcgtcggtcgccgtcatcgcggccgacgtgaaccgcgacggcagaacggacatcctcgccgcaaaccggaccggcggggacatctcggttctcctggggaacgcctctggtggcttcaccgcggcggcaaatttcgcggccgggtccgatccgcgcacgatcgcggccgcggatctgaatggggacggcaatccggatctcgtcgtgacgggatccggcgcggcttcgatcctcctcagcaatggggcgggcggtttcgagccaccgaacccgatcgcgactggcggccttgtctactccgcctcgatcgtcgacttcgacggggacggcaagctcgatctctttgcccccatcatgcagggatcaggcggcttcgccgtgatgcagggtcggggagacggaacgttcctggcccctctgacctttgccagcggaagcgggaactacgtcgggtcggtcgccgacgtgaacggcgacgggcgtccggacgcgctctcgaccaagctcagcgggagcggcggctttaccgtcgcgctgaacgtcacgacccaggcggcagccctggatgcagcaacggtgagcgcgacgcttaacggtgccgcgaccggtctcgcaatcgacacgacagctccgacgctgacggcgcgctcagcgcaagacctcccactgagcggtgcgctgtctgtcaccttcagcgaggccgttgtggcgcacgatccagtgccgccgccgggcgccaacgtcatcgtcaacagaggaccgacggtcacgctctacaagaacaaccgtaacgaccctgcgaccgctatcgagacgttcagtagagggcagtggacgctgaatggcaacacgctgtcggtcacgccgagcgccggcctgcaacccggcacgaactatgtcctggctctcgacaatctcaatctgacggacgcggccggcaacgcgatcgcgacgagcggctcgttcacgatcaatccgaacacgcacagctacgcgcttgtcccgtacgccttctccacggccgcaagcccaccctcgaccggcggaggttcgagcccgtccgatccagcgcccaacctcgtggacggggttcaggtcaacaccggtatgcagaccctcccggacggcagcagcgtgccggtgaccacgatcccggtggttacgggtggccggaccgacaccgacaccgcctcgtccgccgccgacatcccgctggtcacgggcacgggcggggccacatacctcacggcccaggtcccgaccggctacggcctgcaagccctcggtccttcgacctccggtctcaatggcctgatcgcggcgatccagagccgcacggttgccggctcggccgaccaaaccgccctaaccggaagcggctcgggcttcctcggcgcgctcgcagccaacaccaacctgactgtgcgcaccatcgtgccgagcgtagcgcccggcacgacgaccgcaccgaaccagccgttggtaatccagggtcagcccttggcgcaggatgccggccagcagcaggccgtcgtgctcgatgccagccagctgcctgccggcatcacgatcgagctacgcgacatcgacttcgccgccgtcgtcggcgccgtcacggtgcgtgcgccggccgatacggtcgtcgggagcggtagcggcggcctcagcgcggtcggggcgctcacggtcacgcccgatccgctgcgcatctacggagacggcgcggcccagaccttcgtcggtggtgcggccgacgatctgctctccggtggagcgggtaccgacacgctactgggcggcctgggcggtgacctgatctacggcaacctcgacgccgacctgatctacggcaaccagggcgccgatactctgttcggcggccagggtgacgatcgtgccttcggcggccagggcgacgatcgcctgttcggcaaccagggcaacgacatgctgctgggcaatgtcggcgcggacatcgtgtacgggaaccagggcaacgacatcgtctacggcaaccagggggcggacctgctgttcggcggccagggcaacgacgtgctctacggcgggcaggacaacgacacgctggtagggggcatcggtgacgacacgctcgtcggcggactgggggcggacctctaccgcttcgacccgaactccggccgcgacctgatccttggtttcaaccagggcgagggcgaccggatcgcgctcggcggccagacctacacggtcacctcggcgcagaacggtgacgcgctgctcaacctctccggcggcggcgtggtcgatctggctggcatccgggccgatcaggtcaacgcgagctatttcgcagcctag

SEQ ID NO: 9009 - DNA, 81 bp, Methylobacterium sp.
gtgaagctcctcgtcgccgtgctcctgagcaccttcgtctacgcggcgatcctgccccccgccgtgcggttccgtgactga

SEQ ID NO: 9010 - DNA, 195 bp, Methylobacterium sp.
gtgaagagtgcaccatcaaaccccgggatcaaacatgtaatcggcacgatccgcgaccgcgggagcctcggtgccgatgacttctgctgcaacctgccgcgcttcgcagcagagaacctcgcggcgaacgaggcgctgatcgacacgctcgccgccgagaagggcttgacggccgcccagctcgcactcgcctga

SEQ ID NO: 9011 - DNA, 1467 bp, Methylobacterium sp.
gtgcgggagatcgccttcgagatcgacgacgactccggtgcgccggtcttcatccggctcagccgcgccatcatcgcggcgatcgagagcggacggctggagcccggccggaagctgccgggcacgcggacgctggcggctgcgctgaagatccaccgcaacacggtcgacgccgcctaccacgaggcggtcatgcagggctggctggtcgccgagccggcccgcggcaccttcgtcgcccgcgatctgccggagatgccggccgggggcccgccccgtgccgaggcagtgcgcggggcgaaccttcgcagctgcgccgagccggtgacaccggcctgcggcggagcgccgatgctgcacgtctctgacggcgcgcccgatccccggctcctccccggggcggaaatggcccgagccttccggcgggcgctcacggcgccggagttcctgcgatcgggccgtcatgacgatccccatggcgatccacgcgggacgcccgccttacgcgaggcgttgtgcgcgcacctgtccgccgagcgcggcctcgccgcatcgcccggcgagatcctcgtgacgcgcggcagccagatggcgctgttcctcgcggccggtgcgctgctcgggcgggacgcggtcgtcgcggtggaggagccgggctatccgctggccgtcgccgcgttccgggcggccggggcgcgggtcgtcggcgtgccggtcgatgcggacggtctgtccatcgacgatctcgaacggctggcgaaggtggagccggggctgcgcgccgtctacgtgacgccacaccaccagtacccgaccacggtgacgctcggcgcgggccgccgcatccggctcctggacctcgcccgccgccacggtctgacgatcatcgaggacgactacgaccacgcctaccgcttcgacggccggccggtcctgccgctcgcgtcgcgcgcgggcgacgtgccggtggtccatgtcggctccctgtcgaaggtgctcgcccccggccttcgcctcggctacgcgaccggaccggccgggctgctcgcgcggatggccgccgaccggcgggcgatcgaccggcagggcgacgttccgccggagcacgcggttgccctcctcctgcgcgagggcgacctcggccgccacgcgcgcaagacgcgccggatctatcgggcgcggcgggaccgactggcggacctcttatgggacgcgctgggcgaccgactgaccttcgacgtgcccgccggcgggctggcgctctgggcgcggctcggaccggggctcgacgccgcgcgctggagcgaggctgcgcgccgtctcggcctcgcggtcacgcccggctccgcccactgcctgaacgctgtgaccgcggcgcaggccttccggctcggcttcgcggatctctgcgacgatgacctgcgaaggatggtcgcgcttctcggccgtgcctacccgacgcgctga

SEQ ID NO: 9012 - DNA, 345 bp, Methylobacterium sp.
gtgcacaactgtctcgacttcagcttccggcgcatcgagccgggctggccgttccgcgaggcggggcgggactatctcctcgccgtggacggcaatatgcaggcgaacaacggcgagacgctggtgcaactggcgctggccggcgtcggcatcacgcgggtgggcaacttccacatcaccgaggaactggcgacggggcggctcgtgccgctgctcgacgcgttcaaccccggcgaccgcgaggcgatccacgcggtgttcgtcggcggggcggcgatgccggcccgggtgcgcgtgctcgtcgacttcctcgccgagcacatgcgtggcaacaccggctggtag

SEQ ID NO: 9013 - DNA, 609 bp, Methylobacterium sp.
atgcgcgacgcgatgcaactcgtccccatggtcgtcgagcaatcgagccgcggggagcgctccttcgacatctactcccgcctcctgcgcgaacgcatcgtcttcctcaatggggaagtgaacgacacggtctcggcgctggtgtgcgcgcaactcctgttcctggaggcggagaacccgacgcggccgatccacctctacatcaactcgccgggcggcgtcgtgacgagcggcttggccatgtacgataccatgcgccacatccgcgcgccggtgcatacgctgtgcatggggacggcctactcgatgggttcgttcctgctcatggccggcgagccgggggagcgggcggcacttcccaacgccagcatcctcgtccaccagccctcggggggcttcaaggggcaggcctccgacatcctcatccacgccgaggagacgcagcggaccaagcagcgcatgacgcgtctctacgccgcgcattgcgggcggtcctacgaggcgttcgagcgcgcgatggaccgcgaccgcttcatgagcgcggaggaggcgctcgactggggcctcatcgaccgtatcctcccaccacggacaggcgccctcgcatag

SEQ ID NO: 9014 - DNA, 357 bp, Methylobacterium sp.
gtgagcgacgcgggaagcgacgagttcggccacgacatcgagcaggcctacgagttgaacgagccgcccgagaaggtctggcgcgcgctcagtatcccggcgctgcgggagcattggctgcccggggcggcgctggtcgcacccgaaccgaccgccgtcacgtccgagcatgaggtcagctaccggatgcgcgaggctgccccgccgtaccttgagagcacggtgacgttccgcatcaccccgaacggcacgggcggtacctgcctgcggatcatccacgaactgacggacgcccggttcgcacacctgacgaaggtcgccgcgaacggcaacgtctccctgctacgcgccgcctga

SEQ ID NO: 9015 - DNA, 114 bp, Methylobacterium sp.
gtgcgccagaccacggggctgaatgtggacgagggcgtcgtccgggcgatctacatcgtgcgcaatcccgagaagctgcgccatctcgtggccacgtccgagcattctacgtaa

SEQ ID NO: 9016 - DNA, 654 bp, Methylobacterium sp.
atgctggggtcggtcgccgacgcgcaggacgccgtgcaggacgcgtacctgcgctggcacggcctgctccacgccgggatcgagaagcccgaggccttcctgatccgcatcgtcacccggctctgcctcgaccgcctgcgcgccgcgcgccgcacccgcgagacctacatcgggccctggttgcccgagccggtcttcgaggccgcgccggacgaggcgggcgaggacgtctcgctcgtgctgatgctggcgttggagcggctgtctccgctggagcgcgcggcgttcctgctgcacgacgtcttcgggctcggcttcgaggcgatctccgccgccctcgaccgcgaggcggcggcctgtcggcaactcgcctcccgtgcgcggcggcacgtgcgcgcggcgcgcccgcgcttccccgtcacgcccgaggcgggcgcgcggatcgcgcaggccttcttcgaggcctcgcgccgggacgacgcgagcggcctgcaacgcctgctcgccgcggacgtggtcgcctacacggacggcggcggcctgcgctcggcggcgctcaacccgatcctcgggcgcgagcgcgtgacggcaatgttccacgggctggcgcgcaagatcggcttcgtgcggccgccactgctgcaccggggctga

SEQ ID NO: 9017 - DNA, 711 bp, Methylobacterium sp.
atgaagctccctggactggtgcgcctgctggcagaggacgacgaacgcggcgagcccgcgatagctcacatcgcacgggttatccgcgaggccggtcatctgccgacgacgaagagggggcgaggagcctccgacatgggcgtccttgaagctgcgaacctgcttattgccgccaatgccacggatgtgccgagcaaggtcagcgagaccatcgagacgttccgtaagctgaggcaggtccccatacgaaaaagcgaggggggcatcacgatcgactcttcgagttggtggaagaagctctcatcatgcacgaatttcggtgacgctcttgaggtcctcatcgctcaaagcgagaatgaccgagaagacgtctgccaagcgtttaatctatcacttggcgctaatcggccgtctgatttgctaacattccgcgcagtgagatttggctggcctgaagctacagcctcgatcctgctcaacgtcgcgaacgccgagcctttccgagatggcctgcagccagatgcggacctgagcggcaagcgcttcgagatccgctttgccctaacggaggccgatcgcctcttcctcaaggatcagaagccgtccggtcgcatccacgaggtgactgtccgggacagcgtgatccgccgcctctccgacgcctgcgccgccgcatcgaccgacgcgcccgataaggaggcggtcgcctga

SEQ ID NO: 9018 - DNA, 279 bp, Methylobacterium sp.
atgggcgacgtcatcaccttccggccccgcccgcgtcctgctcggcccgccgtgcggcaccaccgcgctcgcattgagggggccgtcgcccatgcccttgatgtggtcgacgagctgatagccgttctcgacggcctggatgcgcccagcgtggatctcgtgcctgacgcggacctcgaggacggcggcgatgccgagccgtccttagccgctccgatcggtggtccgtctcagcgtgtctgggcggcaggcggaagccaggatctcgagcgcgaatga

SEQ ID NO: 9019 - DNA, 423 bp, Methylobacterium sp.
gtgaaggcgcgagcgaccgaggttctccaggcaaaatcgccgagtggctcgctcatcgagcacctgccggcagcgcgggacctcgcggacgtggtgagcctgtcagagctgtcgctctggcggcttcgagccgtgttccgcatcatcagccacttcaccgacgcagctgatgccatgtgctgccaacctcgctgcgaggtcactcagggcgagctcaacgacgttggcaagttcgtcgagtggcacgccgagctctggggacgcctcgccgatcggcttatagaggaggccagcaatcgcatcccagccgatcaggacgaggccgaggatcgcctcaagatcctgatggagcgggcgctcatcgattgcgagtacagcttcctcgctgaggctgtgcatggcctgcgcatgatggcgtcctga

SEQ ID NO: 9020 - DNA, 504 bp, Methylobacterium sp.
atgtccgatgagttcggagctatgttcgaccgcgtgcagcaggagcgcgtggacgcggcgaagaaggagcgggaggcggcagacgaagctcggtcgcaggcccggcgggacttcgacatgaaggctgcgtgcttgacgaatgtcgtgctgccgacgcttgaggaagctaaggcgggcttcgcgaataaagggttagaagtccggtttgtgaccaacgcaactgcgcccaacgtcgccaactatgtagacccgacggtgcgatttcacttcgcaaagccgcagggcagcacccttgcgctcaatgttgacgccagcgtgatctatactattaccgtcacgcacacgcagggcggcgtacagattcatcgcgagagtaagaaccaccatcagaccatcacgcgcagcgacctgagcaagcagttcggcgttggtgtggccgaccagctgacgcgcgatcaggtcatgaaggtgatcgagtcggcatttcgcgacgctacccgctaa

SEQ ID NO: 9021 - DNA, 207 bp, Methylobacterium sp.
atggcggcagtcaacgtctgcaaagcgaacatcacgcaggagaacaagaaggttctctacgcgaagatgcttcgttcatatgagacgccctctcaagtcgcctacagcgtcggcgtcgaggtgagcgccttgaacaagatgccggctgcggaccgggaagccatgtgcacggccatcaacgatcggatcaaggccggcatcgagtag

SEQ ID NO: 9022 - DNA, 276 bp, Methylobacterium sp.
atgggcaacacggccggcaccgtcgagagcgtcgcggatctggggccctactggcgcgctgcgctccgggcagcgtcgcagcatgtggacgagcaggttgccggcacggcgatgctgctcacggccgtgcaacggctcaaggccggcatgggcgtagagggtgccgccaacttcctggagatcctgtcccgcgccgtgcgcgacggcgagatggtctccatcgcgatcggcgacgtgacgctgaacctgaaggacgacggggtgcggacgcagtag

SEQ ID NO: 9023 - DNA, 2589 bp, Methylobacterium sp.
atggcggccggcctgaagaaggccgccgatcaggccgacgcgctcacccggctctcggccaagggcggcacgggcaagcttgccgccgacctgcgcaacctcggcgcctccgcctcgcagatcgacgccgtgaccgccgcgatgaagcggtacgcggcgcagaatatgatcccggccaaccgcgccgactggaccaaggtccaggcgagccagatgcggacctgggagcagagcactgtcgccagcctcaagcacgtcatcgcggccgagcgcgaggcggcgcgggccgctcaggacttcgcctccgcgcagctcgccgccgcggtgaaggcgggcgaggcctcccggaagcagcggcaggccgcgctggagcaggccaaggcgcaccgcgaggcgatccgcgagcgccgccgggacgcggccgccaccatcgcctccggtgccgccgtcatggccgcgcacaagggcaagaagatcggcctcgatgcggtcagctcggccgcctccttcgacatcgccgtgcgcaagcagcgcgagttcaccgacatcagcgcccagatccaggccgggttgctggcgcaggccaagcgcgtcgggcaggagacccagttcagcaacgaggatgtggtcaaggcgcagaccgcctcgatgcagggcctgccagcgaacttcacccccgagctacgggccgccgtcgccgagggcatcgtcgacaacgtgcgcaacttcgcgaccctgatggagaccgacctgaaggagggcgcggagatcatccgcggctacctccagcagtccggcaaggatatctcgaccaagcagaaggcgctcgccgaggcgaaccgcgccaccaaccagctcgtgaagatggccaagctcggcggcatgtcgggcgaggacgtgggccagttcgtgaagctcgccatgtcgtcgggcaccaccgcggggctgacgacggacagcctcatgtccctggcggcgctggccaagcgcggcggcctgcgaggcgacgaggcgggcaccttcgtgaagacctcggccggcaagctggtcagcccgacgaagaagggtctggccgccttcaacgcggccggtgtcgagcattcccgcttcgtgaagatgccggaccgcctcagcacctcggcgctcgaggggcagttccggatggagatgggcaagggcttcacgcccggcatccggaagcgcctggacgcgatcaacggcgacaagaccctgctggcggatcagagccggtatatcgcggccgtcacctccgccgtcgagccgatcctgggcaagaagaagaacggccaggtccgggcctcggaccggcaggtcgccgcgaaggcggccgggaactaccacaaggtggccgcccagagcgtcgacgtggaaggcctgctcgacgcgctgatgaaggccaacccgacgctggcccagctcaacgcgatcttcacgggcgcgcacggcggcaagggcgcgatcacgcagcggcagtgggacgagttcaaggcttcccgcgaggagatccacaagagcggcgacgatccggattacgctgccaagaaggcccgcgaggtgatggctggcttgggcgggtcgatcgagaacctgaagggctcgttcgacaacctcgtgctctcgatcggcaccgcgaacgaggggcttatcaagttctccgccgacagccttgggaacctggtcgacaagttctccaagctcgatcagggcacgcagcaagcgctcagcctgggcgcgggcggcgcggcgctggcgggcggggcttacggtgccttcaacctgaccaaggcccttctcggcttcgggacgtccagtgccgccctcaccggatcggccgcggcactcgacgcctccgccgccgccctgaccgcagcggccgcgaagttggcgggcggcagcgccgtcggcgatctggccggcggggcaacgaagggcaaggcaggtgccgccgggcgtctcgccaagatgggtccgcttggcttccttggctgggctggcgtcggcgcgggcgcgatgatcggcaccggcctgctgcttgattccttcgatgagcaccggcaccgaggcaacggctaccgcggcgactcgcggcggcgtgccccgacgctcggcctcgacacgctccctcagggatggggcgccggtggggtcgacgtgtcgaagggcctcgggggcggggtgggtccctacacgaccaaccgggagaagacctggggcgagtggttcttcggccggccgacgcatcgcggcgggtccgacccgacccgcatgaccctgccgctgccggcaggcatgcagggcggggccgccgcgccgactgtggcgccgaagaccgacacgaccgcgttccaggccttggagcagaagatgggcgaggtgaaggacaaggccagcgaactcaacggcatgtccatcgcgatcccggccagttcgagcggtctcggcacgatcattcagcagatggaacggatcatcagcctgggtccgcaggtcaacgccgtcatgaacgcgggcgccggcaatactggtaaggtcgctcagaccctgcagaacatgcgcacgactgcatag

SEQ ID NO: 9024 - DNA, 87 bp, Methylobacterium sp.
atggcagagctcgacgcgatgccatgggacgagttctgcgccgagtggatcgaggctgagagcgtgagccggcagcatggcaactag

SEQ ID NO: 9025 - DNA, 513 bp, Methylobacterium sp.
atgccgcgcagcaagccgctcggctggccgaagctgatggtggcgcgccgcctcgcgggcggcgccacgggctactattgggggccgccgacgtgggcgatgaaggccggatgcacggttggccgggaagcgctcggcacggactatgccgaggcgaagcgccgatgcgatgacgtgctcaacccgcagttcgatgcgtggcgaacgcgggacgagggccgcaccttcgacgcggtgacggtcaagcgcctcaccgtggccgaggtccgcgcgctcaccgccgcccagcgcgcggctgaggagaaggacccggacgcctcgctgcccttcccgatcttcgtggacgacgagggtgcgccgatcccgcagacggtgatggacgccatgctcgacgacgacatggtggcgctggagcgtgcggccgacgatttttttcccgcccggttccgggcgagccccgccgcttcgtccccggcctctggcgccgataccgggcagacatccgacgcgtga

SEQ ID NO: 9026 - DNA, 183 bp, Methylobacterium sp.
atgtccgaggcccgtgccttcgtagcgacgagatcggtcttcggtctgggcccaatcgatttcggcatgttcatgtcgtctccgcttcgctgtggtgcgaaacgcctaagcttgagggcggatatgtggcgcaggttgtacatccggctaggcatgctgggggtgcagcatgagtggacctga

SEQ ID NO: 9027 - DNA, 96 bp, Methylobacterium sp.
gtgcccctgctcgaagccctgatcctcgtcaccccgctgtgcgtgggctgtaccttctgggtcgctggccgcatctacacgggggagggctactga

SEQ ID NO: 9028 - DNA, 165 bp, Methylobacterium sp.
atgggctcgctcctcgccatgatcgtaggcgttgtcaccttcactgccgagacgggcgtggaagttgtcagggtagctcttgttcatccgatccttcagcagggcggacgcggcgttgtatttttgctcgaagtcacggccagggtaagggccgcgccccgatga

SEQ ID NO: 9029 - DNA, 243 bp, Methylobacterium sp.
gtgaccgcgcccgacaacgagcgtcggcgtctcgccgcagagtacctgcgtggccgcaagctggaagaggccctggccgcgtggcgctcggactacgacgcgccgacctactgggagcgacggccacagctcgcccggctcagcaacgtgatccggcggctcgctgacgaggccgtggcgcaagatgatgaggcggccgaccgcccccggggcagcgggcacgaaaatacccgccgcggctga

SEQ ID NO: 9030 - DNA, 96 bp, Methylobacterium sp.
atgttcgcccgccgcacacgcctgagcctcgccatcgcgatcggctcgaccctcatgctgacgaccgtcgcggccgtggcgttgtgcatgccgtga

SEQ ID NO: 9031 - DNA, 279 bp, Methylobacterium sp.
atgtaccgccgtcgtctctcagagcagcagttcgcggacgagcttgaagatctagaggtcacgcatcgtcagagcgttgggtccgctcacatcatcgcgggcgagagcccaagccgtggtgccctcatgctgatccagaccatcaacgccttcgcggcgatgtacgaactgccagagggcgacgagcccgactacgagccctcgccggcagaggtacaggctcaccgtgagcgtctgttcgcattcgtggctggtctggaagccgagctgcgtccttga

SEQ ID NO: 9032 - DNA, 387 bp, Methylobacterium sp.
ttggggcccgtcgagtgggcgcgcctgtccccggaggcgttcgctgccgagaggtcggccttcggcgcgtggctcgccatcgacggccccatgcagcgccagtaccggaggcgggcacgcgcctacgtcgctgcgcgcaaggtggtcttggagatgcggatgaacgatgtcgagttgttgccggtcgagttcggccgccgcgtgtccccgttcctcgaagcgccgatcgatcgttcgcagggccggcagcttctgaagcagtcgctggccctcgagtgcgagggtgggccctggccggcggtgacagcgagcgcggaaccctctcggcaggcggagtgggaggctaactatcaggaaaatcaggcgaaagcggctggccggacgtga

SEQ ID NO: 9033 - DNA, 339 bp, Methylobacterium sp.
atggcgacgatccgcggcctgatcttcgcggcgctcaagggcgtcgagccggacagcaagcgggcgctcgccatcgccgactatctggcgaccgagtaccgccgccacccgcaggcccagcacatctacagcctgcggctagagggcccgccccggctgctgccgccgacggtctcgaaggtcacgcacggcgagcacctctgggtgagcattacccataccccgcgccgcgatccgacggtaatcgccgagcgggcgatcttcaggtcggcccaggagttcgcagcccacctccactacggcgttcggaaagcgcgcatgcgcaaaggtggggcttga

SEQ ID NO: 9034 - DNA, 264 bp, Methylobacterium sp.
ttggcgctcgccgccctcatcggtgccgcgacgccggcccacgcggtcgatcgcaacgagacgatggccctaatgatggcggtcgccaccttcaacgagaaaaactgcccgggcatccagcccaaccggcagttcatcgccgacacgttcaatgagttcggggtcaagaccgagaacatggcccgccagccctatctcggcacgatcatcagcaccctcaacgccttcgagtccaacaagccatacttctgcgaatcaaactga

SEQ ID NO: 9035 - DNA, 351 bp, Methylobacterium sp.
atgagcgaaagtgacgacgccttcaccaacgagcagttgaccgaactggcgcttatgcaggcggagagtacagcgcaggtcgggaaggcgttggaggcaacggcccatcaggcccttgcggggctggtgatgaacgcgctcctgctgcatgaactggagcgtctcggcttcgtggactgcgaggccctgagagccgaggctgtacagcgggctctgtcgatccagcctccgcaggtgggcgccagcgtcgccagggtcattcagaccatctttgacgggaagcccccggccgcttggtcgggcgcagatctcacttccgtcaacgacgacttaccggacgcgaagcactga

SEQ ID NO: 9036 - DNA, 267 bp, Methylobacterium sp.
atgtgcgggcactgcctgcgcgtcgacgccgccgtcgccttgggcttgctccttgcttcgtccgtcgcggccctggacgcctcggcgacgctgtgccgggcgttcgcccgcgagcgctgcgcatgctgccatgcggtcgactcccgcggggcgagcctcacacgcgagaccccgcccttccacttgttggccccacgcttccccatcgacgacatcgccgacgtcctagtcggggggaacgggccgccggcatgccgctatgcctga

SEQ ID NO: 9037 - DNA, 171 bp, Methylobacterium sp.
atgcccgaacgtccccacgtcgcgtccaggccgttacgcccggaggaccgcagcttcctgtcgagccccttggcggacgggagcggaaagccggacgaccagggcgtccccctggcggtctcggtcctcgtcatcgcggtggtcctgctcatcgtgagcgccatgggctga

SEQ ID NO: 9038 - DNA, 108 bp, Methylobacterium sp.
atggtgaaggcggcctcggccacgaggtggctcgcgaacccgccgtcgcgcgtgcagccggtgaagccgggcgcatcgcagaggttctcccagccggtctcgcagtag

SEQ ID NO: 9039 - DNA, 234 bp, Methylobacterium sp.
atggccgtgacggactgcagggtcgtgggtccagtcctggtgatgacgggtgtctcgcctcggtacggcgagatggtccttgtgcagagcttcgacgacctgtctgcaatttacgagcggcccgagggcgacgagcccaactacgaatcgcccgaagccggcgaagcgcaccgcgaaatgctcgctcggcttctagctgagttcgcagatccactcccggcccccgtcgggtag

SEQ ID NO: 9040 - DNA, 387 bp, Methylobacterium sp.
ttggacctgggtggcggtgagatctggcaggcagtcgccgagcctgcagagatgaccggcgaccaaggcgtccaagtgacgatcacggcgcaagtcaatgcccccgtgacggtcgggcggctcgcgtccgtcgtcaacgaggcggtgcgggacgaggagggcccgcgcggcgagggcctccatctcgatctgcacgggatgcgacaggtcgaggacgaggatctcgcccgggccgacgctgtcgacctgatctccgtcgacacggcgggcgcggccgtggagcggggtccagagcacgagatggtcgagcgcttgcgccctagcctgctccggggtgcctatcgcgcgtcaagcctcatgcggctctgtgcacatggtcgaaggtga

SEQ ID NO: 9041 - DNA, 360 bp, Methylobacterium sp.
gtgcgccgctacatcgagagcaacctcgccacggtcgatgcgccgacgctgatgagccgcttcggcctgtcgcgcacgccgctctatcagctgttctccgaatgcggcggtctctacgcctacatccgccagcgtcggctcgccgaggcgatgcggcggctgcggcaggtgcccgcgggccggcggccggagctggcccggctcgctcacgcctgcggcttccacaaccagacggtcttcgcccgcgcctttcggcgccgctacggtctcaaccccagcgaggtcgcgatcggtgagctcgtgcccgctggcgtgaacgctgccgatccgaccctgctcgcctggctccgtgagctgtga

SEQ ID NO: 9042 - DNA, 402 bp, Methylobacterium sp.
atgcaggaaatcgatctcggaaagatcggtcaatggattgtcgggaacggtccgttcgatggtcagtgggccccaaccgatttcacggccgccgaggggcgctacccgtgcgcccaaaccggcggcgaggatctgggcgccgaggcagattcccaatgtagcgcgatcaaggagggcacgtttgcgaacggcttccgtctcacccgccatgaaggtaagtcggtgatctcccacatcgtaaggaccaccaagtacgaccagcagatcggggcttacggcatcgaagaggtcgaagttggcggttacggcatccagatagctgacgtcgtatccatgcttcagcagcagtggctcgagaacgccgagatcctgataagaggcatgcctgatcgcaacgactga

SEQ ID NO: 9043 - DNA, 171 bp, Methylobacterium sp.
atgtgggcgatgggtttcgtggtcgagggcgcgcactattacacctacgtactgccgtgccccttctcgaactcgagatccttgcgcgacgcggctttcgcggcgcggagcatgctgaagaccgctgccatgcggtccaacagggaaatgactgccaccgacttcggttga

SEQ ID NO: 9044 - DNA, 1893 bp, Methylobacterium sp.
atgaaaatcgtgatcctcgacagccttcccgatgacctgctcaccgttttgctggccgacaatgtcgtctaccggcctgatctacggcttaaaggatcgaaagcgcaggtggaagcactgcactggctgaaggctgacgccgtcgtctgcaccagcgaattggatcctgccgggctgtccgcctggcggccgggagcctgcaaggatgtggcctgcttggatctcgacgtcgggcgttcgggcacggcggtggagatcgaggaggtggaacctgggttgtggcggacgacggtccgctgcggcgatctccgcagtggatatatccgggccttcgagacgctcgaacacctctccctcacgcgcatggtcgcgaatgaaacgccgatccccagaagctccaaaattctcgcccgacgagacgtggtactggttggcgccggattggtgaacctagtcacggcgtatcaactctccagatccggatggatcgtacgggtcatcgatgccgcgccggacccatcgacggaggcgccctggctcagtttcggatgcagccgaggtggcgatgacgcgcggatgttcaccctgtccgagatggacaactacaatgaccgggcgttgtccctcaacatgaacagctactttagcaaggacgtagcttcgctggggtgggctgcatcgcggattggaagcttctctcagtccgagaacgattggatatccgactacgagtccgttcccatctggctcgcagaccgctacaatgatgacatctttgcgttcacgcgcgacagcagaaaccgctgggaccgctggatccgcgacgagccagatctattctccagttgcgaaacacgctccggcatcttgcgagtctactcagacccggatcatttccgatctgcggtcgcacgacaggaacgtatcggggcggtgatgcaggtctactcacccgatgaggtagccgtcttcgagccagccttgcgggcccccgcggcatccggcgcgatcgctggcggcatcctcgtcgtcggtttcaccgtgaacgcacataagttcatggcgcagttgatttcccgcatgatcgatctcggcgtgagcttcgagtgggaaaccaaagttcgagccgttctgaccgacgagacgggatgcgtctggggactggactgcggcgaaaagacggtcgaagcttccaacttcgtggtttctccaggagcctacgctggcgaactcctgaacggaacgcggtgctcgggccgcatccacggcgttctgggagcgtggctacgcttgccgaatatcgagccacggttggagcacagcctcaagctcgcgagaagaggtcacgtcaccgaagacgccaacgtcacggtcgcgaccgacgtccacggtcgtcccatcatgatcatcggctccggctatgggcatacgggcatcgacccgacgaatgtcgacgaaggatttctgcgaaggatatacaacgggctgaccgacacggcgcaaacgtatttcccggaggcttacgcggcctgcaaggatggcggctcgatcgaagcgagcttgaagtactgcgtgcgtccttggacgtccaatggtctgggcttgttcgagattcgtcccgttcagggcggcggcaagttcgtcgtcacgggtggccacaacactgggggatttgcccagtcgccgacgatctcggacgccgtggcggctgccctggccggtacccaacacgatatgcacatcctgtatcatcccgatcgcggcatcagcttcctcgaaagagtccgctccagagactggtgctcgaccatgagttcgatcggcacacccgataaggcggtcgagccgtcacatctctgggatgccgtcgtccgcgacgtcgcgctttcgtag

SEQ ID NO: 9045 - DNA, 243 bp, Methylobacterium sp.
atgcgtaagtccttctattcacacacatcccgccgcattgcgcgccgctcggccgaacccggccgcgcggacgggcgacatgcacctggcgcgcgaacgcgtatcgcgcgtcgtcgcacctgtgggatcgatgcacagcccgcgatcctccttgacctgacagaccagccggcggtgctgggcccggagatcgaggcgatcgagcagcatcccgccagcctcgtcgacgacctgctcgactga

SEQ ID NO: 9046 - DNA, 651 bp, Methylobacterium sp.
atgtcccttcggtacctcgacgacggcgtcggcctcgacgggacgttcgtgcttggcttcaggatcaccgacgaacccgccgagaagtggtcggcccgcatgaatgccttcaagaacaaggagaaggcggcgcttttcggcgcggccgcgtgtttgaggacaggtgtgccgggcctcctcaaggccctgggactgccggcggatcggacgatgctgataccggccatctcctcccgcgacgaggtcgcgtcgccggaatcattcatttccatgcttgccgcggcggtcgcgaggtcggcgggcgcccgcttcgatgggcaagccgttcggaagaaggtccatcagccgctccatgggatcttcgccgcggcggggcggaccgccgaactggacaaggcgggctaccaggctgagccccgcgccggcatccgccacttcgtcgtggtcgacgatctcgtgacccgcggcggaaccatgtcgaggatggcgcaggcgctgaagggcgcgaaccccggcgccaccgttcacggcgtcgccctcgggaagacggagcgacgcgcctactgcgggccgaacctcgacaacggccacgtggatcagcactgggaggaggcttggcttcgcggcgaacggaaataccgtgagcggtag

SEQ ID NO: 9047 - DNA, 750 bp, Methylobacterium sp.
atgcgcgtttgcctacaccttcccggacggacaaggatcaccgtcgagcaggccctccaggagtacggacccaatccgcccgtggacgtcttcgcctgccccgtttgcgacggcatcctgtcaatccgggcgcaagcggccctggcgagaacggcacacttcgcgcatgcccgcggcgccgattgcccgaccatcgatgccgccgcggccccgttcgaaaacctccgggcgctcgaccccgatcccgtggctcgcatccagcgacaggcaaggttccgcgcgaactggcgtcggcacttcctgcatctcggttccctggtccccgcgctcgccatcgaggagttcgtcgcccggctggatctgtccctcgaatggaacatctggtcctacgtgggactcaccgacgccgagatacccatcgtccttgcactcctggaccagttctcgcccgacgacgcgatgcaaacccataccgtgaggccccgcgaccactggtatcggttctgggtgagccatggcgcgggggccggagccgattggccctggccggagcagggcgcgaccatctcacgaggccgcttccggtaccgtggcaggggcgtcgccccggctggtgcggacttcatcgaccttgagattgtgccggtttcgggcgccttcctggaagggcccgagccaccgacgctacatgactatcgggagaacgcagtcaacgcctggtttgttaggcatccggccttcggtcgctga

SEQ ID NO: 9048 - DNA, 363 bp, Methylobacterium sp.
atggcacggcaactgctcttggccggtctgtggagcgggtccgccccggtctgcgccatcgacgcgccaatagatctcccggcgatgagggaacgcctcacgcgcttccgcgaatgcgaattcgcggaacggaaccgttggctggcttggccggtcgacgaccggccggaacccggtcgggacggtgtggccgtaacgcccggcctccgggtctgggcctgcgacgaggtggaggtcgacccgtacgcggcggctgcggggcggcctttcgacgccgagttaacgctcagcgacgatgtctcgctgggacgcgccgccgtcgtgttgttgggcctgctcagcgaccgaaggccggatgcctaa

SEQ ID NO: 9049 - DNA, 294 bp, Methylobacterium sp.
atgatggccctgctgcgtgcttggtctcaacgcaggttggatcgggaccggctggtccaggctgacgccagttcgctcgtcgagcggttcggcgaaggcgcctacgacgtcgcgcgcggccgtgtcgtcgagccccgccgagggaccgtcctcgacccggcccggccgactgggcactggacccgcgtcaagcttcggatagccgagatgtctggacgggagatcggcttggataccgcgacccggatggcgatgcgggggtctcatcttgaaaagggtgggggtcggtggtga

SEQ ID NO: 9050 - DNA, 120 bp, Methylobacterium sp.
atggtgggccgctcgcgaaaggtcgtctcggacgtcgtcctgaacgccgtcccgccggcggtcgaccgccttgccgtttcggggcggatcgtgtcaggcgccgtccctgtcgccacctag

SEQ ID NO: 9051 - DNA, 99 bp, Methylobacterium sp.
atgtcgagtagcccgcccatcccggacaggacgaggattgatgccgtggccgagaacgagagcgtgacgtcgatccttgagggtctggaggagccggcg

SEQ ID NO: 9052 - DNA, 432 bp, Methylobacterium sp.
atgaacgacaacagcaccgccttcatcgcgaccgccgccggcctcgtctcggcctacgtctcgaacaaccacgtccaggcgggcgaactgcccgggctgctcgccagcgtgcacggggcgctcgtcgggctcgcgcagcccgcgccggccccggaggcgccggccgagccgctgagcgcggcgcaggtgaagaagtcgatcaccgacgacggcctggtcagcttcatcgacggcaagccgtaccagacgctgaagcggcacctcacgcggcacggcctgaccccggagcagtaccgagcgcggttcggcctccccgcgaactacccgatgactgcaccggcctacggcgcgcggcggtccgagctcgcgaaggccatgggcctcgggcagatcggccggggtgcgcaggtgcagcagcaggcggcggagtag

SEQ ID NO: 9053 - DNA, 249 bp, Methylobacterium sp.
gtgatcggcgacatgcagctccatgccagcccgctcatgaccgaactcatcgaggactggacggaggtgcgctcgccgggtcgcgctgctcgccgccgccggcagggccatcggcagcgcatccgctatgtcgatcgcccgaagcagcaggtgatcgtcttcgggaataggatcatcgcgcatcccgatatcattgagcggctgcgggctcagatcccggagcggtcaccccttcacaggctgttttga

SEQ ID NO: 9054 - DNA, 237 bp, Methylobacterium sp.
atggcatggatccagctcacacaggcgagcggtgggcgtaagacctacgtaaacacggacctgatctatcaggtgacccaggccggtaagacgcggttgcatgtggctgtcgctgccaaagcagatgactccacaccgctctggcctatgcatatcgaagttgccgagagcattgagcaggtgatggagatgatgcacggcgctggcgagaaggtggtcagccgcctcggttcttga

SEQ ID NO: 9055 - DNA, 93 bp, Methylobacterium sp.
atgatgcgcctcgtccatcccggctggctcgccacgctgacgccggcccagatcgagctcttcttctccgcctgctcgcccacggtgcactga

SEQ ID NO: 9056 - DNA, 546 bp, Methylobacterium sp.
atggatcgcgccctcaccttcatcggcaccatcggcacggctttgagcttcctgcctggactctccgaccccgtgagatgggtgatcttcgcctccggcatgacgatcgggttgggcggtctcgcgcacatggcgtgggagagacgactggcgttcgcaggttggcttgatcgccggatgccaggacggctcgtcgcgcctccggccgtcgaaactgagcacgagtttacctcgctctacgaggtaacgaggcaggcctacgagcgcacacggagtaccttcctcggtaatgcggctgaccgtctatcaaacgacagcccactactctggtacgtccatttgcttgatgaccattttccggtcttcggaactcatccgccctcgcggatcatggaacgcttcgacgaggtcggcttcgaatacgaggtcgtcggcgagatgatcatcgcggttgagcagttcggctctcgccgctgggagaacctatcgctacgggcgagcgatgtgccggaagccctcaagtatgttcaggatcgcgccgagtag

SEQ ID NO: 9057 - DNA, 420 bp, Methylobacterium sp.
atgcgcgcggtctggttcggtctcctcggtgcggtgctggcggcgggggcggcgcaggcgaaggcctgcgacctgcagggggcagagctgacggcggacgatgggcggactttccgcgtcgtgcgcatcagcagccatttcgaccgcataaagagcccgaaggtcaacgacctgaaggcagacggctatgtcctcgctgtgattgagggtgctgggcagaagttcgtcctaagccagacctacagcggctggggcatgcccaacaatgccgctcgctcctatgaatacgaagaagacagggcggccaagattggctccgagcgtgcgcgccgagccgagcgagcccgagttgatggcacctttgatgtcctgactggacctctggagggtgtttctctgcgaccaacgcgctgtagctag

SEQ ID NO: 9058 - DNA, 1908 bp, Methylobacterium sp.
atgggccccggccagggccggccgggcctcatcgacctcttggcgaacggcgccggtgcggttgggagaggcatcacaggcctgttcggcggcggcgacgcaggcggcagcttccctgaaagcctgcccgccgaaggcacggacgggtttggagcacccggctacggccccggggatgccctcggctacggcaacggctccttcggcggcttcacgggcacgatggagaccggcggcggccgcggcttcaccggcatgaatgcgggcggcggggtcggacttgggtccttcggatcgggcatcacccaacctggcccggctccggatctttacggcttcaccggcatgaacccgtcgcagggcgtcgggcccggcacgctgggccaactcccggccggcttcgatccggcagcctatctccgggccaacaccgacgtcgcggcggccggcatcgacccggtccagcactacctcaacttcggcatgcaggaagggcgcgcgatcacgcccgagggctggacgcagacgcagggtccacccgcgctgacgccaaccagcggaggcggggccgcggcgcccacgatcggcggcggtcagcccacgtccaccatcggcgcaccgcaggcggtgaacggcctgccgccgggctttgacgcgcaaacctatctggcacttaaccctgacgtggccgctgccggtctcgatgcaggcacgcactaccgagcgttcggagcgcaagaggggcgtgcttatgcacctccgggcggcacctcgacgctcgggccacccgcatcgagcccgaccatcggtccggatggctcggtgagcgtcgtatccacgggcctcgtgccgacacagggcccgccggccaccacgccgacgcaagggcccggcccgacgatcacggcgcgcaccggcaccttcaaccccgctgaatatctggcggcgaacggcgacgtggcggcttccggccagagcgcactcgaccacttccggaactacggcctgaaggagggccgggcgatcgacacgctcggcaatcacttcaacgggcaggcctacctcgcggccaaccaggatgtggccatggccgggatggatccggttgagcacttcctgaagtacggcgcgcaggaagcccgcaccctggcgccgaccgactggacctcgccgctcacggccacgaccaacatcggcaccatcggtgcgcccgcggccacgccgaccatcgggcccgccggcaccacgccaacgatcggcgccccagccctgacgccgacctatgccccgcccgcggccacgccgacgatcggcgccggcagcgccgtgccgacactagggcccggcttcactcagccgagttggtcgcccggcggcggcatcagcaatcccttcggtttctcgggagcgaatgtgggtagcgcgctcggcgccacgccgcagaccttcgcctcggcctacccgctggatacgaacatcgggtacagctccggcggctcgccaggcggcggcggcatctccgactttgggttctccggtgctgacgtgagcgggttcgacgtgaacgcggcggctccgtctgcgggcaccgaagcctattccggtcctggcgcaacggttgacggtccccggaccggaacaggcaagggctcgtcgtcctcggctgccttcctcgctgatcaggctcgcacccgggcctattgggacacccttgcgaagccggcgagcctctacggctacaccaacacgtctactccgccgatcgccgccgcccccgtggtcccgaacctgacgctgacaaacctcaacgccgcgaacgccggcatgggcggcgcgatgctcggcagcggtctaaacctgtcgatcaattccagaccgctcgcgggcgggttcggcttcggcttctag

SEQ ID NO: 9059 - DNA, 276 bp, Methylobacterium sp.
atgtcggcgaacgctgccggcacgcccgcgcctcccggcaacagctcgcacaggacgaacgcgagcgcctcgaggcgcgccgacacgccggcccgtacggcttcggggaacgatcccgacgagaacgaggccgtcgagatcgtcgttcaggacgaggccgaccgaccgagaccgcatatgggcccgtacatgggcccgtacatgggcccgtacatgggcccgtacatgggcccgtacacgggtccgtcccggccgacttcgccgccgcggccgtga

SEQ ID NO: 9060 - DNA, 246 bp, Methylobacterium sp.
atgaccatctccgaactgatcgctcagcttcgcgcggccggcgccaccatcgaggtcatcgagatcgcggtgcgctcgctggaggccgccatggaggccgagcggaccaaggaagccgaccggaaggccaagcaggcagcccgggtccggaagcaccgggacacccgcaaggggggcattaccgtaacgttaccgtcacgcgacggtaattcaccccctgacccctccccggatggtccgccccct

SEQ ID NO: 9061 - DNA, 435 bp, Methylobacterium sp.
atgatgcacggtgaagagcaggcgaaggcgttcgcacaccacaacgtgtccgcccggatggcggcgagcgggggcgccctcctcggcaataccactgcgacggccgccaatcagctcggcggtgagggttcgcgtccgtccctgcgtaccgcgatcgagaacgcgtacaccgcccagaagcgcctcgacgagacgcattcctacgtgtcgagcctcgccgactcggccgaagcgctcgcgcagcgcatcagcgggccgtacccgaccgaggccagccccaagacgacggacagtgctcagagagccgccccgcagtccaccgtccaggcggtgaaccacgccctcgacagcgtgcacggcagcatctccagcctcggcagcccgatcgaacgcctctcgcgcgccctcggcgtgatcgagcgcgccgtcggctga

SEQ ID NO: 9062 - DNA, 384 bp, Methylobacterium sp.
atgtccacgtccctcgcccgcgccgcacgcgcggtcaccatcgccgcgtccgacgctcgcgccgaggcggcgcgcacggatcacctcgtgcacgtggcccgggagcacgccggcaaggacatgtgcggcctggccgaggccgtgcgcgaccacgctgagggcgtgagtgaggcggccgcctgggtggcgcgctgcgctgtactggaaggcctgcccgaactggtcgccgcgatcgaggcgggcgctgacgtgtgggtcgatggcgctccgctgtccgctgggtcgattgtcgttcgcccggatgcggatcgtgccggcctgctgccgacgctgaaggcgtgggcgcggcgcgggcgtggcctgctttcgcgcagggccgcctag

SEQ ID NO: 9063 - DNA, 168 bp, Methylobacterium sp.
gtgagcgcccgcccgcacttccgcgtgctgctgcgcgtgcgctggaagctcagcggcgcgacgtggctctggctggtcgaccgcgacgggagcctcctgctgctcgaggctgcccgccggacggctggcggttcgcttctcgtccggttcgcggagccgcttcggtga

SEQ ID NO: 9064 - DNA, 126 bp, Methylobacterium sp.
atgcgcgaactcctcacgctcatcgtgttcgtgctcttcctcggcgtcctgcacgtcgtcgcgaccgcaaagcgcgaagcctcactggggcggctcccggtgctgcacctccggagcgagccgtga

SEQ ID NO: 9065 - DNA, 237 bp, Methylobacterium sp.
atggcggatacgacagagccggatctcgctgcgcgcgtcgcggcaatcgaactgatcctgaaaggatggatcgcggtgtccgagagtgcgacgggcaagatctcggggccgattcgcgctgggatcgacgatgggctcgcagaggcgctggggcacggcacggcagatcccgagcgcgtgaagcagctgcaaacggcggtcgatctgttcttctcaggcatcccgaaggccccctga

SEQ ID NO: 9066 - DNA, 261 bp, Methylobacterium sp.
atggacacgtttcgcgacctcattgccgggtacggcctgagcgatttcgctgctgacatcggcgttcaggagaacaccgcgaagcagatgcggaagcgcgactccgtcgcccctgaatactgggatgcctgggttaagggggccgccgagcggaacctcccaggcatcacgtacgaacgcctcgcgaagattgccgccaacaagcgggtcgtcgcgcaggctgccaacaccgacgccaccgacccgcagagggccgcgtga

SEQ ID NO: 9067 - DNA, 114 bp, Methylobacterium sp.
atgtcaccgctcgccgccgaacttcaaaccctcgccttctacggcctcgccgccctgaccgtcctcggcgccctctgggtcgccggccgcgtcgtcaccggggagggctgctga

SEQ ID NO: 9068 - DNA, 150 bp, Methylobacterium sp.
gtgcgcctgcacgaccgcggcggcgatatcttcgccgtcggctcgatgccgctggcgaccgccgagcgcttcatcgagcagctacaggggcacgtcgcggcggcgaagaagcagggcctgtctgtgatccggtgcgagggctcggcatga

SEQ ID NO: 9069 - DNA, 228 bp, Methylobacterium sp.
atgagtgattgcattcgggagtgggtggatctcacgccagagttcgaggtggcgctcgaggacgcctgcatcgcgaccgagcttcttgctgcagtcattgacgaagaaaccagcggcaacaccgccgcgcagcgtgagttcgctaacgcagcaatgaccgatctgatcgaggcgcttcgcgacgtagaaccctgcgaagagaaagcccgccttgccctaagggggtga

SEQ ID NO: 9070 - DNA, 279 bp, Methylobacterium sp.
atgccgcgggagaagaagacgctgagcgaactcgaggagatgctcctcgcgaggttgcgcgaactgccgaacggcgaactcgtcgagggagtgaacatcgtgctgtcggatcgcgaggacggcgatccgggcgtcggtgtcttttggagcgaaaccagcgcgaccatgcgcccgctggttggtcacgcaatcgcgtacggtagcgtgctggtccggcaataccaggtcatagacgacccgaacgatgaggcgctgccccacgcgaccagctctgtctga

SEQ ID NO: 9071 - DNA, 144 bp, Methylobacterium sp.
atggccgaaccgccgcgcgcaccccctgccggcctgtccgggatcgaccgcgacggcgcgcgacgccggtcgaaacttctgcgcgcactgctgctgttggcaaccctcgccgctgtcgcctggatcgccttccatctgcgctga

SEQ ID NO: 9072 - DNA, 183 bp, Methylobacterium sp.
ttgaagtcggtgatgcagatgttccagcacccttcggccgcccacctatctgccagcaccatcgcgctgccggcattcacgcgtgtggctccgcgcaaaccggccaccgatgaagccgagatcgtgaagcgcgcaattccgctgaccattgtcgacgctcacgaatgcaagggcgacaactga

SEQ ID NO: 9073 - DNA, 216 bp, Methylobacterium sp.
atggtaggatcggcggaagagcggctcgatgccctgaaccgggaaatcgcagacttggagttgaagcgggatgctcatgtctcgatcatcgcggctttgacggatcaggggctggacaccgctgcggccaaggccgtgcttcagaggattgaggatcagctcgcggcgcttcgggtccgcacagcaaccttcgagggtgacgcgagacacatttga

SEQ ID NO: 9074 - DNA, 255 bp, Methylobacterium sp.
ttggctgtcgagcaccacgtaacccaggctgacatcctgcacctggcgctgaagctcgctcgcaaggccttcctggagcgggcgccgcagcctccccgcagcgcctcaccggtgccagtcgctactggcgcagccctcatcgccatcgccgaacagctcgtcgagctgcaggaagatgcgcgcatgagtgcggcagacgctgaggctcatgccatggctccattcggcaccgatgccttcgaggtgcggccgtga

SEQ ID NO: 9075 - DNA, 1134 bp, Methylobacterium sp.
atgagctttgagaccttccgcaccaccttcccggcccttgtcgagcagcgccttgctcagatctcgctcgatcctgatggaagtggcggcgacatcctggtggccggtgccttgtacaagatggctgcagcagtctcgaagacttcactccagggcgtagcgtccaccgcacttctgtcgagcatgtccgccagccagctgcaggcgtggctccaggcgcctgagaacgtcacggtcttcatctcggccatcagcaatcagggcaccatggcaacggtcgccaggagtcagtcggccatggccacgattgcgggctgtcccgctgctgtcgggctgatcctgggtagtgccaatgcggtggcgcaggtggcgctgagctatgtggcgatcctggccgtgcgcaaccagcctgccgccctggccgccttcgtcgccaacgcccaggcatcgcgcctgctcgcatccagccagatcgccatggacctgcttgcggccagcgccgccgccatgacgacgatcgccgccagctcgaccatgatggcggcgatcgtcgggagcggcgtggccatgacggcggtcttcgggtctgccgaagcggtcagcgtgctcgtgcagtacagccaggcaatgcaggccatggcggcgtccgccactgccatggcgcaggctgccgcgtccgccaccacgatggcggctatcctgggatcgagcacagccctggctgctgtgttcggcagttcgaccgcccgaaccgcgatccatgcatcgaccgtcgccgtggacgcgatccgcgacacgccagcagccatcgcctggctgcgagcgaacaagatgacgaccgccagcgtcaacatcggcggcaccaaccagagcgtgatcacccctgtgatggcgggggtatccaaggccatctcgctttcgatcaagtccggcggcatcagcagcgcctcagtgacctattcgctcaagaccaaaaccgctggctcgaccgaggcggcagtggtgccgctttcgccctcggcaaccaatacggtcgcggcctacaccagctttggggtgacctgcagcattaccatcccggcgaccaaaaacgagaactactaccccgtcatcgaattcgtggcgatggactga

SEQ ID NO: 9076 - DNA, 246 bp, Methylobacterium sp.
atggccgatctgggtgtctgcgtcgtatcgggcgtcgatgggatgacgtacgaggtcaacagccgcatcgatgcggacctgcgcgcgatcctccgcgaagcgcagccggacgatgggttccaggttgcgggctcgctgcgctgggccgacgtccgcgctggcggcaagacctatccgttgcgcgggctgactgccctggccgaggtcatcgccgagtacgccgagcgccgtgaggtgcaggcatga

SEQ ID NO: 9077 - DNA, 234 bp, Methylobacterium sp.
atgcctaacctcctcgaaggccatccagagttcacccgcgagctcatcaacgcggccaggcgcatcgccaaggcccacggccacaccatgcgcaagccgactgggcggatgagcctgcatgagtggggcatgggtttcttcaggctgaccgatgccgccggcaacattatcgccggccctcgacatgagctgacgccgcgcgctgtggcgaagttctacggggagaccctgtga

SEQ ID NO: 9078 - DNA, 186 bp, Methylobacterium sp.
gtggcaacccccaaccctaccgacttgaccacaccaggcacgctcgatgacgaggcgttcgtcgatgcgttctgcgcgattcctgaggctgtcgacggcctctggatgaacaacaacccttcacaggagcagctccagtccgagtacctggttggcgtcttggaagaggactgcggacatgcctaa

SEQ ID NO: 9079 - DNA, 111 bp, Methylobacterium sp.
gtgctcgcctacgccatcgacggcctcgtggcgcaaggcacggtgtacgagaagcagcaggcgctccggctggtgtcggacgcactcaccaagcgaggcatcatcgggtga

SEQ ID NO: 9080 - DNA, 648 bp, Methylobacterium sp.
atgaacctcgacaccgcccctgccgtcgcgaccgccgccctgccgcctacgcccgtgccgtgcctcgacccaaagcccggcctgatcctgctcgggcgcgacgagcgcggcaggccgcacgccagcgccttcggcctcgatgaagcgcccgcggccgaacgggccgccgcgttgatgggcttcgccaccctgatcgtggtcgaggagcatcaggggctggccagcagcctgcccaaggggcgggtcttcgagagcgggcgtgctttcgtgccgttctgctcgacccagaccttcgcccgactgctcgaagcggccgggctgcccgatgcgcccgtgcccgccagggccgctgccaagcccgctgagccgtctccgcccacggccggcagtcagggtggtggagcacctgccggaggcgatggcggggctgccaagccgcccttcggctgggccgacatcaccatcggcagcctcgtgctcgctcggggcgatgacgaggacggctactatgccgcgaccgtggcagccacgaaggcggacaaccacttcgtgctgacgtggcgcgactaccccgacctgcccgagtttagccgccaccgccacgccctcggcctcctgcaccccggcacgccgacgaagggcaagtag

SEQ ID NO: 9081 - DNA, 288 bp, Methylobacterium sp.
atgaaatttcgtccgctgcacgaccgcgtggttctccgtcgcatcgacggcgaggaaaagaccaagggcggcatcatcatccccgatacggtcaaggagaagccgcaagagggcgagatcgtagccgttgggcccggcgctcgtgacgaggcgggcaagatcaacgcgctcgacgtcaaggccggcgaccgcgtcctgttcagcaagtggtccggcaccgaggtcaagatcgacgatcaggagctcctgatcgtgaaggaatccgacatcctgggcgtcgtaggctag

SEQ ID NO: 9082 - DNA, 234 bp, Methylobacterium sp.
atggcggccgctgacgcgctcgttgctactttctcaaagcaaagcggcactcgcgaagagctcgcagggattatcaccgggctgatggatcagtaccgtatctcgcctgatcgggcgcacatgctcatcgaccgcttcggccgggctcagctggctctggagaatgctggagacgagctcatgacaaggaaacagggcgacagcgaaagacaacctagcctcatagcccagtga

SEQ ID NO: 9083 - DNA, 333 bp, Methylobacterium sp.
gtggccgaccaactccggcccaaggtgccgaggctggcggcgctgatggacgcggccgagaccgacgtcctggcgtacatgggcttcccagcggcacaccgggccaagctgcactcgaccaatcggctggagcgcctcaacggcgagatcaagcggcgcaccgaggtcgtcggcatcttccccgacgagccctcgatccgccgcctcgtcggcgcgatcctgctggagcagaacgacgaatgggccgtgcagcgttgccgctacatgaccctggaaagcatcgccccgatcggcgatgatcctctcgtcagcctgccaaacctcgcagtctga

SEQ ID NO: 9084 - DNA, 261 bp, Methylobacterium sp.
atgatggcggtcacctgcgcgacggtcgcggccgtcacgcccgtgccgccgtattcccgcggcacggtgatggcccagagcccggaggcggtgaagcgctcgatctccgcgaagggcagcgcccggtcgatgtcgcgcgcggcggccgtgccggcgaaatccgccgcgagggtccgggcagccgcgagagccgccgcatcgtcggcgagcaccggcaccgggcgcggcggctccggcgccacggtgaaggcgcgctcgtga

SEQ ID NO: 9085 - DNA, 150 bp, Methylobacterium sp.
gtgatcgaagttgtcgaggccgagatcgtaccggtcggcgagttccgcaccatggctgggcggcagcgtgagagttggtatgcggaagccatctacgccgtcgcgtacggtatccttatagccattccaatccgaaacgacgacaggtaa

SEQ ID NO: 9086 - DNA, 153 bp, Methylobacterium sp.
atggccaacgagccccagaagccgtcccaggtggatgctgtgcccggctcgggtacgccgaagccggaaagcccggagccgggaaaggcaccgaaggcttccgaggttgatgcgcagccggacaagcccaaggcggatgaggccaagcagtag

SEQ ID NO: 9087 - DNA, 411 bp, Methylobacterium sp.
atgagcgagatcattgcattcaggaaggtagaagcgccgtcgccccggatcggctcagtggacgtgctgggctcaaacgcggcgagggaagtgttcgcctggcagcgcattctggtgcgtagggctactctgtcaaagctcgcattccgcgtcgggatcgagcttgcccagtcggtggatcgcaagccagggcgtggctacgcggtgcggacgcacgcccagctgatgggcgtgttgcgtgtcaccagccgaagcaagatccaagaggcgatagctcggcttcagcgcctgggctttctgagcgtcgaggtgagccgcggcttgggcatggcgaaccgctatcgcctgacatggccgccccagatcgccctgccggatgcggatggtgacgatgacgtttgcccgttttga

SEQ ID NO: 9088 - DNA, 279 bp, Methylobacterium sp.
atgtccatggaagctgaaatcgccgtcctgcgggccgacctagcacgcacctacgaattgctgaccggcgtcatcaacaccctggcggctcaggtcgcagcatcgcgggccgtgcatgacctgctggacgccgaaggcgtcctgtctcggcatcggctgtgcgagcaggcgcttgcctatgctgagcgtgcgggcttgggcccggaggtggtcgccgtcatgtcctcgatactggcacccaccccgactgccaacgcgtcagccgggctctaccactga

SEQ ID NO: 9089 - DNA, 219 bp, Methylobacterium sp.
atgcccctcttcaattcctcagccatcgaacgcgccgagtacgacgagccgagcagcacgctgcaaatctggttcaccgggagcggaggcccgtacagctactacggcgtgccgcctcacatctatcaaggcttatgcgccgcggcctcgcaggggcagtattatgcagtctatatccgcgacaaatacagcagagatgcgcgcttttatcggaggtaa

SEQ ID NO: 9090 - DNA, 177 bp, Methylobacterium sp.
atgaccacccaaccgaccacgctgcccgaccgggcggcggcgcacgctatcgagcgtgcgcgcctcgacgccctgcgcgcgagcatcgctcaggtgctgagcgctgacctggcccggctgaaccgctgcctggccgctggcacggcccctcaggccactgtgggaggcgcggcatga

SEQ ID NO: 9091 - DNA, 450 bp, Methylobacterium sp.
atgatccggcgtcccatcccgccctgcgagctcacccaggccttccagcaggctggccttgagcccagctaccccgaacatgaggggacgagcccccaggggctcggcaccacctcctgtgcggctgagcaggccgagcttgaggccctggcagccgtcgagtttgaaccctgggacgtgccggacgacgtgctgcccaccaacgctgagtggtccagcatggcgaacccgcacctggcgaccctgcgggcagccacagcggttctgggcatgaccaaggacgagctcatgcagctggccgccgaccccacgtacgatgggctgggggacgacatggccgggaagctgcaccggacggccgagttgatgagctcgtaccgcgtcatggccgaggtggcgcacggccggctgctggcggccatggcggcggcgcagctgagaaccgcgtaa

SEQ ID NO: 9092 - DNA, 156 bp, Methylobacterium sp.
atgaggcagatcgccatcgacgggctgaacactctctccttcctcatccgcggcctagccgcgatcatcgaccagcacccatgggtcggacaggcgattttcttctcgccggtcctgtcagctttgaactggggtccgtatgccttacgatattga

SEQ ID NO: 9093 - DNA, 246 bp, Methylobacterium sp.
atggcagaggacaagcaggccgggaccgagccgaaggtgcctgcggagcgcgccgacctgaaggcgcaaggccagacctcgcccaaaggcgaggacaggcctggcttcgacctaggcggcagcgcggatagggatgcgcagcagggcgcagtgccggacacaggccccgtcagcgacccggagattgggaacgagcagccgaccgaccgcagccagctgaccagcaagaagggaacgccggcctga

SEQ ID NO: 9094 - DNA, 153 bp, Methylobacterium sp.
atggccgacgagccccagaagccgtcccaggtggatgctgtgcccggatcgggcacgccgaagccggaaagcccggagccgggaaaggcaccgaaggcttccgaggttgacgcacagccggacaagcccaaggcggacgacgccaagcagtag

SEQ ID NO: 9095 - DNA, 699 bp, Methylobacterium sp.
atgaccggaccgatcctcatcgtcgacgacgacccgcacatccgcgacgtgatccgcttcgccctcgaaaaggccggctacgcgacggctctcgcccgcgacggcaacgaggcgctcgcccggatcgcggtcgagccgccccggctcatcgtcctcgatgtcggcatgcccggcatggacggcctggagctgtgccgacaggtccgccggacctcggaggtgccgatcctgttcctgtcggcgcgcgacgaggagatcgaccgggttctcgggctggagatcggcggggacgactacgtcaccaagccgttcagcccgcgcgagctggtggcgcgggtcggcagcatcctgcggcgcggcgcggctcgaaccgccgcaacccccgagcctctgttgtcgcatggcggcctgcgcctcgatccggggcgccacgaagcgcgcttcgccggccaggtggtagccgcgaccgcgatcgagttcgcgatcctcgccgcgctcgccgcccgcccggggctggtcctcagccgcgaccagctcatggacgcggcctatggcggccgcgtccatgtctcggaccggaccatcgacagccacgttcggaacatccgcgccaagttcgcggcggccggctgcgccgaggtcgtcgcgacggtgcacggcgtcggcttccgcctcgcggcctgcgagcctcgggcgtga

SEQ ID NO: 9096 - DNA, 1551 bp, Methylobacterium sp.
gtggtgctgggcgtgctcgccatcgtggcgacgctgccgctcgtcggcctgttcttcttccgggtctacgagaacgggctgatccgcgaggccgaggccgagctgatcgcgcagagcgccgtgctggccgcggtagcggcgcgcgagatcgaggccctgcccgagggcgagcggctcctcgggccggtcgtgcgcccgccggaggatccggcggcgcgcgccgcctaccggccgatcgagccgggcctcgatctcaccgcggccgacatccttgagcgccgtccggccgccaccgaacccgcgcgtccgcccgaccaggcggccctcgagatcggcgcacgcctccagcccgtcctgctgcgcacccaggtccacaccctggccggcttccggatcaccgaccggaacggcaccgtgatcgccggccgcagcgaggtgggccggtcgctcgcgcacctgcccgagatcgccgacgcgcttcagggacggttccgggcggtgctgcgccagcgcgtctccgcgcatccgcccccgccgctctactcgatcagccgcggcaccggcgtccgggtcttcaccgcgatgccgatcctggtcggcgaccggatcgggggcgtggtctacgcctcgcgcacgccgagcaacgtggtgcgccacctctacggcgagcgcgccaagctggcgctcgccgccgccgcggtgctcgccgcgacgctcgccatcgcggccctgttctcgcgggcgatcacgcggccgatccacgccctcgtcacccgcagcgccgagatcgcccgcggcaaccgcgccgttctggagcaaccgggcccgctcggcacccgcgagatcgcccgcctcgcgcaggggctcgaccgcatggcccgccagctgcacgagcgctcggactacatcgccaccttcgcggcgcatgtctcgcacgagttgaagacgccgctcaccgcgatccagggagccgccgaactcctgcgggacgcgcagacgagcccggccgacgcgatgagcggcgcggagcaggtccgcttcctcgacaacatcctggccgacacgcggcgtctcaccgccctgctcgggcggctgcgcgaactcgcccgggccgacaatcccgacatccggggaacgacggatctcgccacggtcgtcgccggattgcagcgcgcctgcccagagctcacggtcgcggtggagggcgcccgtgaggagcccttcgcgatgtcggccgagaatgccggcatcgtcttcgcgcacctcgcggacaacgccgtccgccacggcgcggtgacgctccacttggcagcggacctcacgggcggccatctgcgcgtgcgcgtgcaggatgatggcgaggggatcgcgagccagaatcgcgcccgcatcttcgagaccttcttcaccacgcgccgggaggccggtggcacgggcatggggctcgggatcgtccgcgcgatgctgctggcccatggcgggacgatccgcgtgctgccctcggatcacggggccgcgttcgaggtcctggtcccgctccgcgccggctga

SEQ ID NO: 9097 - DNA, 78 bp, Methylobacterium sp.
atgtgcggcatcgtgggaatggtggggcgcgacgcggtcgccgaccagatggtcgaggcgctgcggcggcttgagtac

SEQ ID NO: 9098 - DNA, 150 bp, Methylobacterium sp.
gtgaccgacccggtgagcggagcgctggtcggtctgctgacgggccgcgaccggctgcgggtccgggccgcgaccctgcgcggcgcgggcgaacgccgcgcctgcatcgcccggcccggccgcccacgccggagcggtgcgacgccctga

SEQ ID NO: 9099 - DNA, 90 bp, Methylobacterium sp.
atgagcggaggacgatccgcgatccagcgcgacaacggcccggagcgttcgagcctcgccccctgcatcgagatcgcgccgctggcgtag

SEQ ID NO: 9100 - DNA, 201 bp, Methylobacterium sp.
gtgctccgcgtgcacccgctcggcggcctcggtgaaggtcggaacttcgacgctcaccttgcgccgctcggcaacgggatcgccaccttcacgggccagcttgcggtatccgagcgccttctcccgagcctcagcgaggctgacaaggctgaggccacccaggccgatgtcacggcgccggccctgaacgacggtgcgtag

SEQ ID NO: 9101 - DNA, 450 bp, Methylobacterium sp.
atgatccggcgtcccatcccaccctgcgagctcactcaggccttccagcaggctggccttgagcccagctgccctgaccatgaggggacgagcccccaggggctcggcaccccatcttgtgcagatgagcaggccgagcttgaggccctggcggccgtcgagttcgaaccctgggacgtgccggacgacgtgctgcccaccaacgctgagtggtccagcatggcgaacccgcacctggcgaccctgtgggctgccacagcggttctgggcatgaccaaggacgagctgatgcagctggccgccgatcccgcccatgacggcctgggggacgacatggccagcaagctgcatcggacggccgagttgatgagctcgtaccgcctcatggccgaggtggcgcatggccggctgctggcggccatggcagctgcgcagctgagaaccgcgtag

SEQ ID NO: 9102 - DNA, 270 bp, Methylobacterium sp.
gtggccgcctggttccccgaagaggcccgccgccgccaagcgcggaatcttgccaatcagcgggctgcggccctggtcaggtccaaggctggcgccatggccataagggccatggcggacgccctgatgcggaagggggaaattggagccgatgagatcgaaggcctctgccgtgaggcctacggcggccaacagtgcgagttcggcgcctggaatgcccactggcccccgacgctgggacagctgcgctctggcttcatccctggctga

SEQ ID NO: 9103 - DNA, 237 bp, Methylobacterium sp.
atgaggcggacggttctgttctctgccctcctgctggcggaatgcacgccgcccgagaaggcttactccgcaatgctcaacttctttgaacactttatcgcccgagcgatgaagctcgggcgggctgatctcgatccgttcggcatccttcccgtgatagacgccgtccgagccgcctattcggacactctggtggtgaacggacggcaagtcgaggcgatcgacgcgaaacggtga

SEQ ID NO: 9104 - DNA, 768 bp, Methylobacterium sp.
atggttgatatcccggcgctgcgggccgtgctccccgcttcggtccggatcatcgaggacgcggcgcactgcttcgagggctcgcgcaacggccggcgccccggtcaggacggtgacgccgccatcttttccttctacgcgaccaagaacgtgacctgcggcgagggcggagcggtgatcaccaacgatccggatcttgccgcagcactggttcaaactgttctacacggcatgtcagccggtgccgctcagcgcttccagagtgggacctaccgccactgggacatcgctcgccttgggaccaaggctaacctgccggatctcttggcggccctgctcgagccgcagatcgaccggctcgaggcgcagcttgcgcgccgcgagcagctctgcgggcgctatgaggcggcgctcgccgacacgccctttttgtggccggagatcgaagccggtgtcgtttccgcgcgtcaccttttcccgatccatgtgccagatgggcaacgcgacgcggtgcttcgggtgctgggtgaggccgggatcggtgcaaccgtgaattatcgcagcgtgccttgcctcaccctctatcgatcctctggcgtgccggacctgccgatctcgcgtctctggggtgagggtacgctctcgctgcccctgttcccggacttaacagacggggagcaggacgaggtcattgcggcactgagagcccaggctaacacgatgcgaccgtccaagatggcgcgccatgcagaacccgcgttgccgtga

SEQ ID NO: 9105 - DNA, 699 bp, Methylobacterium sp.
ttgcacccgctgaccgtctacgccgagacctgtgcccgggctgaggaggccgtgctcgcccgaaacagcccctgcttcacgacggcagccctgcgcaacgcgacggtgttcggtctctcgccacggatgcgcttcgatctcgtcgtgaatcagatgactcatgatgctcttgagcacggacgcatcaccatcggaggtgacggcacgcagtggcgccccctcgttcacgtccgggatgttgcgcgggcgatcctgctcgcgatgcgcgcccctcgccgagccatcggtggtcaagcattcaatatcggctgggagaactaccaggtcggcgagatcgcacatgctgtgcagcgtgcggtcacggttccggcacagatcacccatctgccaggggggccggaccgacgcgattaccacgtgagcttcgcaaaggctgagcgcgccctcggcttcagggcgagcctgactgtggaggaggctgtcgtcgagatcgaacgggcgatccggggcaagcgcctgagcaacaccccggcctgctacacggtacattggtataggaggcttctggccgagcggggtcctgggcttcgcctacccgatacggggccgttgcacgtgttgacggaagtgccatccaccgacgcaattatcgcgcgtgatgccgttgctggagcgccggtggcggagcgcgttcaatga

SEQ ID NO: 9106 - DNA, 630 bp, Methylobacterium sp.
ttggacggtgaatgtgacctcgttcttgaggacgagcacacgatagtcttcatcgagtgtaaggcgaagccgattacgcgagcggcgatggcgggcgatgccagcgatgcggtgctggcgtatctcgaagggattgtcgcatctcaggctcaagcgctgcagcatcagtccgtgctcgagaagcatggacgcataactttcggagacggctccgtcctagattggggaggtaggaggatcgtgcgcctgtccatgaccctcttcgactatggcacgttgcaagatcggttggtcttcgcacaactggcgtccacgctcgccaacagcagactgaacgcccgggatccagccgataagtcggcgacccgccgggcaaagaaatcaaaccaaattatcgaaaagcttcgtgagcacctgcagggcgcagagggtcttgatgaggagcttagccgcaagatctgggcacgatcccttcccactgcctccctgtccatcggacaattggcaattctacttgtggaccggaatgccgtgggcaagctagcggatgcactcatgaagccagccagttttgccaccggtagtgtgctgaaggaattctactatatgcgagagcagaaaataatctag

SEQ ID NO: 9107 - DNA, 159 bp, Methylobacterium sp.
ttggagctggtcgctgatcatctgctgatggctcacggccttatcgagcaagatggcgccaaagagatgctgccggtgttgaggcaggctttgatgactgctggcgtgctgctcgcccgaagcacgatgtcgagcgacaccagtgatcgcttccattga

SEQ ID NO: 9108 - DNA, 111 bp, Methylobacterium sp.
gtgacctgcccaccgtccgatcaggatctgagcgccgtgatcgccgtgatctgcttgctggctgggctgatcatcggtggcgcggtcgccgcgcgcgggccgccgggatga

SEQ ID NO: 9109 - DNA, 174 bp, Methylobacterium sp.
atggaccgcgagcgctcggccccgctgacggcggcgatcgacgcctgcaacgcgcgcgccgtagtgccggcccgggcgggcgtactggagaagcgggactggagcccgaaggtcgagatgcggacgccgcgctacacgacccagatgagagagctgccggtcgcggtggcctga

SEQ ID NO: 9110 - DNA, 174 bp, Methylobacterium sp.
ttggacgggaccgatagggcccatctctgcggcgccctggtgatcaccggccggatggccgagaccatcgacgccgaccgcatcggcttcgggaacctcacctactatcggacgcaggtgggcaacccgcacccgcgcctgcgcggcgtctcgatctgggcgttcaagggctga

SEQ ID NO: 9111 - DNA, 183 bp, Methylobacterium sp.
atgcttcgcgctcttggtgatccgcggatcgtccttccgaggcaggctgccgcagcgaccgttcgcacgctggccggccgcccgcccggcccctatccggcggccatggatctcaatgcgctcatcctcatggcctcggccctcaccttctcgggcttcgtcgtgctgctcggctggcgctga

SEQ ID NO: 9112 - DNA, 81 bp, Methylobacterium sp.
atgaatcggaacgccgccttcgatcccgcgggcgtcgcatcgcacggcgcgcgcgcgcggccccgccggaccggcggctga

SEQ ID NO: 9113 - DNA, 87 bp, Methylobacterium sp.
ggcctcgacgccgccgcgatcgtcgccaaggtcaacgaggtcctgcccgagcgccaggacggccgctcgcgcctgcgcctggcttga

SEQ ID NO: 9114 - DNA, 264 bp, Methylobacterium sp.
atgatgacggaggtggacaagctctacttcgcaacgaccggcgagacccatcgcctccgcgatcccttgtgtgatgagatccgccgcgtgcgcatcagacccgtccggttccgccatctgcgaaccatcgtgcgcgccagcgacggcgcctgcatcacggtctgcctcagcaagccagacgatctcggcgactacgcggatttcgagctggccggcgccttcgatgccgacctcgacctcgtggtgggagggcgcagaacatga

SEQ ID NO: 9115 - DNA, 699 bp, Methylobacterium sp.
gtgtccgctgccctggccctcgttcccgcttcccccgatctgtcgcctgcccgtgccgcgctcgtcgccgcattcgccgagcgggaaagcgtgctgcgagcctcagggacgatcgtacaggcccgcgagcgactttccgcagcgctgatcgctcggaccgaagcgcaaggcgccctgaacgctctggcgaccgcagaggccgaggccgtcaccaactggtcattcaccggcaagggccgcgagccgaagcccgacctcggcaagcgccgggatctcgaaggcagactggacgacgcgcgcgtccgcgccgaagccgctcaggccgccgtcgcgaagctcgatgccgctggccaggaaggtgagcgccgcctgcgcgctgccgacgaagcggtctcgctggccctgtccgccgtccttatggaggaggtggaggccgagcttgacgaagccgcacagctcttcgccaaggcccgcgcccgcgtccgcgctgtcacgaagctcgcctgcgaggcgcagaacacctgcgcagaagcgcatcggccccgcgccggaagcctggcgtatcaagcgagcgcgatgctcagccccgctcccgaccaatgggaccgccttggcgactgggctgacacaaagcgcgccgtcgcccagctgattgaggacctccgcaccgagccgactgcaactctttctctggactga

SEQ ID NO: 9116 - DNA, 435 bp, Methylobacterium sp.
atgaacgcgcagatcagcaaagcagacatcgcgaaggcggaagacgcagtggactatcactgcgagggccttcgaggtgcactgttcaagctcaagtggattgacgggcagagcgtcgaggacaagcgcgccgatatgcgcaaggtcttcgagcgcttctccgaaaacctgctgcgggagatgccggacagtgcgaccgcgcagacgcccgagcccacatcgaaggccgcagcgccgaagccggagacgaagaaggacgagccgacctccccggtcgatcgcctcacgaaggtggtcggcgaggtgctgagggccgatccgaagctgagcgccgagcaggcggtgacgaaggctttcgaggccgacccggcagcctacgacgcgatcgagaccgagcgacaggcgatgatccgccgtcgcggcgtttcggagtga

SEQ ID NO: 9117 - DNA, 1332 bp, Methylobacterium sp.
atgaccaaccttgcgacccttgccctcgaatttgcggatgacttggaccgcgactggcgcaccaaggcgcgaccggagcagttgccgccgccgggcgactggctgacttggctggtgctcgccggtcgtggcttcggcaagacccgcaccggtgccgagtgggtgcaggaacaggccatgtcgggccatgtcgggcgcatcgcccttatcgctcccactgcggccgacgcccgagacgtgatgatcgaaggcgacagcgggttgctggccattgccccgaacaggtgccgacctgagtatcaaccggcgctgcggcgcctcacctggccgaacggcgccattgcgacggcgttctcggctgaggagcccgaccgccttcgcggcccgcagcatggcgccatgtggggcgacgagctggcggcttgggtcaacgcgcaggcggtctgggatcaggcacagttcgggcttcggcttggccggcacccgcgcgccctggtgacgacgacgccgcgcccgatcccgctcatccgtgccctgctcaccgacccgcacacggtcgtcacccgcggcaagaccagagacaacatcgcgaacctcgcgcccagccgggtcaaggcgatgtacgaccggtacgagggcacccgcctcggccgccaggaacttgagggcgaggtgctgaccgacacgcccggcgccctttggaagctggaggacatcgacggggctcggatcaagcctgagcaggtgccgacgctcgtgcgtgtcgtggtggcgattgatccggctgtctcgacccgcgatggctcgaacgagacgggcatcgtcgctgcaggggtcgatgcgggcggccacttctacgtgcttgaggacgcctccgggatcctgacccccgatggatgggggcggcgtgcggtggacctgtacgccttccgccgggcagaccgcatcatcggcgaggcgaacaacggcggcgacctgatcgaggcgacggtgcgcaacgtcgatcagaacgcagcttttcggaaggtccacgcctcacgcggcaaagcaacacgcgccgagcctgtggccgctctctacgagcagggccgagtccatcacgcgggccaattcacacggctcgaggatcagttgacggcattcacgcccgactttgatcgcaaccgcgccggctactcgcccgaccgccttgacgctctggtttgggcaatcacggaactgatgggccgaggccagcccgatactggcgtcatcgtcatcccgccgagcatcccgaacgagcgcaagttcagctttgacggtggtggtcttggcctttaccagtacgactag

SEQ ID NO: 9118 - DNA, 243 bp, Methylobacterium sp.
atgcattcgaggtttgtaatgtgcgccattgtagatagcgcgcaattcgggaacgagatcgtccagcatgacacgtgcctgatcccaatcggtgatcaaaacgcgcggatcgacagcgacaacgtgccgtatgccgctgatctcctgacagttcacgagaccccgcgcctccaggcgagcgagcacatcgtaggcgccggttcgggtgatgcccgcacgcgtcgcgacgttcgtaatgggtga

SEQ ID NO: 9119 - DNA, 192 bp, Methylobacterium sp.
gtggccaagctgcgcttctgcgagggcttcgccaaggcgttgcccggcggatgcacagccttcgacgccaagggcctgaccagcgttgcaaccccgatcttcgtgcagtggcgcaacaagggtctcgtgaccgtctacccggacgccgacgccaaggcgaagccggtctggcagggcaaggcggtggagtga

SEQ ID NO: 9120 - DNA, 99 bp, Methylobacterium sp.
gtgcatttgagggcgcgcatcatgtgcggcatcgtgggtatcgtcgggcgcgacgcggtcgccgaccagatggtcgaggcgctgcggcggcttgagtac

SEQ ID NO: 9121 - DNA, 246 bp, Methylobacterium sp.
atgctcggcgttgccgccccggcctcgtctgcgatggccttcccctccgacgcgccgcgcggccactacggcggccactacaccggtttcgccgcggacggggtggagacgacgggcgcgctcggcgtctttggcagccgcaacccggcgagctgcccgatgagctcggcggccgagggcaacgccagccagcagaacttcctcgtgaagcagtacggccagacctctggcggcaaccgctgctga

SEQ ID NO: 9122 - DNA, 147 bp, Methylobacterium sp.
atggaacttaagggctggttgaactgggtgagggggcctgttccggccggtccgggcatcctattcgggagccttgatgcccgccttgtcgacgtggcatgccagatcgcgatgtccgacccgatcctcgacgaggccgtgacctga

SEQ ID NO: 9123 - DNA, 252 bp, Methylobacterium sp.
ttgcgcacgcggtgcatcgtggtccggctgcacaaggacaggctgagcttcggggatgcgccgatgaccatcggccggcagaagatcgatccggaaacctgcggcgacggtctcgcattcgggccctttcccgagctggaacggatggcggataagagccgccagtgcgcggcgcagggcgagaaggattgcgtgctctacacgaacatcccaacgaacatcccacgcgcggcggccaagcgcgggcggtga

SEQ ID NO: 9124 - DNA, 492 bp, Methylobacterium sp.
atggattcggcacgtgaggccgggccggtctgcgtgcgtgagccggcggccctgcgtccggccggtctcacggcgctcttccgcccagaagtcctggcctttcaggcctcgcagcgacaatggggcagcgtcgtcgagctgcgtcccgtctcggcgcgcgcgctgtcgtggtccgccgcgttcgtgacagccctcgtggtggccttcctgtgcctcgcccagtacgcccgcaaggagcccgtgcccggctatctgcgcccgtcgctcgggagcgcgaaggtcttcgtcccgcaggtcggcgtggtccgtgaagtgcgcgtcggcgagggcgcgaccgtccgcaaggggcagcccctgatgatcgtcgacacccagcaggtctcggccggggggcgcgacctgacacaggccgccctcgattccctctctgcccagcgcggcaggctcgcgcgccagatccaggctgaggaggagcgcgtggtctccgagtga

SEQ ID NO: 9125 - DNA, 204 bp, Methylobacterium sp.
atgctgtttgcgggcaccacgccgatcgtcggccagtacctgctgcatgccacgggaaccatcacctcggtgatcctgctcggcatctcgcacgtcgtcgtcaccgtggtctgcgcgatgatgctgatcgcgcgcatcgaagggaccggacagccggccgcgacgccggacgtcgcaccgtccggggcgctgcagcggacctga

SEQ ID NO: 9126 - DNA, 138 bp, Methylobacterium sp.
gtgctcggcgatcgcctccaggagccgcaccttgccgggaccgacgcggtggtcgggaccgagatcgatccggatgctcagacgggtcatcgtgcctccgcggcgcctctggccgaggctatgttcagcggtatatag

SEQ ID NO: 9127 - DNA, 225 bp, Methylobacterium sp.
gtggaggagcagggcgcggcgacccaggagatcgtgcgcaacgtctcgcaagcctcgaccggcacgggcgaggtgacgcgcaacatcgcgggcgtggcgggcgcggccgaggagacgggggcttcggccgcccaggtgctcggcgcggcctccgagctgtcgcgccagtccgagcacctcaacgccgaggtgcagcgcttcctcgcgagcgtcagggcggcatga

SEQ ID NO: 9128 - DNA, 108 bp, Methylobacterium sp.
ttgccggtcccgggcccgcacggcccgaaaggtctcgatctcggcggggccggagcggcggcgctcgatccgggcctgccggagagcctcatcggtccgatgtcgtag

SEQ ID NO: 9129 - DNA, 1224 bp, Methylobacterium sp.
atggccgggggcgcagggttgaacgacagggaaagcagcggctccggggcggtctcggcaccggaggatgccggcctgggagcggtctgggacggcgagtcgcccgagggcggggatgtccgcttcgtgctcgcggaggacggcgcgcgggtgctgcacgcctggccgggcgcgcgggcgctgctgcacgcgctcgcgccggcgggcgtgctcccgcccgcactcgcccggcagatccggcccgcggcgggccccggggcgcggatgctgcgcctacgcctcgacccgcgcgggattgcgccgccgaccctctgccgcgccgctcccggacgagccgccgacgggcgcggcctgatcctgctcgtggtggtcggcccgctgccgatcctgcgcgccggacccgcgcgcgtccggatgcctgcggatacgcctgccgaaggcacgtccgacctcatggtcgagcccctcgccgagtcccgcgtcgaggagcgcgccgccgtgcccgctccggcgcgcgcgcccgttgcccctgccgaccgggaagcgggcgcgccacgcccgggcgaccgcttcctctggcgcagcgacgccgcgggcgcgctcacgcagctctccggcgggggcgacgcgctcgcccgcctcgtcggtgcgtcctgggccgacctcgccgcctcgggccggctgcgcgagggggaggccttcctcgacgcgctggcgcgaagccggaccttccgggggctcggcgccatcctggcgctcgagggcggtgactcggtcgccgccgacctgtcgggcgcgcccctcggccggcccggccaggccttccggggctacggcggattcggcatcgtgcgcgccgtgaccctgaaggacctgacccggcctgtcgcgaacctcgtgcccctgcccgaggcgaccggcaccgagaccgtcgcgcccgagcctccgtccgagcctccggaggcggaagccggatcccgtgagagcgcgggcacgccggacccggccgctgtctcccccgtttccgtcccggtggaggcgaccgtatccggcgcgcccgtgccgcgggagccccccctcctcgccccgccctacccgctggcgccccccttcgggcgcggcctgggcacggatccggtcgcgatggccacgatggccgcgccgctcctcgcggcctggctccagcaggactggttcggctcgcccgcccgcaccgcaccggcg

SEQ ID NO: 9130 - DNA, 165 bp, Methylobacterium sp.
gtggtcgccgatcggttcgaccgggccgccatcatggccgccgcggtctcggccgcccgcgcctatcaggagccggccggctgcacctgggctgaggccatgtcggtcgcgcttaagggcgcgtggcaggcggccaagatcgccaagagccggacggcgcactga

SEQ ID NO: 9131 - DNA, 1494 bp, Methylobacterium sp.
gtggccttcctctttccggaggtggccaaggcggcgcgcgacggtcgcttggatcaggtgatacctggtcggtcgtggcccgcctggagagagccgccggcggtgacggagaaggccacggaccttgacaggtgggtgacggacctcatcgagaggacggcctccccaatgatccgcgaccgggacgcgttgcgtgagatcggcgtgacctgcccctactacgcagcccgctactggtcgttcatcgccttgcaggacgcggcacgggatcaggaggcccactcggcggcccgggcacagcgtctcaaggaccaacgcgacgcctacgtcaccctcgccacggcggcccgccgaaccatcgaaggcgagggcaaggaccgctaccaccatggggacgcaggcccccgcgggaatccctattgggaggacggggcgcgggtttgggacgagcgggtggccgcgcgcgagatcgggaaggccgcctgtgacgccgcaacggcggcactcgcacgggccgaggagttcatccagcgcctcaccgccgagatagaccggatcgcgccgccgactgcccggccggatatctggaagacctcctacgccacgacgatggggaacctgtatcagctcctcaccggggaggaggtgcccgatcacggagacatcttcggcgacctcatcaaggcgcccctcgacatgatcggaacgccgatcaagccttgggggcaggtcaggaccctgcgcaaacggttcagcgaccccgagaacggcccgggtttcggccgtggggccgatggcggcatgggtctcgaaaacctcatacgcttccggatgcgggggccaggcgcggcctgcatcgtgcacgacgccctggagcgcgccgacgtgatgtcggtcgccatgatccgcctcgccgattacaccgatgccccggtcgagaccgttctccgggagtgcctgctcaagccctacatccggcggcatccggccctgaaggagccggaggtcctgttgatccagctcggatggcaggaggagcctcgccccaacgcggtccagagggcgctgcgggagacggtggcgagggccaagggcggcgatatacaggccgccgcggtcatcgagatcctgatgaccatcggcatcgacatcgacctgaccagccggaagttcgcgagcgggctgagttggctggagaggtatgccggcctcgccgtggccgacgtgatgtatgggctataccgggagagcctacgcggcgacgagttgagcggcgcccttctggggctgatcggccagagcgacccggtagccggcgggctgatgggcctcattgatctacggatccatacctccacggaaccggaggacatcgaactgcgcgggctcatcgaggcgcgcacggaacgcgcagaggctaacatcgcgcaccacagggcgacggcagaggccgtgcggaactaccagaaggtgcctccgcgccccgccgtctag

SEQ ID NO: 9132 - DNA, 1077 bp, Methylobacterium sp.
gtgatcgagcaagccttctccacgcaggctgaggcggatgcttgggtcgccgcggaacgcgctcagggccgagagatcaggatcataggacctgcgcgcagggacgagtatttccccggtaccgtgcatcaccagattgcccttggcggcacggagaagggcatgcgctcgatcgcctacatcgcgcagacattcctggcgcaggcgttccccgaccttgcgcgtagcccccagctgcaggcgctcaaggactacactctgcacaacacgggcgcgggctttgtatggtgggagttcgatccgcctaacgacgtgccggcctctccctttgccttcggccatcgcgtcatcgtcggccacgatagcgcagatggcgctgtctacgcacgtgtctctctgtttggcagcctgaactatgccctactcctggcaagggtgccgtccgataccagccgcgcagtgatgaccgacatcgatccgctggcccttcgcgcccctgctgatacgcagaagcaggagtttgcaaaggccgtcagtgccgtgatccgcccggcagatccgatccagatcttaggcgacgccctgcggacaggccgggctgaacaggagatcaataagctcgttggtaggatccaagagttcgagcttaacaagacggcgggcgagttgatgggcacggtggcagcggcatctatcaaaccggaggccgagcgcagggctgatctaacgcaggtcgtcgcgggacaaagtcaacgtctgctcgtgattatgcgcaagtctgcggccgatatgaaatcgtcttgggctggcgcgggagggcagatggtatcatcccttcttgaagccgcactgcgtcaagaccccgcctcagcgaacggcctgagccccgaggctatccgttctcttgagctcgtgcgcccggtcttagtcgagcagatggatcgtgatctcgtcggcgggaggctcgatcaagatcgcctagccatgttgatcggaggcggaccaggagcggccatcatgctcgaagccttgatcccaaatcttgtgcggcgtgcagcgagcggccagagaacttga

SEQ ID NO: 9133 - DNA, 420 bp, Methylobacterium sp.
atgatgacggtgggaatggtgacggccctggcgctcgtcggtggccacgcggccgtggcgcgcgcgatctggccgggcgagcgcgtcgaggatcccggtcccgccctggatccgtacctgaaggctcaggcgggtgccctgtccacggtggtcgctatcaaggagcgcaagctctcggacgcgcacgaggccctggccgcggcccggaagcgcgagaccgcgttgagggtcgagctggacgccgcgaaggccgaggcgcgcgagctagtcgatgagcggtcggcgctccggagggaggtgcgccggttgcgccgggtcgaggtcctggccgcggtcgagggcgacggcgagggagacgagactgccggcgacgatgacgggtccgcggcaccgccggctgggccccgtccgttccaatag

SEQ ID NO: 9134 - DNA, 204 bp, Methylobacterium sp.
atgcacgaggatgccccgcagaaccgtaggaacggccgcccgccgttgccgcccgaggatcggcgcgatcaggccgtggacgtgcgcctgtccccgaccgaggccaagagcatcacggagcgcgcagcgcgggtcgggatgcgcctgcgggagttcatccgtcacgcagccctgaatacccgcatcgtcgcgccctcatcctga

SEQ ID NO: 9135 - DNA, 180 bp, Methylobacterium sp.
gtggcccaccgacacgtagctgatggccgggccctgtccctggccgagcgggccgcgctcctggcctacctgcgcacgccctgcctcgaccggcacggcctcgtggcgaagctcctcgcggtcgagcggtgggcctccgagatcgcacaggacggcttggaggccgtgctcatggtctag

SEQ ID NO: 9136 - DNA, 774 bp, Methylobacterium sp.
atgccgaagccgctgtcggccgagcgccgcgccctcgacgccgcctttgggatgaccagcggctacgtcctcgatttcaccgaccgcacaatggcggagtggttcgaggaggggttcgccatcgacatccagtcgggcgcttacgatgcgactgggacgtcgaaggccaagcgcctacggaccttcattgaggtcgaggatgggcacacggtcggcgctgtgctgcgcgcgctctggatctacgctgaggggatccgaaaccggcgggtcgacccccctgccgaggcggatgttgtcaccgtctttgccttcatcgagcgtgtcgagagggccgaggcgcgtccgcgcacggacgcgctggaacgtttcaaggctgatgagaccctcgacgagctggtcgccgccatccagcgcgacatcgccgtcgacaagccggccccagcgctggaccggctgcacctctactgcatgaaaaagttcgcccacctgctcgatgagcgaagcatcccgtacgaccgggcggagccgctgcacagccgcgtcggcaagtacgtcaaggcgctggagcgcgagcgcgaactgcgccgcatcacggtgcggatgctcaagagcgcgatcggcatcttcgacgaccttaacgatgtccggaacaatgggtccttcgcccacgacaacgacctcgtcgacgcggccgaggcacggttcatcttcgatgcgatcagcgcaatccttcgcttcgtgaagagcgtagacacggcacggttcgggacctga

SEQ ID NO: 9137 - DNA, 1257 bp, Methylobacterium sp.
gtgttttggtcttggcagagcgacatcgcgcagcgggtctgccgtgagttcgtccgctcggctttatcagatgcgctccagaggctcgcagccgaactcggcctcgaagagagcgagcgccccgaactcgaccacgacaccaagggcgaggccgggatggtcgacatcaccgccacgatcctccgcaagatcgaggcggcgtccgtcttcgtggcggacgtgacgtcgatcgcagagaccgggcagggcaagaaggtcgctaacccgaacgtgctgatcgaactggggtacgcgctcaaggcgatcgggccggaggccatcgtgctcgtcgccaatgagcggtatggtggcggccccaccgacctgcccttcgacctacgcaaccgacgcggacccatcacgtacaagctggaccgcaaggcatccgatgaggagttggaagccgctcgggggccgctcgtcgacagtctggtagaggctctgtcggccatactccacgtcgcgcgcacagcccgagacgcagaggctcagcccgtcggccaaccgagccgcaatggcgacccttccgtctggtttccaaccggcgccgcactccaggcgcgggattggtttggccgcgcgcagatgcgccggatcatcctgcccgatgccccgcgcagctacatgcgcatcatcccggccggttggggcaatacacctccgaccgcacaagacctccaccaccccgatgggcatgggccaaggatcaacccgctgggccgcgggaccaacggtgacggcggcctgaacgcggacggagtcctgtactacgagccgatcgagaacacggacgagacggaaaccatcgtccagtggtttgcggacagcggcgagatttggggggtcgataacaaggcagctcgcttgatcggcgaacaaaccctgttcgacatccattatacgacacgccgctgggctacgttcatgagaacggggctcgcagccttgcgggcattcggcgcgcgcggtcccatcctaatcgaagcaggcgctgtccgtctcacggatgtccaatggtacgaggtcagcccgagcgcacgggtatcgggcctgcggccccatgcctgtgcctcgcgcgcatcccgggattgggacgatgccgcacagattgcctttctgaaggatgccgcgaaccaagtccgggccgccttcggcgttcggcaagtctcgattgaagaggtcgatccggtggtgcgagcaggctggcagagcatctga

SEQ ID NO: 9138 - DNA, 141 bp, Methylobacterium sp.
atgggcatcgaagctctagtgatccacgcctaccgcgagaagaaggtcgagcgcctgggcgccgacacccggcgcatcctcgggatccggggaccgtttctgaggagacggctcgccttacgcgaacgagtcgtctcctga

SEQ ID NO: 9139 - DNA, 138 bp, Methylobacterium sp.
gtgccgttcgcgcaggagttggacctcatattcgaagcgcatctgttcgcgataaaaatccccgccctcttcgatccgccgcagcaacctggcaactgcctgcgctgcatcgatccggtagagttctcgcgcaggtaa

SEQ ID NO: 9140 - DNA, 888 bp, Methylobacterium sp.
atgggcgacattttcgcgcggtcagtcagcggcgcgctcaattttgagtacgccctcgacgaagcactctgcaatgctcgcctcgatgcttctcagttgcaaatggcgctcctcaacgtcgtcattaacgcgcgcgacgcgatgccagacggcggcacggtgactatcaaaactgaaaatttgaaaataaacgaggaagaccagcaattgttcgaagggttgatgcccggcgaatatatcgcggtgatggtgaccgacaccggcaccgggatgccgaaagaaatcctcaagcgggtgatggacccgtttttcacgaccaaggaggaagggaaaggcaccggcctcggcctctccatggtttatggctacgccaaacaaagcggcggtgcggcgcgcatctacagcgaggaaggcgttggcacgaccgtcaaactgttgttccccgcaacggaccgacccgtcaacccgatgcagcagaaacaagtctcgtcgtcggcgaggggcggcaccgaacgcattctgatcgtcgacgaccgcgccgatgtggccgagatggcaagcatgatgctggaagctgcaggctatcgcaccgtgatcgccggggatggtcacagcgcgttgaaactgctcaccagcgatccggatatcgatatgatgttcaccgacattgtcatgcccggaagtctcaacggtgtcagcctgtcccgcatggccttggttcgtaagccgaaacttaaaatccttttaacaaccggttttgccgaaacctcatccagtggcgcgattgaaagcgatcttgagtttccgatgatttcgaagccgtacacccagacggatttgctcaagaaggtccgcatcgttctgaacggaccggatggggttagctag

SEQ ID NO: 9141 - DNA, 285 bp, Methylobacterium sp.
atgacgcgtgtcagtctgccggctctcgccggtgccgcggttgttgcgggcggtttcttcgcggcttccatccccgcccaggcccgctgcgttggcatcgccgcctgcgcccagcctccggcgggcatcgccgcgcgtcccggctttgcggcgaaccggcccggcatcgtgaatcctggcatcgcccgcggcaacaatctcgtcggggccggcgccggcaacctcgtcggcgcgggtgccgggaaccttgtcggcgcgggtgctgggaacttccgtccgcgctga

SEQ ID NO: 9142 - DNA, 351 bp, Methylobacterium sp.
atgtttttcctgaaggtgctgcagggcgctattctgatcgatgttatgattaagatgttcttggaaaaactgcagtctcgcgcgattttcctcgattatttgcccccaggttttgacgccgacgctcatattgttggcgtcgtgtacgatcccgtattttcctttcggcgatccatccaaccgatattgaaccgactcgtcatattcgtcggagacgacccagaagtgccatctgacacctttgacagtcctgaagcgatcgtctttgacaacggatcgcgcataatcctcgatttgcgtaagttctttcgtcttgattggcaccttcggagccttcagctcgatcactag

SEQ ID NO: 9143 - DNA, 333 bp, Methylobacterium sp.
atgccgttgttcgctgtatcgcttctctccgagtgccgtgtggcgggtgtcgtcctgcctgacccgatgcatgaactggcgatccacatcgtccaagctcaggacgaggccgaagcgcgtgcgcggggcgcggagcttggtgctcaccggcagcatgcctaccgcaactcggacggcgaggaagtgacatgggttttccgacgcgtggtggaatgtcaggacctctttgagcgcagcttctctgacggcatggaagtctcgtcctggctgtatcggggtgagcgcctctgcctcaacgacggatggtcggcaccctcggctgcgaccggctag

SEQ ID NO: 9144 - DNA, 204 bp, Methylobacterium sp.
atggcgatcgcccgctctgacggctcagccctcggctgcgaagaggtcgagctgcccggtgaagcggcgcgggcgccccttcggcttggccggcggagctgcgggcagcacaggcaagggcgcatgcggtcgtccatacaggaccgcaccaacgatctcgcgctgctcgccacgatgaaaggcgttcagggtatgcgctcctga

SEQ ID NO: 9145 - DNA, 159 bp, Methylobacterium sp.
atggcaacgacgaccttgttggcggcgcagggccagataatcttaccggcggagctgggaacgacatactcgaaggcggaaccggaaatgacgtcatgtttggcggttttggcaatgatgtttattatcactatgccaatactggacttgatactataa

SEQ ID NO: 9146 - DNA, 459 bp, Methylobacterium sp.
atggacatcgaagacgccctcgaccagctcggccggcagatcgggatcggcctgcgcctcgacggggcccgcgcctgccgcctcgtcttcgacggacgcaccgcgctcgacatcgaggccccggcggaccgtcccggcaccgtcttcctgcacagcgcggtcggcctcctgccgccgacgggccggcgcgaggccgtctacgagatgctgctcgccggcaacctgttcggccgcgacacgggccgggccacgctcgggatcgaccgcgacctcggcgagatcctgctcgtccggcagctcgacatggccgagaccccctacgcggccttcgccgacgcggtggaggactgcgtcgcccgggccagggcctggaccgagcggctgcggcagacacacgcggagacgcctgcggccgccggggacgcgctggcgctggcgcggttcggcctgcggatctga

SEQ ID NO: 9147 - DNA, 1527 bp, Methylobacterium sp.
atgacgcacggcatctccggcctctcgccgcgggcgagcctcgacacgacccaggccgccgcgggcacgcggggcagcttccggggcgcggccgtcgaggcggccccggcccagccccgcgccgcgagcgcgctgaagaccgcgtggctcgaggtccggcacttcttcgcctcgctcgtcggcatgcgggtgagcacgacgaagcccgagacggtcgccgacgccgcctcggccacccgcggcgtgctgcacgcgatgaccaagcgcgacctcgacacgctcgacgtggcggaggcgctcgtcggcatgaccgagcacggcgccttcccgcaggatctgaaccggaccgggatcaccgagggcgcggccggcctgttccggccggccctgcaggatctctcggacctgcagctgatgcggctgcaggcgaatctctgccgcaagccggatctgctggagggcctgtcccagctcggaacgggcttcgtcatggacgccgacgagccgagcgtcgccgcgatggccgcgggcggccaggtcaacgacctcggcttcgtgatgatgtccctgcacacctgcctgagggccgagctggccgatcgcgggctcgtgcccgcggacctgccgggaaccccggcggccctggaccccggcctcgaacgcttcgcccagagggccgtggcgaacgagggggacctgcgggccgccatcggggaggcgcgcgtcgatctcgcgcgcgcgcgcgaaacggccgtcctcgacgccctggagcaggcgggcctctacacgcgggaggccgaggccccgccggaggcgccgcccgcccctccgcccgccccgccggacaatgccgccgtcaacgcgcccttcggcgaggcgcgccgcgcctggatcgtcgagacgctcaaccaagcctacctgccgcagaaccaggccagcgagcgcaccggcgcggtcccggtcggccccacgggcgccttcgcggtcgcgcagatcttcaagcgcgacatgatcggcgcgcgcgacatcgccttcgcgggcgagcggctcccgggcacggagggcggcaccgcggcgctcgacgccaacgtcgcgcagttctgccaggcgctgggcgacaggggcgcgaccaagggcgacatcctggccctgtcccgcgtgatgaaccaggcgaccaccggcgtcgtcgcctctcagtacatgctcgatccggacaacgcccccggcctccggctggcggacggcgacacggtgcccatcatcgcggacctgaagggcggggcctggtcgatcacgccgagcgggaccggatacgagatcggctaccgcgccgggcaggatctcgacggatcggcgatggcgacccagggcagccggatcttccggttcggcgagggctcgcggctcgacgtgaccctcaccttcgtgctggagcgcggcacggagggggaactcgccgtgacgggcatgcgggattcccgcatcgcgatccgggccttcgacaccgagggccggcagctcgcctga

SEQ ID NO: 9148 - DNA, 318 bp, Methylobacterium sp.
atgatggcccagcacgtcgaggtggcgatgccgctctgggaatggtcggaggacgacgtggttgcacgcctgatcgagcgccggttgccgttccctcgccactacaccgagatcgtcgatagcctcgaatgcctgtgctgcccggcgatgatcagcgccgagcgcctggcctacctcgatgcgcaccaccctgaggccgccgccttcgtgcgcccgctggcccgccggatcctcgatgccgcccggggagccgtggcgagtagcgacgcagccctcgccgatgccccgcaggccgaacccgaaaaggatgccgcatga

SEQ ID NO: 9149 - DNA, 567 bp, Methylobacterium sp.
gtgaatgcccctctccccgccggccgccgcatccttccgcggctcgcacccgagacgctggcccttcgcgagcgcatcctgtcggcgccgatcatgccggccgtcgaggatgccccctggaccctctccccggatccggccgaggtgctggccatcatctccgacgccgagcccgacctgcacgccgcgggctatggtcggccgcagggctggtccgccgagcggcaggggcgatcatgggccgagatggagacgcccgccttcctggaggagatggaccgcgcggcccggttcctgtcgtacctgcgcgagcaccgccgggaccgctgccccacccgccgctcgtccgccggatgggccacgatcgccgagggcatcatcgccgccccgatcggcaacggcgcgctggtcgccgcagcgctcgccctcgggttcacggtgaagccgcgcgcctcgacggccgaggcatggctgggcctcgccgagaccgcgttcgcgtcgctgcccgggatctcgcccgcagctcgcagctcgggcggcctggccgtggtcgccgcgagcctctga

SEQ ID NO: 9150 - DNA, 285 bp, Methylobacterium sp.
atggccctgaccagcaaagagaagcaggcggcgttccgagcccggcgcaaggctgcggtcgtcgaggtggtgacgctgcgggcggagaacgctggcctccgggacgaactcgccacgctgaagggggagaacgcccgcctcgccggcatcgtggcggccgcgaaggtctcggcctctgccgtgtcggcacgtcccgccccggcttcggtgcgggtccgcctgccggcaccaccggcggagacaagtccgacccgctcgccgacatcaatccgggtccggatctga

SEQ ID NO: 9151 - DNA, 105 bp, Methylobacterium sp.
atgccttgggacaagctggcctgcgaggccgacaaggccaagtggaaggccgcctgcgaggtgagcaaggctccctgcaccaagctcgaggagatcctcaagtag

SEQ ID NO: 9152 - DNA, 267 bp, Methylobacterium sp.
ttggacgtgggttcgatggaaaatccgctcatccgccaatgccacgaactcactgctaaggtagccggcgggtggaccgacgggcagcatgcagccggtgagttgatggggagggctcgcgagatggcagcctcccttccagcttccggcaaaagggacttcttcgccgaccttgctaagcaagcggaggccgccagccggagcctagtagataccgaggtgttcgagctcttcggacagatgttgcgcgtcgaggccgagcgatga

SEQ ID NO: 9153 - DNA, 90 bp, Methylobacterium sp.
atggaaccagcttctctgtccgccatcctgatcgccgtgggcttcgcgctcgtggctatcggccgcctcatcgccgtcttcggcatgtga

SEQ ID NO: 9154 - DNA, 219 bp, Methylobacterium sp.
atggcggttatcgaagccagcactctgacgacggaagccctagagggctacgatcggatgatgctcgaggccacgctgagggtccgcaacttcgcctcgctcgccttcgcggtgtggtcggaagtcctccgcgagctcgacaagcgcgggcgagtgacgctggtctccggctcctacgatgacgtcggcaacgcgctgatcacgcggaactacgagtag

SEQ ID NO: 9155 - DNA, 201 bp, Methylobacterium sp.
atgacgcacgcccgcttccctgatttcagcaccccggccccggttgcccgacgcgttcaggccatcgccctcccggccccgctggctcacccggcactcattctagctgcgcgcgccgcgcgcctcaccggtgagctgctgaccgcctgcgccctgatcggtggcggctgcgccctggtcggcttcgcaagcctcctctga

SEQ ID NO: 9156 - DNA, 492 bp, Methylobacterium sp.
gtggagccgctggacttcgtccgggagtacgtcgagccggccatcaccctttgggccgagcgccccaacagccctgtcctcgcggtctgtgccatcgcgcagatcgacatcctcgccgaggtcgtcgcgatcgcgcaggccggcggcaccctgtctcgcggcgagaccggcccgttccggacggaactcgggcaccgggagccggcgatagcgcggatccgagacgcccacgacagccacaagcacggccggctgagacgtagcagcgggagcgggagtagcatcacgcaggggcagaggccctggcggtccacgggctcggcctggttcctcggccgcagtcgcgtggggagcgttctgggcaggaagagcacggccatcttgctggacgatggcactcccatcgacatcgccgttctgatccgagaggctatggcggcttgggaccgcgagctgcgtcgactgagatatcgcccatcggaggaagggtag

SEQ ID NO: 9157 - DNA, 288 bp, Methylobacterium sp.
gtgctctacggcggccagggcgacgacacgctgaacggtggggtcggcgacgacacgctggtcggcgggctcggggcggacgtctacgtcttcggcgccacgtccggccgcgacctgatcctgggcttcgaccggggcgcgggcgaccggatcgcgcttggcgggcagaccgacacggtctcctcggcgcagaacggggacgcggtgctcctgctctcgggcggcggcgtagtcgatctggccgggatccgggccgatcaggtcgacgcgagcttcctcgcggcctga

SEQ ID NO: 9158 - DNA, 102 bp, Methylobacterium sp.
ggcctcgacgccgccgcgatcgtcgccaaggtcaacgaggtcctgcccgagcgcaaggcacgtacctccaacgtggtcagcgtcggccgccgccagcgctga

SEQ ID NO: 9159 - DNA, 207 bp, Methylobacterium sp.
atgccggcgggggcggtccgggtcagcatcggcctcgcctgcgccgcgccgggcaccgcggccgacgccgtctaccggcgcgcggacggcgcgctctacgacgcgaaggcgagcggacggaaccggacctgctgcgccccggcgcccgagccttcggagccgcccgccgcgcgcggaggcgccggcctgcggctggccgaggcgtag

SEQ ID NO: 9160 - DNA, 213 bp, Methylobacterium sp.
atggaccgcttgaattttcaggcctggcgtattcttgattttgtatttgaccacaagacgatcgagcgtttcttggttgaattttctatagttcccatcaagaactttgacttcgccaacagagtatccgtattccgcgtcatcaacgccctcggtctggcctatttttggatgataagccttggcatgctcgttcacggggatgagacgtga

SEQ ID NO: 9161 - DNA, 183 bp, Methylobacterium sp.
gtgaaccgcaccctgcaggagatgcgctccgccgggttgatcgtcctgaagagcaaggcgctcaccatcccggatctgacggccctgcagaaggtggcgctgttcaacgcgaactacctgcacctggagcacgagggtgcccacctcgacgcgaacgaacccggggagcgtgcgaacggttga

SEQ ID NO: 9162 - DNA, 96 bp, Methylobacterium sp.
gtgacggccaaggcggtggtgcagttcaggccgggcaaggccatgcgcgagcgcctgaacccggccctccgccagcttcccctggccgcggagtag

SEQ ID NO: 9163 - DNA, 204 bp, Methylobacterium sp.
atgatcacacgccgataccgggagccacgcgggctccactcggatcaggccgaatatggcttctacgtcaggctatccggagccgaccgggagttgatgaagcgtgcacttgaggtcgccaccgaacgccttggtggtcgccccagcaatccgatgctcctcgtggagatgatgaaggtcttcaccgatggggctgaggcatga

SEQ ID NO: 9164 - DNA, 234 bp, Methylobacterium sp.
ttgctcctgagcatgatcgaatgccgcacattaacgttcaagagcttcttcagatcgcccgaggatcagttggtggtcctcaagcacaccgttaccagcgcaaagggcagaaagatcagggtcgattggatggatttcgagtcaaccactgagacacagagcatcatagatcgactcgcgaaactgaacgctttcctaaaggatgcagacatcagcttcatcgttgtgacctga

SEQ ID NO: 9165 - DNA, 240 bp, Methylobacterium sp.
atgaagatggttgcccgcggagcgcctgcggatggcaatcgcggtctgctacaccagttgcgtaacgacaaaaagttcgcccacgaaatcggtgccctcgtccaggatggccggaagcacttcggcgaggcctatccgggccagacgcgcacgtcccacttcagcaatgatgaatgggccaaggccggctatgaagacgtcgccgagattggccacctcatgggcttgaaaggcctctga

SEQ ID NO: 9166 - DNA, 342 bp, Methylobacterium sp.
atgatggcccagaccctcgacgccatcccgcccctgcgcaacggtcggcgcggccgcccgcgtcggcgacccgacaagttgcacgccgacaaggcctacgacgccagggcccgacgccaggagtgccgggtgcgcgggatcgtgccgcgcatcgcccgcaagggcatcgagagcagcgagaggctcgggcgccaccgctgggtcgtggagcgcactcacgcttggttcaaccgcttccgacgccggccgatccgctacgagcgccgggccgacatctacgacgccttcaccagcctggctgccagcctcatcaccctcaaccagatcagacggttctgttag

SEQ ID NO: 9167 - DNA, 348 bp, Methylobacterium sp.
ttggcggatctcggcatcgcgatgaaggcggcctgggacgtggccgacgacgtgcggaccgggcgcctcgtgcgcatcctgccggactggtggggtgggacggatcggtgggtccgcatcgtctacccggcgcgtctgcaccagccccggcgggttcgcgccttcatcgccttcatggaagacgagatgacgacgtccctggccgagagcgcggatctcggcctgttcgaggctgcggcgctggcgaagctgcagccgcgcatcgacgccgtgcggcgccgtcccgagcctaaactcgccgagcctcgcctcgccgagcccggactcgccgaggcgaaacccgcctga

SEQ ID NO: 9168 - DNA, 108 bp, Methylobacterium sp.
ctcacgggtcaggtgcgcaacatcgcggacgtgacgaccgcggtggccaacggggacctgtccaagaagatcaccgtcgacgtgaagggcgagatcctggagctgaag

SEQ ID NO: 9169 - DNA, 105 bp, Methylobacterium sp.
ctcgacctcgtggagggcggtgcgggcgacgacacccagtacggcggcgacggcgacgacgtgctcggcggccagggcggcaacgatctcctcgacggacagagc

SEQ ID NO: 9170 - DNA, 99 bp, Methylobacterium sp.
atgccgttcgccacccgccctgcgcatctgatgcgcgccgccgccatcgtcgcgatcgcgggcctcgccgggccggcgttcgcccagccgaagaagccg

SEQ ID NO: 9171 - DNA, 279 bp, Methylobacterium sp.
acgaacggcaccgagttgtgggtgacggacggcaccgacgcaggcaccaccctcctcaaggacatcgacgcaggatccgattcctcctttcccgacggcttcacaacgctgggcaatggcaagatccttttccaggccaccaccacgacgaacggcgccgagttgtgggtgacggacggcaccgccgcgggcaccaccctcctcaaggacatagaagtaggatccgccagttcctccccgcgcggcttcacggcgctgggcgacggcaagatcctgttc

SEQ ID NO: 9172 - DNA, 183 bp, Methylobacterium sp.
atggctgccgctgtcgatccggctgacgaggccgggcttcgggtaggtgtcgagttcgagacgcagagccgcgacggcgcgcggggcgaggtgcgcgcagagcgccgccgccctcccccctctgcgggggagggtaccctgtgcagcagggggggccgggacgaggtcccgcaagaggggtga

SEQ ID NO: 9173 - DNA, 600 bp, Methylobacterium sp.
atgaaccaggaggccatagaaccgtattacaacgagcttgagcgagaaatgctcgacgctttctatgcacatatccgctctcacccgatgaagacgtatcttcattggaatatgcgtgataagaactatggctttcacgcgatcgagcatcggtatcgcgtgctcgggggcgagccgttttcgatcgaggacgataagaagctcgatctctcccgcctgttcatcgacatgtacggggtcggctatatcggtcatccgcgcttggagaagctactagaggaaaaccatatcgaggcgcgcgacttcctgaacggagctggcgaagcgcaagcttttgtcgatggcaaatatgttgatctgcaccgctcgacattaaggaaagttgacgttcttgcgaaccttgccacgaggtcgcatgacgataagctcaaaacactatcgagctggactcaatcaaggggactgtcaccaaaaacgatcgtctccctcgcgaaagagcactggcttgtgacgggcgttattgttctcgggggcctcatcagcgctagcttggctgcgtggcgactgatcatctcggtgtcatcgggtacgccacactaa

SEQ ID NO: 9174 - DNA, 1209 bp, Methylobacterium sp.
gtgtcgctcgacaagatcgtcgctctgaaccagtccggaagtgttcaggccgagacgctcagcatggagatctattctcagacccgcaccatcctgatcgtggtgggtctccttgccgtcggtctcgcggcaatgctcggtgtggcgatcgtccgcacgatcagtcgcgacatcgcctcggtggtggagccgatgaacgcgctggccgctggcgacgcgagcgtgaccattccacatcagggtgcgcagacagagatcggcgtcatcgccgcttccgtgcaggtcttcaaggacaacctgatccgcacccgcgagctcgaggcggagacggcgctggcgcgggcctcggcggaggagcagcgcaaggccggcatgcggcagatggccgacggcttcgagcaggcggtcggcggcatcgtcggcatggtctcctcggcggccagcgagctgcaggccaccgcccagggcatgagcgccaccgccggccagaccgcctcccagtccaccagcgtggcggcggccgccgcccaggcggctgccaacgtcaacacggtggcggccgcggccgaggagctcggctcgtcggtggccgagatcggccggcaggtctcgggctcggccgatctggcgcaggcggcggtggccgaggccaacgccacggcgggcctcgtgcaggatctggcccaggccgccagccgcatcggcgacgtggtggcgctgatctcgcagatcgccggccagaccaacctgctggccttgaacgccacgatcgaggcggcgcgcgcgggcgaggcggggcggggcttcgcggtggtggcggccgaggtgaaggagctggcctcgcagacggcgcgggcgacggaggagatctcgacgcagatcggccggatccagggctcgacggatcaggcggttggcgcgatcggcgggatcggggcgcgcatccgggagatcgccggggtggcggcctcgatcgcggcggcggtggaggagcagggcgcggcgacccaggagatcgtgcgcaacgtcgccgaagcctcgaccggcacgggcgaggtgacgcgcaacatcgcgggcgtggcgggcgcggccgaggagacgggagcttcggccgcccaggtgctcggcgcggcctccgagctgtcgcgccagtccgagcacctctcgggggaggtcagccgcttcctcgcgaccattcgggcggcttaa

SEQ ID NO: 9175 - DNA, 543 bp, Methylobacterium sp.
atgctcagccccgtaccggtggccggcatcgatgccggcaagcacttcctcgacctcggcttccagcccgccgccaaggggctgcgctgcgagaacagccccgctggcatccagagcgtgatcgaggccctgcgccagcgcggcgtcgtgcgcgtggcgctggaggcgatcggtccctacgcccagcccctcgtgacggcgctggtggccgccggcttctcggtcgccctggtcgatccgcgccggatcaaggccttccgcaccgccgagggcctgatcgccaagaccgaccggctggacgccggcctgatcgcccgctttgctgcgcgcatgagcgagcacctgcgccccgcccccgagcccgagccgatcgccctcaaggccctgtccacgcgccggcgccagctcaccgcgctagtcatcctgactcacccgtctcgtcacgccccggcactgctcgtcgtcgcagaagtagacgtgagccaccgaccggccggcggcgtcctcgatcgcgaaggactcgccgaactggcggatgtgtag

SEQ ID NO: 9176 - DNA, 204 bp, Methylobacterium sp.
atgtcggagcttcgctaccagcagtctggcacctgggccgatggaacgccgcgtctcgacgtggaggcggtcgagcatccggccgaggcaaccccggccgacgcgcgctcgggtgtgtcgcccgagcgccagagggagcgggtcgccgctgccgtagcgacgacgatccgccgctttgtctcagggggccttcgggatgcctga

SEQ ID NO: 9177 - DNA, 102 bp, Methylobacterium sp.
atgaccgtcgcccaggtgctgatgagcaccgacatggcccggctgaacggctgcctggccgccggcacggccccacaggccactgtgggaggcacggcatga

SEQ ID NO: 9178 - DNA, 96 bp, Methylobacterium sp.
atgaagttggctaggatgaagatccatgccttcgtattgactgtacctttggcagtcatgcacggcggcgaaatcagttgcgagatcgacgagtga

SEQ ID NO: 9179 - DNA, 195 bp, Methylobacterium sp.
atgatccccgtcagcatgggtcaggaccacgttatctacgtgctcggtgttgtagccgtcgcgaatatgtttgatgagacctggtgccgtatcggcataaccgccgtcaacaatatgaacagtgtagccgtaggcatcgttgccgtaacgcagtgcgatggcgtctccactactcgctttggtacctacgggtag

SEQ ID NO: 9180 - DNA, 297 bp, Methylobacterium sp.
ttgagttcggacgcacacgtcatcaaccgggctgccagcgtcggcgcgagcgaccgcttcgtgcgctggctcggcaggatcgcgaccgtcaccggcgtcctgatgttcgtctcctatctcgaccagatccagctgaacctcgccggacagaagggctcggtcattcagccgctcgccacggtggtgaattgcgggctgtggacgacctacggcgccctgcgccgggactggccggtctccttcgccaacgcccccggaatcgtcctcggagccgtcgccctgatcaccgcgctctga

SEQ ID NO: 9181 - DNA, 195 bp, Methylobacterium sp.
accctcaagcgccacctcaccacccacggcctcgacccgcgcgcctaccgccagaggtacggcctgcccgacgactaccccatggtcgcccccgcctacgccgcccagcgctccgccctcgccaagcagatcggtctcggtcgccccggcgccctcgccgagcgcgaggccggcggtcgtcgcaaggccgcctga

SEQ ID NO: 9182 - DNA, 1041 bp, Methylobacterium sp.
atgctcagccccgtaccggtggccggcatcgatgccggcaagcacttcctcgacctcggcttccagcccgccgccaaggggctgcgctgcgagaacagccccgctggcatccagagcgtgatcgaggccctgcgccagcgcggcgtcgtgcgcgtggcgctggaggcgatcggtccctacgcccagcccctcgtgacggcgctggtggccgccggcttctcggtcgccctggtcgatccgcgccggatcaaggccttccgcaccgccgagggcctgatcgccaagaccgaccggctggacgccggcctgatcgcccgctttgctgcgcgcatgagcgagcacctgcgccccgcccccgagcccgagccgatcgccctcaaggccctgtccacgcgccggcgccagctcaccgcgctggtcgccatggagaagacgcgcctcaagcaggccctcgatcccctggttgccgacagccaccgggcggtgatcgccaccctggaggcggcctgtgccgcagtcgagacggctctcgaacgccgcatcgccgccgatccggcgctggcccgcaagcgtgcgatcctgacctcgatcccggggatcggcgcgcgcatcgcgggcgtgctcatcaccgacatgcccgaactcggccggatcgaccgcaaggcggcggccagtctggccggcctggcgccgcatccgagccagagcggggccggtcccggccgccacgccatcgcgggcgggcggccctgcctgcgcgcggccttctatatggccggcctggtcgccgcccgtgcctgtccggccttccgcgggccctacaaggccatgcgggaggccggcaagccggccaaggtcgccatcgtggccacaggccggcgcctcgtcgtcctggccaacccactcatccgagaggacaaaaccttccccgaaagcaccagcgcgcttgacccgcaatacagtcgccggttgatcgattcggccgtgggggggggtgaaccgcgccgcgccccctctcccatagggagagggttggggtga

SEQ ID NO: 9183 - DNA, 1032 bp, Methylobacterium sp.
ttggtcggcgtccttcagcgcatggccaagggcgagatcgaagctgagatcacggaagctgctcgcggcgacgagatcggggccgtcggccgggcggtcgagggcatcaaggccatggtggcccgcaaggccgccgaggaggccgaggtgcggcgccggagcgacgcggccgcagcggccgagcgcaagcgcacgatggtggagctcgccgacggtttcgaggcggcggtgggcgggatcgtggggctggtctcgtcctcgtccaccgagctgcaggcgacggcccagcagatgaccatgaccgcgacggagacggccagccagtcgaccaccgtcgcggccgcggccgagcaggcttcctcgaacgtcaacacggttgcgtcggccgccgaggaactgggcgcctccgtgcgggagatcggccgccaggtctcgggctcgtccgacctcgcgcaggtggcggtggatgaggcggaccgcaccgcggcgcaggtgcacgagctgagccgggccgtgaccaaggtcggcgacgtggttcagctgatctcgaccatcgcggcccagaccaacctgctggccttgaacgccacgatcgaggcggcccgcgcgggcgaggccggccgcggcttcgcggtggtggccgccgaggtgaaggaactcgccaaccagaccggccgggcgaccgacgagatcgccagccagatcggccacatccagggcgcgacggggcaggcggtcgaggcgatcggctcgatcacggggcgcatccagcagatcagcaccgtcgcgacgacgatcgcggcggccgtcgagcagcagggtgcggccacgcaggagatcgtgcgcaacgtgacccaggcatcggccgggacccgggaggtgacgagcaacatcgcgggggtggcgcaggcctccgaggagaccggtgcggcggccagccaggtgctcgcctcggcctcggagctgtcccggcagtccgagcacctctcggccgaggtgcagcgcttcctcgccaccgtccgcgccgcctga

SEQ ID NO: 9184 - DNA, 99 bp, Methylobacterium sp.
gccggggcgacgggctggctcgtcaagcctgtccaggccgacaagctcctgcaggtgatccggcaggtcgcgccggccgtgcagccgcaagccgcctga

SEQ ID NO: 9185 - DNA, 480 bp, Methylobacterium sp.
cggggacgtctggcgctcgccggcaacggggcgacgggcggggagggcgccgcgctgcgcgcgctcgccgccgaggccggcatcgccggatccgtgacggtgggcggccccgtcttcgggccggagaaggatcggacgctgcgcagctgggatttcttcgtccagtcctcgcgcttcgacgggctgccgatcggcgcggtcgaggcggcgctcgcgggcctgccgctgatcgtctcgaccgccaccggcctcgccgaggcggtcgagcgccacggcgccggcttcgtcgtgcgcgacctctcgcccggggcggtggcggacgcgctcggacaggccgcccggctgacgcccgaggcctgggtgcgcatgtcgcgcgcggcccacgcgatggccctcgtcacgggcgactgggcccgctcggcggaggcgcttcagcacctctacgcggccggcagcgacgacctcaggctcgccggctga

SEQ ID NO: 9186 - DNA, 126 bp, Methylobacterium sp.
cggtcccgcaggcccgcgagcgaggttatcgaggcccaggccttcgagccccttcagcaccggagccacgctgcgcccgagcccccgcacgacgctgtcgacggccgcgcgtacacgctctggtga

SEQ ID NO: 9187 - DNA, 153 bp, Methylobacterium sp.
aacggcaccgagctgtgggtgacggacggcaccgcagccggcacatccctcctcaaggacatcaacgccgggtccagcagctccaccccgaccggcttcacggcgctgggcgacggcaagatcctgttcagcgccagcaccgcggcgaacggc

SEQ ID NO: 9188 - DNA, 297 bp, Methylobacterium sp.
atgaggatcgagttcgccgatgacgacttggcgcgcatatgcacggatcaagcctacaagatgggcctgccggttgctgtgattaaggcggccagaaataggcttgtacagatggaagccgccaaggatgagcgcgacctcagaaatctaaaaagcttgaactacaaaaaaagaaacagacaggacgaaggcatcagatcagtgtgtatcaacgaccagtacaggatcttatttacactctcagaggacgagcgaccgccggtccttcgcgtcattgcgattggcgacacgcattaa
